United States Patent 7,868,149 (PLANT GENOME SEQUENCE AND USES THEREOF) - sequence listing, part 2

SEQ ID NO: 510 - DNA, 35217 bp, Oryza sativa
actccatcaaacacctcatgtgcaatgaatagtgctatccctaattaaaccccattttagcctatctcctatacaattttaatcctataaactctaattttacttagttaaatgttaactaaatttaagtactaaatcctcatgaaaatttatccaaaattattaccacccatatttatttatttatcgcataaatgaattctttttagattaatttgggttattgaccctaaggtgaacttatatatttttgaaaactttgaggtaatattgaatttaatataacgacttgtcatgattaatacattagcagattggtcgagtttagttgtatagcaatatattttacacggatgggttcaatctatttattctctaaatagtaaattgagactcggcacaatattaatctaattgtttaattaaaaactcacataattttataaagcttaatttaattatatgaccattattttatatgagtgactttatcaagtgttcaaatattaatgtatatatattcccatgaaattctcatttgttaataggatcattatagtggtaatcatcatttcatgtgaatttataatacttcatgtgagattggatccacatacattagatttaatcttacaatctcattagttaaacctgacatcgagctatcaacatggttcgaatatttaatatttgatctatgatttataatagaaattaatattttatttggcttgctttcttgtgcactaatgtattcttgtatcatatatttattgttcaggtgtacgccattaatttgattctccattgttacaatttatatttggcaagcaatgacaaccataacacccagcatgatgcaaaagttttaaaaagttcgaaattttagtgatttttattattaggaattttcaagatgttacatctaacctcttgggaaatttcctttgagtctatctctctgatccgattcctgcgtttttcctgcgctccaatcaaacgactattcctgtgtttttcctgtgttttgcaatcctttgttttatacttcaattcctattagaatcctgtgtttttcctattcctctattttttcaaccctgtgattcaaaggggccctaaagtcaggaaaaagaaccactacacaccaacatcacctaaacaaacaaccgacgaaggaactaggaccggaccgaccgtcgctatacgctatacgaacaaaggagttacaattatattgcctaacaccgactccgaacagttgaacacttgacctcacatatgtcacctgattaacgatttcattcattttcactacccaagccaccgtctcacctcattagcaatgctacacagtgccagataccgttcctaaacctagaggcttaacctcaccgggacactaagattgccctcgaagtctcgaactgctagggtaaatcgttcatcaatcatcttgtctgtgtatccataatatccataaaagggccaattcaacaagagaagaaccgatgaaattataagcacaaatggataaggcactggttactaacccatatgttgcagttgcacagactactgttattgattttataaatattgaaattttccagtaaactaattttctagtaaattatagcgcataaattaaaataagaatatactttacttcaattacagctttctagtaaactaatttcgaatttggaatacactaataaaatgctaaattccaagtccaacccggtataattaattttaaaattgttatgttttggaaaagactaatctaaacggtccatgctatcttggcgagaatacacttcctccatcccaaaatataagcaatattagcatagtgtcaagtgatacttttttactttaactatttatagaaaaaaaagatcaatcatataaaattgatgttattagatttatcttaaacaaactattataatatgaaaactctttttatttaaaatatcttatttttatatatattattgatcaaaatagcatatcgaagactgtatcgaagttaaaaatacttatattttaagacggagagagtagagcagacgtcctcatcatagtctgtgacccttactaccttactacgcatccaacacatgcctacggtaacggatgttcaaatgcaggatcgtggagggaacttgaggggttttttatgagcaaagacccggacgcgccgacgctgcggggcccgtcgggctcacgtgacgaactgtgagagtgaaatttgtttaagatacaagaaagaaaaaactaggaagaatagagtcacaggctcacagcgggatggattcggtgcgtcttagctgcattattcgatccgtcgtcttctgccttatccgcgccggcccgagtctgacttgcccacgatccgtccaaaaaccccccaaaccgaaaacaagctgcctcggaacgaaattcccgggcactccggctgcttaaactgaaccccgacgcacggctacagaaatctcctgtcatcaaccggtgagcgacacaggttttctggtggcgtagtggttatctctcagacagcgcaatccccgtcctcgtgaaggcactcatcacgcttgccctgcctgtttcgtagacagctcgagaagcaaagatacgcagtcagttgggaacagaacatcagcgaaaacggagcaggaaagttagcccgtacgatcagccggaactgaaaggaggaggagcaaagaatccaagctggggagtggggaggggaggggagacgaaggcgcggaacaaaacgaaaacaattgcgtggttgcttaagacaagacacgggtttagtgtgggagtggaagtgggagccacgcgtgcgtgcgtggagcgcggctgcgcgcgcaggccgggcaaggcagcgaggcagccggcagcagaggaggcggcagtagaagaaaaggcgcgtcgcggtcaccacggccggtcaccaccacatatcttctcggtgccccaccaccaccaccaccatcgccattaccgctctggttaggtcggaaaatgcagctgggtccaaacgagtgagtcaccaccaccaccctgcacttccacaaaaacaacggtgcaaacaaaaaaaatctcgccccgcgcgcccgtcaaaactcccatgccatcatcttcgtctagcacggtactagcagtagcgcttgatcacgagaagccagtgtctcaggttctgagcgagcactgctaccgctgcagctgctgcaccaaagcttgtgcgtaaacaaacactactgggaacgcacgcgaggccatgtacctgagcaaaggcaaggagagccccaagaggtgtagaggtgtacagtagatgttccatttttcaaacagttctgttccaggtacagagagcccaccaccaaggcagagtgggaggacacacttgcatcagcaagactagacttggattaacttgcaaaggaccctacctcccagtttcattcctgcctcatctcaatcacaggagtactacaaacttctgcaaacatgcaacatctccatctatatctgatgccgattgcttctacccctcgctatctcaaccctcatcctcctaactaaggggctgtttggttttcagggacttattcacctcagatatttaaacactaatttaaaatattaaacatccactaattacaaaacccatttcataagtttagactaattcgcgagacaaatcttttaagtctaattacaacatgactttgacaatatgatgctatagtaaacttttaataattatggattaattaggcttaaaaaattcgcctcacagataagctctcatttatgaaattaatttttaaattagtctatgtttaatactctaaattaacgtcaaacatccgatgtgacatagactaacaagttttagccccatctaatcaccccctaagcatatcatgctgttacagttgacaccatcacgcgatgtaaccaagggtgcacgcaacacacaccaacctgtcatcgctcacactgctgctgtgctgtgctgcactcttctctcctggccttggggaataaaacaaggcgatcggtttgctttcgtcttcctccccttctcgccatgcaaagggcgctttggttcttggtttcttcttccttttgcctcagaaataatcacaccggcattgatgaaccaagcatatgcaggtactacctcagagaaaaaaaaaactccttcgggtaagctagaatggaaatgaagttctgcgctagcgctgccgcggctgcactgctgctacagcagcagtgccctaacaaactatagtaaaagcttttgagctggagcaccggaaagctgaattcctagacctaacatgacctaaaggcacctaactctaattaatccaaccggaactaagataatactggaaaagaaaggggaaaaaaatccaggtacggtacaggactaatacggctggaaaaatgtacagccaccgcgggggcgcgcggggtggctagcttgctttagctagaacgacgccacggcgggcgctgcggcggcggcggcggtgaggagtccggagccgacctccttcttgcgcctcatctcgagcaccttgcggtgggagttggagtggatggcgctcacgaaggtggggctgcacgccgggcggtactcggggaggagccggccggacttgtagcggacgccgcacgcgttgcagagcgtcttggcgccctccggccccgcgcgccactgcggggtcttctgcacgccgcagtggctacagcgccggtcgcccggcgcgggggccgacgccgccgcgcccgagggatgtggtgggagctgcttcggcttgcggccacgcttcttaggcttgttcttgccgttcttaccgtgcttggacttcttccccggcggcagaaggtgatcgtccgggaggtccgacgtgccgccgagcgggtgccactcaaacttgaggagcggcgagaacgacgagaacgaagccgacgaggagcacgaggaggtggtggttgtggacgaggatgacgtggagtccgagaaaggcggtgcccccgagagagaccacgccgtggcccgagagcgcttgctgcgtttcgccttcaccggcaccagcgcctccgttgacagcgcgcagatggtcggagtccgcaccggataggacgcgggtggcagcgcgcggtaagctccgtcctgaggccgccgctgcagctgccgaggctgcggcggccgcgcggccagcgacgccacgacggacgcaggaggctgcggcggcgggggcaactcggaaagggagtcgtccatgatacgcgacacccactctagctcctcgacgtcatgcgcctgcagagaaaccatacagcacagcaagaaattaattacagggggaaaaaaaagacaaccatcgcgaaagccgcagcctttccgccgaaaggcacggtcaacgagagtctcgagaaacctcaccggcaggtcaacaatctccggaggcggcggcgggggcgccacaagctcgtacgttacgacggacgacggctgggagtcgtccttcgacttttcctcctctggcgcggcgacgagggccagcgcctgctcgttctcctcggcggcgtccttttccgcctcgcagaactcctcgaggtcgagcaggtcctcgacggagaacccgtccctctcaaccatcccccacgccgacggcgccgcggccgccccctcgtcggccgcctcctccgaccggcaactacttttcagcgcgtccatcttcccatccttctccgtccaaaaggcacccacatacacacacagcaaaaaccataaattcccaaaattccagaaaccaagcaaacacaggctcaagaaacgcccgttctcctcctcgtcatcccccttcccataaaaaatcccatcaaagaattataaaagagtcgttttcttatcgtctcctgaggctaacgctcccttccttaccagagaactgtggtggtgcgcgtaggacggcatggctgaggaggagcgggaggtgttggaaccctgggcggcggtggcggcggcttttgaggcgaagaggagaggaggcgagagggggggcggaggaggggaaggaaagggtggaagaagggatgagcgtttggtggagcattgaatggctgccaaagtccgtgcccacaacaaatgcgccagtttcccctcgaccctcacctttctcccattttactcctccccaattccttttccctcccttccaaatctttcctcttttcttcttttctttttctgcccttggtgcttactgctttctatctttgattttttaagttgttttttagccttttttaaatcctatcttgccacttcgtaatctcatctgtctgatatcactctccctttttgtatacgccctcttttcgaagaagccaaaagagaggggtgaaatgtgaaatggggcagtggtggtaaccgtagccacccccagacagccagactttgggcgccgcgcgcgggagcgtttgcgtgtttccggtctaccccgccccgcctcgccgggccgcctcgcgattagtgtgcgtgacgggggtgggctgggccggacgattgaacggatggggtttgggtaaaagtaagcgagggattagtggccgggggggacacttggtggggccaggaggcactgatgcctctcttcttttggaggtaaatcataaatggcgtcttttttgaaatgtgagtgcggattgtggaaaggttcaaattggattttgctcgggatgggtgggtttgcttccagttcaatctttgccagggctctgttgctgtattcaattattcatgtgctgaggatttggtattaatcaatgtatatatacgtccatccttctaaaaatacctatatgcatttacagattggcttggaaaaaccattcaaacattaatcggctgctttaatagtagtattctgcgaacacagcaaattgtctccataaaaataggggtgaaaacgaaatggattatgtatggtgatcataccatatcctaaacatatttgttaaacggattcgaggcagatatggatagtgagcggatatggattgtttcggctgtcgaaaatagtgcaggatcggcgcagacatggatcagaaatagattaaatttatcggatgttatatgtgtatgcaagtaataaacgattgagttagcaatgcaaagtcaacgatgcaataatcaataaacgacccatcataataataattgtgtaattaagtgctaacaacatgaatacatgatatgtgtaatatagaaatacatctaaataagtgtgagatagacggtgaaagtatctgactaagaaatcttagtattattcaacaaacggcctatcggataattcaatagaaatatcggataatatgcatccgctaaatttctagaacacataccatatactcgtttcagagcggatcggatcggataatatccaatccatttcaccctacatagaaatataggatttgcatttttctaactaacaagtacacaatgtgcatgttgggaaggaagttttgagccaacagttaaaagccaaaaacacatgatctgcgtaaagaaaaaactgctatataacgccataaatgtttttggttgtatgatattgcaaaattaaacatatttttgaaaacatgataatttcatggtagacatcgctcacgttaatttaattaatgttttcaagtagaggacgagagaaggggcacatgcgcacatgaaaaaagaatgtaaatgtcctttgtgttttccacttagaccaactcggacatcgacccaccgtacactgtcaccgatgccaagccaattgactatccgtggccaagagttcaccttgagcattgcttccatgctatcggcgtcgccatcatcctcgtcgcttatataggacccgtgttttaaccctcgtcgcctataaatgttggcctcgccatcgacccatcgccaccttaaaacactctagatcattggtcaggcactttgcatgcgtcattccgtcacgccaccaccaacacattgactagctgaattcatatcgttcctcgatgatcctgctcacctcaagctgtcctcgtcgttttactagttgacgcttagccacccaagacatctctcgtatggctcctctgccttgtcatccccttctgcctcctctctagttgctaagggaaacttaacctaagctcatcctccaatgctccaactggaaatcaaaaacccctcgttaaggctgaacttccgaagccatttttcattcccataacccaccgtaactccagtgcaatatttctatacactgatacacacatttgcctcctctccccattatctacccaaaaatattaaatttataggggtgttgcctaatagtattttctttacgttcttagagtgtttccatatgtgtggtgtcatactgcttaaatcgtaaagtgattatattttatagtaaaattttattgaaaagtagttataatgtaagacttttgtactaacggttaaaatactaatgctaagtaaacaataataataaaattactgtataatttaaaattggagatcgacttcgaagtcgtaattcaaacaagcatgcccacaaaaggatgtttgtattcttcgcataaaagggttgtttgtataacatatcaaatattatttcggcgattttccaaatccatttgttgtgacgaaactgacggcatattttcctctttgtgtaaaccaaacaaaaagttacattcagatgaagcatcccggccttacaggcagcccgagtattgggttttaatttcatccatcgttttagggaacatcgaaagcgaccgaaccatgttgccgaacagtctgctaaagtctctctccgtcaaaaaaaaaaaaaaaaaacgaactctagttttctgtgtctaactttgattgtccgtcttatataattttttttataattcatatttttattattgttagatgataaaacaagattaatactttgtgggtgacttgtctttttattttttttcataatttttttaaataagacggacggtcaaatgttggacacggaaaccagggtttgtcttttttgggacagagagagtaggtctgatacttttcttcaataaaagttggatgaagattaagattttaattggatgctttttaaactgctaaacggttcgttttgtgttaaatatttctatatgaaagttattgtaaaattcaaattaatatatttttcaagtttataataattaaaactcaattaatcacaagttattatcatcttgttttacgtgaaatacttaatcttttatttttagaagattcaaataccacgttagcgtaaatgagaatagtattgagtagaaattcgcagccattattagagagattagcacagttcaaatgtttccctccttcgccggcccggcttccacgcgttgccgcggcggcactcgcgtcgcgtggcttcttcgtcggacgcccgtatgctggagcgggtcgcgggaatcgccaaaattgactaatcgtttccattgtcacacgaagttaccggaatacccttcctgacgaaaggaaaaaaaaatacatccgagcggcgggtacaccgcatcggctctcgggtcgcccaaccgggccaccgttcgcgcgcggtgccacgagccgagcggggcagtttagacaatttgggcgcgacgacgatgccttctctcgcggcgcgggcaaagttaaaaaagccgacgtgggtggcccggacccagcacgtcgcctcaacacgcaacgcatctgagcagcagcggcccgcgtgtcagccgaacgggcgcggtccgcgaggcgtacctgccgccgagtcgtcatccgacctggcggccggctggacgcgtcacggataatacgtggcgtgactggattggttgggtacggacacgcgctgcgcggcggtggcggcaggtgggctcgggctgcgagaggtggaccgggtcttgggccggctcaccgcccgacgtaaagcagttttaaaggcgcagagaggacggccgcgcggcggtgtgggtttgggctggagctggccctatggaccgtggaccacggagtagtaggagtaataataatagtcgtctctcagctcagagttgccctcgtcgcgaggtaaatcagcagcgcacggccgtggaataaaaacgatggcgtgaatagtgaagaggcagggtcgtacgtacgcgcagtacgtgtacatctactactgcggccgtaagtatggctgtcggttcatactttccttgtacgtcaaaacagatgcctctcacgaggtttttgggctacttaatacagtacctggctccatgttcgttctactcgcgaattttccgtagctatccccgcgcgttaaacttctgtgtgcaagattgcaagtattccattatgttcttcaacgctgacacgatgctaactgttaaccgaatgaccacgatttggcaacaaaacagtgcgttccagaaattaaattcgtcgtcagtttcagaaggcgtagacaaaaatacaggatcaatcttcaggagggtaatctgatgccgagttttctgtccttccgtggacaggaaaattctcgatgacaaactcgacaaaaaaaatcagcataggggcacgatgaaactgaccagacaaccatgcagataaatattcgagatcgtcaatacaatcccggcagcagagtaaactggccaaccggaacgatagccaaaacatcatggatgacaaatgttgtgaagatgaaagctcaaactcatcgggatgtcagattcgacgggccaaactaagataagagacgatgcatctagacggctcccaccacgtgattgacggtggatatccatagatttgcttaaaaactttaaaggcgtcgagggcctacgcatctgcgtccgcatgcatgggctccgagttgacgtgttcggtgttcccttcaccgcgtatggggtatggccgtatggggaactcacaggaatggcgcggcgggtcggaggcggcgccccacgcgggccaccgccgcgccgagagcacgcgacgtcgcgccgcgcgaggccgttcggtttgggcctttgcggtgggctgcggtgcgtgggcacaatcgagtagtgttcgtggctgtcaaagatccagtcggcaccgatcttattaggcttttgaatcttttcgctgtcgagccgtgtgaggtgcaaccggttaccacttaccagttaccagtagtaggccggggagcttaggtgccaaattgatgcgtacatatccacttaccatgctcacgtccctttcctactgcgctgaaggcgttgtgcctgccggtgtggcgatgcgatatgctacagagatgtgtgtggtcaattgttgatttcgcaatttttcgtacaggctgattttgcagctttgacatcgccgtgcgaaaacaaccttgatcttatagctgttgtgatcagtgccgagaatgacgacctcctaaatttccacaggcatgatgcaaaatacggacgcagtcatgtgcacgcagacgcaccttacctatagacatttttataccgtttaatatcatcattattatttctggattgctgccagatatgcagatcgcaagagatttttctctagcaaaagaaagaaaggcgccaagtcgccaagggatgcatggcgcgtatcagcgcattagacacaggacgcgggcgtggcgtcgttggcatgcactgtgcttttgccactcgacggcgattgttgaatcacgcacatcagttcgacaccaaaaaagaaaatcggcctttttccacccagctattccggccgcttttggtctcgttgcttgcagttgcaggacaaatcatggccttgttacgtcgaaggaggaaggacggggatggggatgtatacagtggtggctgttcttccgtagcttcctttttgcggtggtggtgcgcaggggcggagctagtatatagtaggggggtgcctaggaacccggtcaagaaaatcttttagctatacatcatctattttcaccatgtatgcactcccctcaatacaaacttagacactcgtatcagcttaaactcaatctaaagtagagtaaattaagcaagtggcaccaccctctgtttcgctctagctccgctcctggtggtgcgctcgctagagtgggagttttatgggcgatcgatgccatcaaaatcgatccttccatttgacttgcctttcacatcaagcaaagaggatgtcgccgttgcgaagtgagcacgtactacctgcagtaagcaatcagactgtgagaaagccgtggtaaagaacatcgtcaaggtgacatgagttaaattacgcgataaaaggtcaagctgaaaccatgctcctcgatcgagctcaagacaaagctggcggtgccactgaaatgtctgaattattttggcccagtgcagactttccttggacgattcatgcgtcacaattgcgttgagatgctggaccagctttgttataggctggtcaatgcaaaagcccaccattggcaacgaatttcattggtataaatcaaagtactcattttgtttcaaattataagattttctagcattgctcatattaatactgtctagattcgttaacatctatatgaatatgggtaatgctagaaaatcttataatataaaacggagggagtaccactcatcctggaatgagaatctagaaagcaacacaaaatattctgtgcaagggtgctatacttaagagaggagaacttttggacttgggctatttatgggccagttatgtaggttatgtaaagggcccaattgcaatccttcctaacaatattgctcacaaaggagaaaagtccaatataactcccttaatataagttgcatctattttgtattactcaacggcaaaaccggatatactaactcctccaactactacaaccatgcaaaacgacttactcaactgttctaagaacagtttttattgacgcgacatccacatgaccgtccagtcatcaagaaaatatatggagttcacatctaagtgagagggaagctagaaaaaaaaatgcctatgctccttccacctcccatcgttcccctctcccctgctcctcctctacttccagcatgcgtggcaggagagcttgagagaagttttatgatgcatactcgatcaatttatacttcaatattataatatactagcaaaaatgcctgtgcgttgcaacgggtgaaaaaaatctaatgataatataagtttttcatgcataatcatgtcaatgacaatgtttgtattttaatgagcggcttttttttataaacggtgttttttcttgcgcgattttctcaaaccatttttttacaaatagcgcatttctttctaacagtttttttctagcatgtttttttccttttttttactaatgacgaaaaccatatttttctccccttttttgttttgcttttctcgcgtgtttttttgcctattttttctgacaaatactttctcgcgtggtttttttgcctgttttttctgaatgtcatttttttgcttttttccaatacatgataatatatgacgaaataaaagccgtgtagtagatggtaaaaaaaatcaatggatcctatttttcagagtgatttttttatatagatagtgtttttttcttccgtggttttttcaaaccatttttttagaaatggcgcattttttcagacagtcttttcctcgcatgttgttttaaaaagtttttgccgacaatggaaataatttttcttacgcgtttttttatttttttaagaagacggaaaaaccttttcatcatgtttttttgcgcttttttctgactttttttctcacacgttttttgaccatttttattttctcgtgcattttttatttttaaatagttagattagattagagatagagacgagatttatactgattagaaattggactttgtttcgccctttctattttttttctcgcgtgcattttttattttatatgaactagctttttattttttatgaaccatttttttgccactttcttagggaatcagacgaattttttttcggatttttttcgcctttacaggaattagactttttttttctgtttttaaaggaatgagatctagcgttttttttcaccacttttttttttgccttttataggaatcggattttttttccgtttgcatctacagtttttttcgccacttaggggaaatagacttttgttgttgttgtttttttgttttttttcttttttgtgtggcttttctttttctttttatgcacctttctgcctttgttatatcccttttatttattttttttttaaaaagaccaaaagcatcttattgcaagattataggtactcaaatgtaaatataaaaattatagggactcaaatgcaaatgtacaaccccaaatattgaaatcatataaaaatagaatgttatcgacatgtaggttccgtttttacaaacagatcttcaatctagcacatcaatttttttcaccaagatgtatggaatatcacggtatagattgaaaccaagaaaagtgttgcctagtatctcggactcaaaccgagaggagtgggactcagataactttttttttcttatgagagggaatcgcaacgaggagtcggacttttttttatttttatctctatttttttacgggaccgagttggacttttttttatcgctattttgttttttcttttctttttttcccacgtttttgttcgcccgttttttttatcggacaattttggttttctagcccggtttttttgcctttttttctggatcggacatatttggttttttttcgcactttttttgcccggttattttttgatcagacaaacttggtttttttcgcccggttttttgacggacgatggaagcccctcttatttttttaaatagtagagatatttatttaatttatactttaatcttgttatatttcgaatattttaaaatatataaattagatcatacgtcactgtcgcacatgcgccacagcttcatacgcaagttcgcatgcatgaacagccgtgtgcaagttccgatacatgatgacacagtgcaagcgagttggcaggatagcagtccacacggcataccagccggcaagttaattttctagggaatcatcatctgatgcaagagatttatttagggtgatcattatagaaaacgacaacttccattatctaaaagaataaaacgacaacgtgcttactgttggagatttatgccactttaagccactcaatatctttctttttttaaaaaaaaaaccgagccagcataagtagagggagaaactacttacataatcactaacggtgaaggatagaatgaaaagaaaagtaaaagaaaagaaaaagaaagagaggaggaaaaagaagagagaggaaaactattaatataatcgatcaaaagtactattataccgataatctcgcaatgtttgtttctccacatattctccatagcttgacttcgtcatgaatttgtctagtagctgcagcagggctttttttcttgatttcgaaatacttttcagttccgctcgcaccatatctcccattctaccagcatgtggattgatttttttgctttggctttgtctttcccaccttgagttgttctcatgatccaccagttcaatagtgattcattttcatcatgtgtcaggtcaatttcattgcagttcagcttccctagcctaccgtacaaagggataatccttgaagagacgttgagatgtttctaggttcctatagcatagttgacaggaatagttatttgaccattatctgatatatatgtagctgatctgctgtccaaatcctattttgcagcaacagccagtcgaagtgtttgcatttggaggggtcccattgctttcagattaattttgctgcaattgagcttatccttccggtgaattgtgctatataggctgacctcgcactatatttcccattgcaacaaactgttcttgaaggttttttaattcaggtggcagctactcctgcctcgtgcgaaacaaaattcagggggcgcccagcaaaatttaattaggaggttcaaacattacaacagattactgtgtgtacagggtctaaactcaataacatagtattcagtagaattattgtctagaaaactcaatgaatgttagggattttatcttatcaccttatttgaataaaacaaatttatcggttattatatgtcttaccacagggataggcaggagctgtagcttagatgtaaattctttctattattaaaaaaactaacaaggtatattacttgttctgggaggtaacttgcagtgccattttactctgaaagcatctcaatatctcatgtgatcgtttcggagatttggagaaaggaacaattattgtgataaccacttacaaacatgcctagaaacatcagtacacagtgcgcttgatcaaccagactaacagagttcttccgataaacgaggaagtaggccaacgtagagctctcccgagttccgacagagacgacacctatatatcgaagttcataaccacgctatccatgtgaaaacaattctttttttttttctggcgatgacgctcgtcaaaacagataagaaatatatataaaaaaacataggcaatataagttatcctaaagtagtaataaagtatgaagaaatataggattaaatttacgtggacatatgaagaaaaatatttatttacagttgattttcttctttatatattcctctatatgtcggtaacattgcttgtttgtgaaagaatttgtcataggataaatttattcatttttaatatcttttataacgttgtggaccgcatacaataaacaacagatgctctagttgggggctttataatccatttctttgtccatacaagctatgcatgcatacacctgacatatgcatctacctatttatatgttggtatattagatatgggatatctcagatacataaagatacgtgatatgggacttctcctacatgatgtacacacatactttcatgtaaagtaaattacatcaccattccttaaagttgcaacgtgatatcactttgtccacgatcttgtaaatcgtatatcttggacttggttttgatgtatcatggtaggtccattgtacgtttcccacatggatgttcaccttggatgcaaatttgcattcagctccttcatgcacattcgctatgtgtctcctcgaaatatcctctcttctcttctgtatctattcagggtgggttgcagctgctgcagtagaggagggagacgcctagggtggtggcggcttgaatgaacactcaattgctccatggaaatccatcctccgtaagaccaacgaggccactgtttcatcttctctcgtctccccatctgtcttcgttctcattcggacgaggatcaatccatctaggcacgagaaaggcaaagagctagctagcaaatacaatcagtaatggagagctggtggcttccaacatggcagcctctccttgtgctcctaccaacaatgcttctcctctatcacacggtctcgtcatggcactgtggcgagcgatgcctcccgctcccgccggggccgcggggtctgccgttcgttggcaacatcctgcataccagcgacatgacccaccgtggcctggctcagctcgcctcgcgctacggcggcctcctccacctccgcctcggccgcctccgcaccgtggtcgtgtcgacgccagagatggcccggctggtcctccatgtaaacgaccgcgccttcgccgaccgcccgaccaccgcggccatcgactacctcacatacgaccgcgccgacatggtgttcgccccctacgggccagagacagatccagaaataaaaagttgggggactaaacatatcgagtacatcggtataaacacatcatctcaatattaaactatgctaaaatgctattaacacatcctattttaccaatcttggcaaaaaaaaattgaagggggtatccatgagttttgtaggtgtaggggggacttcttgcacccacgttggatccgcccctgctacgggcccttgtggcgccagctgcggaagctgtgcatcaacaggctcttcaaccggcgccgggccgcgtcgtgggcagctgtccacgacggggtcgatagcctcctgcgggaggtgaccaagaacagcggcgcggtggtcaacgtcggcgagctcgtgttcggcatgtcgatgaaaatcactctccggcttcgactggagcttgcgggaggtgtcccgggcatgcagctggggatgctcgcggtggagctagcactggccaggctgctccacggcttcgactggagcttgcccggcgggacggggtcggccggcgagctcgacatggaggagacatatgggctcaccgcgccgcgagcagtgcggctgtccgccgtaccggtgccgcggctaagccatctctaagctgcgtacgatctcgatcgaccgcgctctacatgccgatctgatgactgaggagacacgtcacacgtacaatagctggatctgtaaaaagcttaaagctgttgtcaacacgtacggcgctgtttgtgtatcacttggtacacgaaaatactcgcgcctcgatcgtacacatggaataaatgaccagaaataaaataaaaacgaaacatcgtctttacacaatcacaagctcatagctgccaattgagcggtagctagctagatccaattccaaggttcggcgaccctgcccagctagccaggcagctagctagctagctactcgccggcacacggcagatgggcgagcacgagctgcatgcgcgacccgcgcctgatgatgtcgagagctagtggtgctgatcctgaagaatccataacatagcgatctccctcatgaagtcacggtttgtgcaaagattggccggcggccatggacaccgcccacaggcccactggtcgcgcgccctaacccctgcgcgatcaggctcctactactagtccattagtactactactagtctactagcactactactattagtctattactataacagtactactacatgtatatatacgtatgtatatattttatatatacacatagaaactttgtatttttatgtatcaatataaaatttctatgtatgtatgtaaaatatatacatacatatatataatttttttatgtatcaacaaattgacgtataaaaaatatacacgtatataaactttgcatacgcatatacaaactttacatacgtgtatataaacttccgtttttttttgacaaatagtccttttgaaaaacttattttgaaactaaccctcgcaaaaaacttcaaccaaaaatagatcatgagctcaacaccaatgtcaatggcgctgaggtccaaagggtcaacgccacatccgttggcgctgaacccgtggccacgtggatccgaagctgatctatttgtcgatgtggcatgaggtcaacgccaactctattgtagcatggtggtgtggcctctgtgcatgcaagcttgaggtaacaagtttgactcccttgagcagcataaattatctatttttattgcaacttttttaccgtcattttcttccggaccgatatacttcaaaaataaatataatacttccattatctttcttcccacgttactatttccgacatatatactccaatggtacattcaaatatgtagtatacttcttcttttttaccgtccttttcttccggaccgatatacttcaaaaataaatataatacttccattatctttcttcccacgttactatttccgacatatatactccaatggtaccttcaaatatgtagtatacttcttaccgtccttttcttctggaccaatacttcaaaaataaatataatacttccatcattttttcccacgttactatttctaacatatatactccaatggtacattcaaatatatactcccttcattccaaaatataagtcacaaccacccttaattcaaataccaagaaataattgttatcatatcatagtttagattatcctaataaataaaatgtatgcacccaataaaattagatatcttaatggtggatgatttaaataataatattttagtgaaaaagaggtgctaattaatgatatgtatgcatgcacgccttatattagtatacttccgttcttttttctcatattattatctcctttttcttacagtattatttcggaatgtaggggaagtgccggaagaaaagaacaaaaaaaaagatttgctagcaggacaaaagtacggtaaactagtcgaacctgctacctcttgcttgcatgcacagagggcacaccaccgcgctacattagcattgatgattgtttagagttagcgctgggttatgagttcagcgccaatagagttagcgctgacctcgcgccacgtcagaatgcagaacggcttcggatccacgtggccacgggttcaacgccaacgaatgtggcgctgatcccttggaccttagcgccattaacattggcgttgagcccacgacctatttttggttgaagttttttacgagggttagtttcaaaataagttttcaaaaggactaatttgtcaaaaaaaaaacggtacaaactttgtatatgtacatattaaaacccgagagaaaaaaatcacgaatacaaactttgtatacgtgcgaatacaaaatttagtatacatacgaatataaactttgcaaacatatatctttaaaaacacaaaaaaaaagagaaaccgaaagaaaaccggaaaaaaccaaacagaaacagaaaaaaaaccggaaaaatcgatagtctccctgcgcgtgccgtccgcgccccctctccgcgcgcgacacgtgtccagtcgcgcacgggagggcgcgcgtgagtgaccgccgattagccctttcggagcctgagagccatgctgcgtgctcgacgtcggtgtgataccattataggccgcgcgtagctcacgatactattccggcccaactagtacagctcgaacaggcccaaccaatataaactttcctatatggaccgcacgatgctcacaatcccgttccggcccaatcattcgtctcatgttgggtggtaacgggacagggaccatgtccatgggttctttaacacgggacacctatctcaactcttaaatatttttagctcaaaagtctattgaatctcactatagcatttttttaaacctatccccttacattttatatgctaaaatattggatccattatcatcctatattactcaagtgtactccttccgtcttaaaaaaccaacataatgttggagatgacattactagaaaatatcacatccattactatgttagttttttatgggatagatggagtaggcttgatctttcctgtggcaacgctccgtgattatacaagctcttctttaaaccatggagatgctctcgccataagtaaattcatctatatatggactactataaaactgtaaaagcagtacaaatgggaccaaaggatacaaatggaaacaatggacaactagactaattggaagctagctggcctgcttaattacatcagtctaaagaagtcaatcaagccatcgtaatggcccctgattgctataggtagcctttgacgcaccaacttgacagcatcatcacggttaccatttttccggggtgatctgtttgcaataagcatatatactagaatacggtttggttgccactacgatcgatggctgggacgcgatactagatttcgggtctaagtgttgcttgatctggtgtgttttgtttgagctcattcggaaagtggcaagttgcgttggaaggacttctctgctttcactggataccgtcggtgagctaaggcactagggaccggaagccgccggatcaggattgaatagatttggctgaaggtagaagtagtgcaaaggagtctgttagaggtgaatgcaacaccaattttttagataatgaattttcattaatccggcctctatattcacgaaggatatacacagctaaaaatatacaagagcacttagactcacatctcaagagagaacacaaaactaaaagaaaaggaaaaaccaactaccctgacacatccttgctttccgacatcatctcctaaaacaacgagattcggcgagtggaagttgtctagtcgtcaacgctcctagtgcatcatcgttgcgagcctccgttgatgccatcttcattcgcttcatatgagttgatgccaaacgtcgcctggtttagcccactttcatccgtcgtcccagccaaaacaagccaaccaaatgcgggccggcaagatccatttccgcttcgctgaattcctaggcctctgccgcccctagggccgccaccgtcttcgggatcctcctccacctcctggactcccagctcgtcgccgccccaagggccgtcgtcggagacctctgcagctgccgttgaggaaaatctcttccacccggactcccaggcatctgccgcccctagggcagccaccgccaacgggatccgcctcctcactgcgaaccttgcaccggcactcaggccgccaccgtctcggttcgatcgctacccctagggcagccgtcgccgccggagaagtcttccgcccggactcccaggcgcttttgctagacatcgctgcgaacgataccacctccacccaatcccgccgtctccttgccaaggatacggcggcgacgcttaggccaccgccgttgactccagaacacctcagctgtcgcccttaacaatcacatggctagatctaggcataaaggtcacaccagtaagccgctgcccctaggaccaccactgccggtgagcatacctttgtccttcgtcgccatcttcaccatcgcgacgaaggggacaggccacacgcagaggaatccgccgtggcgctgccaactgcctagcagcggcatgccacctgccgtcccctactaccctgaggccatcgccactcccccgctgacgccgtccatctgccgcttccatcaccaccgcgccgccccaccagaaggagccaacaccaccgcttcaccagccatagccagcgccaccggcccaccgcccacctccaacagcgttgccgccactctgccactaggagagtgagtcgcgagttccgcttcaaccggacgccgtcctcaccggagcagccgacctgccgacgccacgcccgaagcctagccgccgctcctgcccgcccgcaagaagcggccatagagggctgccgagagctgaaaggaaccccgccgccgccatccttgcacccacgtggaactccagcggtgtgctcaggcagcggcgagctagtgggaaggagtcgagggttcaggggagtcgtaggggcgatgagactagagctgcagggctagatggttctcctcttcgaatatcatcgaaaactcgaatgcaacacaaataaggactgcagaagtttgggctgcgtattaagactgactgaatgcaggtttttgatgtggcgagactcatcaggaagcatagattcgaagctcagtcttcaagttctgttcttattttcatcgtcatttcttatttataagagtcgatataaaaattgaagatgattttactggtattttagtacgtcatccgtgtataaatcggtttttaagtccgttcgcttttgaaaatacaaatccggtttcggtttttaagttcgttcgcttttagaaatacataagaaatcgtataagaaatcactttaaaaactcacatactaatttgagacgatcggacatctaattgcagcttatgattttctaacaaaaatatatatctaagcgaatttaacacagtgaatttcatcttaactaaataatataataataataaattaaaatagtcttcacccgttgcaacgcatgaatattttttttagtgagagtcgaaatctaaacattcatgtaacttttggttgtgtggatatagaagtccgatttttttttagcggggatagaagtccgatttgtttgttggaaatttaaagtttccaccaaaagatggccttttcgtgttgttcttggtgttcgcggttttcctctctctttctgaaaaaaatacaggtagcaacttcgagcgaaccaaaattcaggcagtgcaaacacttcatcgaccagtttcaacaaacatttgaactgacgagcagacctgaaaaattacaaattctgaactttgcattttgaatatgcagacatttttaatcatgttgtaccggtggaaaaattacaaacattattgctgatgtactgttgcgtatgcgaacgattcctgttactaaaagaacttgagcacaaaacgattcccgcttatcctccagtttattccactcgagcggtcgagcctgtctggaaccacaaaaaatccgtaaattttttactccaagttacagtattacactgtaccataataataagataaaaaaagggcaatgcttccataaatatactgcgtgatagctgaattcggtcaggaaaccattaaatttcagtcattcattgacccccacatatggcgccaccaataaatcgcgagcgtccataggcgcaagatgagaggagccctccaaattcccaaggcgggcctcgagtcgagcccaaaccccttcgccgccccgccatgcagttccccttcgccgccggcgattaccccgccgaccaggtcgaccccgactacctctacttcctccgccacatccgccccgatggcgactcctacaccctcgagctcccctccgatggcgtctcccctccttccctcgtgaagtacgaggcccccgccgacaccggcagcaccgacggcgagtgcgtctccgatccctcccctggccgcgccagcaccaaccgcccgccggaggagaaggagtcgtcggtggaggtggacgccgagcctcctgccccctcctggatcgactccctcgtcgacatcgacgaggactaccgcctcttcctcaagcacacgcgcgtggtgaacgacaacatggtgctcgagattgacggcgccgtcgtcacctacccgtgcgccgcgtcctccgagagcagcagcgaggtcgaggatgcgcgggagaaagaggtggccatggattcagacgagccggtggtaattcttccggacccaaaagtatgcgactgggtggcggtgggtgacgcatccgtgcgaacattagatagtaagaagaagaggaagatgagttcaagcaattccaataatgccggcccttccatccccccggtgagaattttttatacatctccaatcgttgttacctgtggcactgttgtttctttgaattgagcagcgtatacacgttttcagtccagaaatagttctctgtttttcgcctaatagaatatacgcaaaagaagatgatagtagtcttcgatatttcagtacgattcaacaaaaggcctgttgatggacatgtatgaataagctgatactgtattgtaccaaccagaacactattctctagcaaattcacgctgaacatcccctccactttatgggccaatttgcctattaccaccgcaaaaatcactgagttgaaaaataccatcggatgtgtcattgacacgagagggtccaggctcacatatctttgtgatgatatttctcaaattttcccctacttgaattatggaacagtaacagtaacacccatatggactcttcaaagaagaattagtctcaaatactaaggttatgtaatgtacatgctaaagtatttcattgttctccaattgatctggcaattttgcatttatctcacaaacaataaaatctactataagggttttttctcctcttgtttacatgatgcacttctcttattacttaaaaatattataatatgcaggggtcacaaggtgttatatggccggcacatatcaacagtagaccggattcagatttcaagcagaggttattggatgctctcagcaaaccatttagtcgaaaagaatatattaagctatttgacatggcttctattcgtacaccattagtaaaattacggcaggtgcgcaatgatgtaaagttctaccctacacaggaaatgggaaattcatactttgatcattacccaggtatgcctgtgtatcgtgcacatatattgttttacatgtgttgtttgttctttggttattctgttgtgtattgcatttttcctcagaattatatttatggtcattgtaactgggtaaagttaaatccatggataatcttaatattctgttacagactgttaaccatttgcactttgtgaatatatgttgaccataatttatggttacatgtgttcatagttttctcgctcaaacattgcaagttaagtatagtttgttataaccctttgtttgttataaccttacaaattaaccctttgttcagttgtttgttataaccttacaaatttgttcttaagatgttacattcatgaccaattagtatacagtcaaaatagcttattgatgttagttttgttcaactgtttgttataagtttacaaatttcttcttaagatgttacattcatgaccaattagtatacagtcaaaatagcttattgatgtgttggtttaatctctggagtgtagttgtaggcataggatcttagaacaacattttgatgtacttaattttgcaaataagcttgtaggactaatggttccgaaaggaaaaagtgagtgcaaggccagaagaaaacatgccatgttattttgaacaattgccactgcattagttttactagagtgttgaacctccaagtctcagtattaaagtatttctgtgcccaagatatctacagatatgggagcactttgattgatgttttttaaaaccaccagcggcagtgtatggacagtgtcagcttatcaattggtttgcttaaactttgagcttatatgcagagatccataccaagatcaaaactagatattaagaaagtgatagttttatttttcttgagaagctttcttttatcttcaacagatcacttagctttctttgttgttgcttataaacaccattgccacttttaaatttgactataaactagtagcatagcgtattgctggctgatttacataatgtatctgttggcagttctacatggttattgcactaacaaatgtcttttttgtttatttaactttagatctcgttgaccaagttatgcacactagctttccaaatggtttagctctgatgcgtgggtttttcttctggttgcaggtaacctcattaatattgctttggtttcttaataaataaacagtgtaggaattacctgctttcatgattctagtttgtacttgccaccatctctttcttatgcacaagacttacctaaccatcaaaatcttttagtccctccacatagaactattgctagagcaaatgtgttctttcgataacttatagatgttttttttctaagtcggaatagatggttcatttgctgctcaatatacagttcattttaagatcagtctaggtgagcctgatataagtagcagcgtaaacagtttatttgcagcattactgaatagtactattttcttactgcgtggaattgtactctgcagtttagtacaacacaactacctaagtagcatgatgacattagtacttaatgcacaatggcatttttctaaaaaaagattgagatgcagttttgtaattggcaatttttgaattgtatgacactcttttgcagaataatgcacatgaagatcaattcaggccatgggttgatgtttctaaagaccacgaggttattcctttgatcgattgagatttacacattgcagctggtcaaaccctcaagttcaaaacattaaacatctatttgcgggaatgactctcttaagggtgacgtaatgtcatcagcagagattgtctcgtatctatatggaatgagataaataaatatattgccaatgatcgagaaataattccctattggaatatgcgcacatcctctttgcaaataatttaacattgagttttgcctgtgaatttgagggctggattccatgttctacctgatctcaccatcataaagcaataaagcagtggtgttatttcaatgtgattggattacctgaagtatcgacattttcacaccgctaatactcagcaaaaaccatagaacggaaatgccatgaaactagagtgctagacccttccttagtcttcacgacagggtaataccctcagtttgctcagcttctctttatgtaaccatgttggagtcgacaaaattattatcgactgtgaatgttctgcttttgtatgaacccgatttgagttcggaaataccctagctcatggctcttctggaagagcaaaatatacattgggcatctttgaacgggaaaatcattgatagttacatgctttctctttagggtacaacacgcattctattttacatctgggatctggctgctgttgaatttgatccttggtttgcccatgctgaaattgaggactctagacatcatgttgtactttatctccccatcgtatagcagtttgcggatgaagtgctcaagatcagatccgatcaaacgaagcgtgtactctgacagctccgcgccctgtaaattcaatccaggtcagttaagcaggtactaccaattaagctcttacaactaacatttccacctggagaaagagaccatgggtgtacactactgctaccctgcatttgcaattgccaattctgcctatgagttacggtgcgtagtatacctcgtagtgatcgacgaggtcctggaactcgtcgtagaccttctggcacgtctcgtcggtccagacgaactcgtcggtggggtcgaggaggagggtgagcttgtccatctgcgtctggtcgaaggcgttggtctccgggttgatgtacgcggcgtaaatgcggatgtgccgcgtcgtgcaactcagccactgcccgccgtactcccggctcatgttcttgctctccgccagcggctgcaccggcagcggctgcgccggcccctgcctcctcgtcttccgctcccgcctctgctcctcctcctgcggcggcggcggcaggttttccaccgccgcctcctcctcctcctctttcacctgctgctgctgatcttgggctcgcaccggcgggaacctgacgcttcgtcgcgccgtccacgtcgcgcgcgggagccggcgctcgagcgacagcttggccggggacaggaacggggacgccgtggttgccatgctgcgcgcagctgtttcgcttggctttggcttggcttgtgtttgtgttgcgtgggtggtggtggtttttttaggtttgctgcgcctgcgcgcgcgcggctaagctgccgtgccgtgccgccttggagccactggctgtgtgtggcttgtgtggataagggctatttctggcactgggtttcagcgactcgtacatgttctgggccaattgaccacacaaatgtattgggctgtggacgttggcacggcctgttgcattgcatgacagagctgagcagcacgcgctctcgtgtggtatggataaatactgttgcatttctgacaaaactttgtatgtgactgtttttttataactccatgtggtgtgacggtgatttcatacttaaagaagtaacccacttttcctcggcacagcaaaagcagaggatacgcatactccatggcctttaaaataacgagagtaattttttttccttttcactttgtgatgatcgcttcacatgaaaggcaaagcaaaagcctctgtagtgattttaagctttctcaggcgggaaaagtctgttcaggattactccatccgtcctattttaagtgcaaccataaatttccgtgtctaactttgatcatccgtcttatttgaaaattttttataattagtatttttgttgttgttatgtgatgatacaacatgaatagcactttacccgtgacttatgtttttaattttttttaaataagacggaccgttaaaattaggcgcggaaaatcatggctacacttaaaatgggacgaacagagtaaaatacttgggagacatgtacgtcgtacaccggagacttggaacacttaaaacactttattatatataaacaacttgttcatatatatatatatatatattgggcagtaatgtaatcttggcagcaatcaattactacaactaacgtgtatgcatggtgcagcaaatagaatacttacaactaacgtacgaatgaaccaattcaaacgaatgaaatttaatcatgtatttatgtacaaaggagagacataagaacgtagctcgagctagccatggacattggtctgcatcgccggcggcagcagctcaggaagcccgggcgtcgatgcaacgatgaggggtatcacggggaggttctcgcagttgcagacctcgatcatattgccgtcggggtcgtggaagaagagctggtccaccaccgtctccccgtcccacactttcctcacgacgaactcccggtccatggctcgtagcctcgccttcatgaccgccatgtctgagcactgccattcgctcaaatcgagttaagacaaatacgaactctgctctcgaacataacagtagctgatcgacctgcgtgcatgcgactgatacctggaaggaaacgtggtttcccatcgggttgatcgccggcagcggtcttgtcgggatgctgcaaccgtcggcgtcgtcgccccgctgcagcagatgtattcccatcccgtacttgtatagcctgtaacaagcagcatttcacactgaaatgatcaggcattgtgtatgcagctcgacaactggttcaaatttctaactacgaagttgcatgcattgcagattacatcttgatcggtccttttgtgctggacgcttcaggggtaatgtaggttaattaattactcaccaagctccattgaagttcagggactccggccgcttgatgagctcgaagccaagcactcggcggtagaagtcgacggacttttccaccgacgtgcactgaaaggagacgtggttcaggcggacgagaggcacggatgcagcaacggcagggtcaggcgcctcagaacccatgctagtttcaggagatgcagaagaatcatgcgatatagtaatcgtcgaaaacaattgcgcgccatatgcatgtttatatacatgcatgcatgcgtagagtaacgcggagacagcagttggttcatcgatcagcacacagaaattacgcatgaagtgtcgtagcacggcaagtcggcaacccctgtgtttgcgtccgtgaagcaagctataggtcgtcgagacttgtgacgtgtgagatctagacgagggaattcagggagcagaagacttggttgccacgtatgtgtgttcgatccaatccccttgatggtcgatagtcaatagatctgttgctgcgctggatttgtgtgtgtggttgtgttgtgtgtcctcgacgaagttgacaaagtcagctaaattagcaacgtggcgatgagttttttgattaactagcattccaccgtcatccagaatcatctcggaaaaaaagagagcatcaaaatgcatcatccagaatggcagtcgcatgtgacaggctgacagatttctaaaaggttggaggttggtgtggagccttagtttagttttctcaataaatttctaagttttgaattaataaatacataattttatatagtttatttggagcttaattttaaccttttttaatgtccaagtgaattttcctgcacaatttttacacgcaccttattttggaagtggaacagaatttgatatacaacttttaatttatgtttacaataaattttaaaggtagaatatatatcttctatatagttggtaccaactaataataattagtaggaactataaagctcaacatacaagcataacacatcattatccactagtaatttaatattatagattatcttaaatctcatactagatacatcatctaaaagagaacattgtagagcttaacatacaaggatgttacatcatctttctcacattattttcataataattgaacattcattatttatatattatttggcatatattcatttatgtattttatagtaaagcgtggggtatcacttagttgcatttggtatacaagtttaacttctattttcatttatataactaggaaggtggcccgcgcgtatacgcgggcacttatattatttgaaaggtaagattgttgtttgttcagaaattttgtctcataaattcggggcaaactaaagtttggataatgttattttataataatttaagggttctatttttcttaaggtatcttagaaaaccattcacaaacttttgagtagaagatggattaagtacttacgacttttgaatcatgttttttttctcgagtaaataagaaactattgctagttaattatcatacagtccatgtatatacatatcgtgtagtatgcccgcaaattaaaaatgcgagtgcaagatactcaaaattcttttgattaaatcgtctcatgaagacgcatgatatagtaataaagggagggaagcatatgcataggaaaaaaagaagaaagagaaaaatgaaaaaaaagggaggggaggcgtacgtacccgcgcatgtaggtgcgtacctatgtcgaggtgggacctcgtagtatttagtttgttttaagatcaatttaatctaatggtttataatattagacctacggatttaagcgaaataaaataatagatactttgattttttttgttagaatttaatatttgccctaatttattatagcaccacgtggcagcttgagagcattttaagaaattttaaatgactaattagaatgttaattgcgcaatatatatgtatgggacatatggtaatatttgttccaacttcgtccatgtttatatatatgtagagagaaattaattttgtggctagcaagccattaaatgtctaattaataacaattaattttgacacctatttacaattgttcagagcaactcttatatattcatcttacgactttgatgatccgttgttcaccaatttactgatcatcatggctcgcatgaaaaaaaatatgtagtacttaaggtttaggatagctgaaattgatgaattatataatttatgtgatagctatttgagggtataaacgaatgaattgacttctaaaaagttataatgttgtttaaagaagacaccatctagaaacttggaaagcgtgcaaacaaaaatccaaaatatgaaatcggaaaaaaaagagagggccttaaactccctttatcacctttgtcatagtaagagttctattgatattcgtcaatattgcgctcacatttataacataatgattcctttcacctttacgaacaaatagtacaaaatccaaatatgaaataacacaaatacattataattgttatgtaacaactctcattttcaacttaaatagagctaattagtgttgagaaaaacacaacccatggtgcttaattattctctcactgcatcacacctttaattttttttcatgttattaacaaaattaatcatctccatatatgatttaatacgtggcaaagcggtagcactatagcggttgtgatcaccttagatgtctcagacactatgctttgtcacacgtgcgaaaagcaaaggtgcagacgtgcattgtgcagcgggcaaaaagagaattttggacgctttatttattagcaaacaatagatccgatgattataataataggtccaccagttctagcgtaagtgtaaattagttaatatagattttaaattgttaatttaatgggtacacaatataatggtgacagtgcattacttgagaataatagaccagtgtaataaaaagtagatccgatgatttatataatggagccatcagtttaagtgcacgtataaattagttaatatagatattgtttatttgatatgacacgatataattgtgtaaaatttattttaaaatagtgcattatttgaaaataatagtacagagtaaaaagtacaccggcttaagttatatgatggtagattctttgtttgtaaaattatcattatttaaaaaatatatccattatatatataaatggaaaaaagaagaagaaaggaaaaaaagggggggagggttcggtatatactccacctgccaatgcacgggaggagaggataggtgggacccatggtatttagtttgttttaggatcaattttatctaatggtgtataatattggacccaccaatttaaataaaaattaagggatatatgttatgcttttttcttagaatttataggattttctctattttattagagcgccacgtggtggcttgagagcgtttgtagaaagtttcatggacttttagtatataatagataaattgtaatttgtataaattatagcttctggacccactaaggccatacatcgaatacatttctcttttttttttgctgatttaatgtggtaaatactaggcctccaaaagccagagctaacatggttacatggacatctagttgttgcttttagagctatcttttgtaccccctccgtctctaaataggtggagcattaaaacaaaggttaaaaaactactcctactataccttcattaatacgagagaacgataagtggaaaatgggggaaaggagagtactattggttcagtgactaaaaataataagaaaaaaaaaggtaatagtattaaagagttctagtgaaatactttggaaatatacttttttaaggacaatttttaggctaaaactacatttatttagagcatgcttggtagagctccagctccacttctcttagagctggagtccgacaaaacggttttaactccacccaaaaagggaacgaagtgagctaaagtgctatcacgaaataaataggtgtagtgaggtttaggttgctttacaactctactt

SEQ ID NO: 511 - DNA, 34016 bp, Oryza sativa
  unsure (1)..(34016): unsure at all n locations
gtgggtaggtagagccgcagagggtatgaaagggtagattttttttcaatttgtgaacgagggtaataagaaggtacgaattgacttattttgaaataaagtttctactttaataataattttcggatagatgctcattaaaatggactcggacattatattacatggtttgcttatcagtgtatcaaacctcaggctattggctgatcataggtaagggtagccaatcaatcaatcacccaaccagcctgccgttagattagatgtgtcaatatcaaacatgctcgacatatcagtgaacaataaagaagcatgtgccagatgttttctcttcgtatgtactctctccgtccaaaaaaagagacaaatcatgggtttccatgtctaaagtttgaccggccgtcttatataatttttttataattagtattttaattgttgttagatgataaaacatgattaatactttatgtgcgatttgtctttttattttttttcataatttttttaaataagacgtcaaacgttggatacggaaatctagggtttgtcttttttttttttgggacggagagaatagagtagacagcccgactttgattagagttgaaggtaagcatgccctcaacctcaatcagtgacatcctctcttttgcaccttttgacaacaaaatatcacaaagtcgaaaaagaataaccacaatcaccatttccgacaactgcctaacttaactaatgtgacgagacgacgcaagtgggctgtaagaatgtggtttggtagaacaacagtgtagtagtacatactgctatgaattcaattggctagaatatcagccataaattatttttgagcactttggattctagagggcatacacgactggaccacgcacaatgattcacccaaagaaattcctgtcacgtgttaaccggcaaagtacgcgcactggaccccgtcctaaaaggacgttaatttgttgttaacctgacgaagaattccgtcaggcgtgcagtctctcgactgaccccctcctctcccccaaaaacacaagcagcgcctcctccaaaaacaacggttttctcttgccagccagcagattcgcgcaccagccgcacggcgcgacgatgcgcgcgaagaaccgccgtttcactggagccgtggagcgcgcgtcgcttcgcacgtccgcgctcgcgatacgcgccgcggctaccgacaaaatccgtacgacgcaccgtgccgcacctcctcctcctcctcctcccgcggcgggagcggcagcttcggtcgctgccaagcggtacgggacgcgcggctcccgtccgcatggacgccacatgcgccgcgccgcgcgagagttaaccggtgcggtgccgaatcgctcgctagatgatgccgcgagatcttcggttggcgcgcgctgttgacttcgttggcctagctatcggggttgcagtcgcggatggcaaccgatactatatgtactaggagtactactaccgtagacgtagtcacaagtacgtacagttcgttgtgtgtagtgtaggtttttcccttgaagctcgatcgtggcttcgaatcgatcggtcgttcgatcactgttgtggacagtactactgtactggtagtaccagccgtgctattgtcttttgatttgctagttcgccaagttttgagagggaaatgagtgcgtgttcaccgggaaagggtaggtcagtgatccttatgccttggacagcatgagtgcaactttttgcgacgcagtaactggcacggccggcaaagggacagaaccatctacgccgatcatcattcacctcatcaagcgacaaaatctaagtgccaagcatgctattattcccgaaatgatatcgacaaaaatgaaaacaaattctcagatcaagaccagctgaagtaatgcagaaggtgcgcatctacgcagaacaaggtgtgatttctcaaccatttacagatcgacagtacaagaaaacatatacaggcatacagccagccacaagagctagctaattaagcaaatggcaccgcttaaggcagcacgcctagtaaacatataccgatcgagtaagtttcacgtaacctctcagaaaaatccaattagcaattgctttaccactaagggactgtaactgccagtcacatcaagatgaatcttccctctttctcccaaacaaaattcctaaacacaaccacgcatcatcatccacgcctaaccccctacggtccgtttggttggagaaagtttttaggagggattggaaatttagagggatgagactattaagagttttgtttgtttgggagacatgaaaattttggtgggatgaggatggagaattgaggaaggaactcctttcttttcaatacctgggtaggggcagttaattgggagggaattcctccttcactttgtttaagcaaatctcagccatccgtttttattaatgacataatctctaactaaattccttatcaattttcatcacctctaccaaacaagatattgggattaaaaattaaattcccatcttaatctcatcatcaaatccctcgtgccgctagtggtaatccctgcttcctgaattctgaaggcaccagtctggccgccgtgagtctgtcagtcactccagtctgagacctcaactcctgtgcaaacaagaatacccaacccaatgatgatccactactccgtgcctccgtatgtttagtgctcgcaatacaccgaaaagcagaggggcatcgcgcaaaaacgcacggcaaggagcaaccagcgagagcgacgtggggagtggggacaagggaatcaacggtctcctctccggctctctctcccctcaaccgtgtgggaaaagggaaaacgaggaaaggaagggagggggccaaaaggaaaagccaccgtcctctacgatatcgcccaaaaacctgccagatcgtgccgtcgtggggagggcgggctgccggccgccgctgctgctcacggaacggaacctccacggcgcatcttaggaagacgggaaccccctactcgtcctccccctcgatagttaaccgacacatatatcgaccgccatggcggccgcctccaagctcggccgtcgcgccgtggcgggcactgcagggcggctcccgcttccagaagcgcgcctccgcctcggcctctagggtaggtagactcgtcgccttcaccttgtttttcttgctccctcccttgctgtggcttgagcattacggggtttctgctacttggctgctagtgcctagctcactgatgtgatattgtgatctggcagtagctcgcgatgctgccccctgcgggatatgcttaggcgttctcgggaagtagccgcgatagtcaacattggaatgagtagagtagctgctctgcttgcggggcggttgctagatttaggcctagttagtgtgcgattctactgttgcggacgacgctctaaccaccatcttaatcgtctccacgacgattgggggtccacgagaggtgcttgccttgccttctcctccacctgcaggagcaacaactcaacaccccgtggctcccctccccgcccaacgagtaggacgggttcttgaattccagtttgcctttgctgacccgtttgattattattattttggatgtgactgcttttctgtcgcttataatggtgtgattttgggctcttggcagatggtgtaggggccaggggagagggggagtgtgtgtgtgtgtgtgtgtgtgtgtagaggggtgaaatgggggcgattggcggggatgaggtggtgcagtgggacaagatggacggaggtgaggtggtcaatggcggcggccgctggcggtgtggggaagctgaaaaggatactggtgtcagtgaggctgaggcctctcagcgacaaggagattgcgagaggggatccgtcggagtgggagtgcatcaatgacactaccataatctcccggagcaccttccctgacaggccatcggctccgactgcatactccttcggttagttcatcacaagttcacaactctgggttttctacatctgtaattcattagttctgcatctcctgttaggattttgcttatctggtcagctcttatgtattgcattccagttgcttcaaatcaggacaaaccttgtatatttctttaaaatttaaaatctcagaatttaacatacctgccggagtccaatcactggtaatttgttacttatacatcgtcgtttgttacaagtaacagaacacatcgacacattcctgtcccagtaaaaaaaatctgacagaacacctttagaaattaagctaaccctcctgaaattgaatgtttacatttacaaatgtattggacatttttttttggtagtggacaactacacaccactagaatacagataagtgggagtttagtttgctcgtactacaagtatgctctttaatattctcactttccagctgtgttttttgacacaactctattccaattgcagatagggtattccgctctgactgcgatacgaacgaagtatacaagcaaggggccaaggaggttgccctctctgtagttagtggcattaactgttaagtccaaacctattgcctatcttatccaatttggttttgattgaagattgcatgaactaactgaacacattttatttccttttaatttgttctgtaacagcgagtatttttgcatatggtcaaacaagtagtggaaagacatacaccatgactggcataactgaatatacggtagcagatatttatgattacattggcaaggtaatcagccacctatcttagtacctattaatccatagctggtgttgaaacgagacacatttgaactgtcaggctgataggcatgttgttctttttgcagcatgaggagagagcatttgtcttgaaattttcagcaatagaaatatataatgaagttgtaagggatctgctaagtgcagaaaacactcctcttagactttgggatgatgcagaggtcaaaacaactcctacttatctaattatttttaaatcctgcttggctcctgctttctactaatgatcttggtgttgtttattttacagaaaggaacctatgtagaaaacctcacagaggttgtattgagggactggaaccatctcaaggagcttatttctgtatgtgaaggtgcgatgtttgtggtagattaatcattaatacattatctagaaaaaagtttataggtggtgattactgccatctgattctgtgtttttatatagctcaaaggaaaaccggggagacatacttaaatgaaaacagctccagatcgcatcaaatacttaaactggtttgttcactacgcagtcacattagaaaagaaaaaggctatagtaaatatgtaaaattgatgttgcattggtccattaactctaacttacccatctgtcctttcagacaatagaaagttctgctcgtgagttcttgggtaaggataaatcaactacacttgtggctagtgtggtaagagacatttaaattttggtcatatttctttttcatgtagaaatggtgaagtttgagcgcattttgttgtaccatgcagaattttgttgatttagcaggaagtgaacgtgcatctcaggcattatcagctggtgctaggctgaaagaaggctgtcatattaatagaagtttacttaccctaggaactgtcattcggaaactaaggttgacaacataacttaatactttgtgtcgtgttgaattccaatttcccatggcattagaggatggatgctgtggctcatttgattacttgctttcatctatgcagcaaagtaagaaatgggcacataccatacagagattcaaagctcacacgcatactgcaaccttctctgggtggtaatgcaagaactgcaattatttgtacaatgagtcctgcccgtagccatatggaacaatcgagaaacactctgctatttgcaagttgtgcaaaggaagtagttacaaatgcccaggttaatgtagtcatgtccgataaagcactagttaagcaattgcaaaaagagcttgctaggttggagagtgaattgcgatgtccagcttcctattctagtcttgaatcattggtgaaggaaaaggataaccaaatccggaaggtaaatgctacttctgacctttatggtgttcactcttgctatttctttgtacttaaagaacttgtagatcctaaaatgatcatttttatgcatgctttatgctaattctcttcaatgccagcaatacaccaacttctagccatggtgtaaaagatttcacatattcttccttgcagatggagaaagaaattaaggaattgaagttacagcgtgatttagctcagtccaggcttcaggatttgcttcaggttgttggagataaccatgtccatgtttcaaagcagtcctcggtatgcagacttccttagtataactatcgtttcataaccacataaagttatttacctttttccttctatctacatgtaggtttctgggaggaactttaccttcgatgttccacagacgtgtgaagatgagcaatcaacaactgagtcatcagaagttgttgacagtgtccaaaattttaggtttcaaggccggcgagtggcacagagggaacataagcctcagcaggctgaaaataatgtgcagtttactaccccatctaggtactcagtcagcagtcctccgttcagtgggatgctcccaactaacagaagtgatcatctctcacagatctctaatgaagattcagatgatatctgcaaagaagtacggtgtatagaaaccaatgaaacaggaggaaatgaatgtttggaatcgtcggctgtggggagcaatagtttgcaagacccaaatgcaggttctagtatgcatatcaacaatgattcaaattcatctatgaattctaggcttcgtgatgaatctccagttacccttgagcagcatttggaaaatgtcagaaaaccttttgccaatattgtaaaagatctgggatcttcaacacgtaattcgtcaagctctaaagtacttggtaggagcaggagctgtaggtctcttactggatctagtttgtttgaagatttggagaaggacgattgcaccccaccaaacagaagtttcatagatttcgctgggagacctcaaaattgtcaaagaaggggatctgcactgaactatgatgcagagagcgagaccctatcaagggcagggtcaatgctttctgaaattactaccacgagggatggactgaaggctaacagttctgttgcaggcgacacagaatttactggcataggtgaatttgttgctgaactgaaagaaatggcacaggttcagtatcagaagcaacttggtcatgtgagtcattggaaatgttatcttgttcctgttgatgctgctcattctacttgtttgagaactgcgcacggttatggtgcttcacatttttaatagctcaaggagggcttatttataaactaaaaatactcgttgcactactttaagatagtccaatatgccacatttaattatgattttgttctttgtttcgattgccagagtggaaatggagacttggcagaaggaaccatcaggagtgtaggactggatccgattacagatgccctacagtcaccttcacggtggcccctggaattcgagaagaagcaacaagagattattgacttttggcatgcatgcaatgtttctttggtccataggacctattttttcttgctattcaaaggagacccagctgattccatttacatggaagtggaacttaggaggctatcatttcttaaagatacctactccaatggagcgatagctagtatcccgaatacttctctagtttcaaggtaagtcatgttcagcatacttcttacaagttcactgcattacatcggttgtgacacttcgatacctactgataaattgactcgggatgcagtgcgaagaagttgcagcgcgaaagggagatgctctgcaggcagatgcaaagacggctctcaatcgaggaacgagagagcatgtacaccaaatggggggtttcacttgcctccaagaggagaaggctacaggttgctcgttgcctttggaccgaaaccaaagacctggagcatgtcagggagagtgcatcccttgttgccagactgatcggactccttgagccagggaaggccctgagagagatgtttgggttaagttttgcgccgcagcagttcactcggagatcctacaatagctggagatatgggcgctcttctctgaactgattgaacctacaagatgctactgacggaagggggctttccagttttcccattttgttttgttttgcttttaggtcctttgtcatgcacttctgtatgatagatgtaactcatttgctattttttattggacgatcagtagggtcgatcttatacaaaaggagttctatatcacctgaattgcaaggttaaaatgtatgttcaactaacacgaaagacttccgaatgttaacagccactcagcattcagaagtagccattcagcgagtctatgttccaatcttgaattctgtgtacaaagcaaggcaatatttaccggctgtacaaaatctcaatcccatcatatttgatcggactcaggcactcagctgaataaaaagaaagaacaaatgtttatgttcgtagctagcatggaacagttttaacagtcgctacgggcatacattcttttctacactccattggcgaggttgtaccatgtatgtattgtcttccaaggatagaagagaacttctaagactgtctccaacagcggagacccattctagagactcatcatggattgagtgatgcacagtaaaaaggtcggacactcaaaaattcccttctccaacagcctacccagtgctcccaatcttcttctctccaacagcctacgctggcagctcgcggcacgactcctcgcgacggctggcagctcgcggcacgactcctcgcgacggctgtggtcggggcggagcggtggtggcaggcggagcacacccaccggcggctcgcggcacggctcgtcctcgtggcggcgatgctcagaacggagcagcgggaactgcgacgaccgcgctccgccgcggactctccccgtcggccgcactccgccctaacgccactacgggcccactacgcctcctccccgacggcgcgctccgacgacgctccccgacggtgctccccgacggcgctcccgccccgccgcgccacctccgccccgccgcgggagctccgcctcaccgcaccagctctgcctcaccctggcccaccgcgcgactgcgcgagctccgctccagtgttcggtggagagaggagacgtatatttgcctagcgctttggccgctacccaatatgcgtatcgcatttgcctctcccgttggaggctgtttttttttacccaaaatcactgtgcacgacggataaatgagtatgcgtcgcgttgttggagacagtctaaagggatattggtggtgaggtggtgaggatgtattgtatctcttaaagataggagagaacctctaaaagattctattattaatagtacatgcggtacaattgtagcaggacttttagtggaatgagtcctaagaataatgctatgggataataatggataaggtcgttgtattattaatttaatagtacaattgaccagatcatcgtacttgattttccatctgatgttcctttttggaggaagaagtgaacgacttgactggtgaagaagcaccgacggaatgaaaacgtaaacaaggcggtatagaattgccaaactcgtctttttccagctcattttcagctttggcacgggctgttttcctgggaaatttcagggtagtttagagatgttgcgtcagttctgcagcaatcaccatttcgaagcgtttgtcaaagtccatgaaaaagaggagtaagaggtaaagctattcgatcgcaataaagaaggtggaatatggtgttgacaaaacatttacccataatcaaagataagaagctgctagcaaagcacacgatattttaataatttactacagtaactcctcttgttttttaaggatgtgtttgaaagaaggggataaaaaatttaagaaaatggacaaaattagatccaccgttagcatataattaattaagtagttattattttaaatttttaaaaaataaattaacaattttttaaaataacttttctatccactttttttaaaaaactcccgttcagcaatccggaagtgtaagcggaaaatgagggatttaattttctttattcttctaacgaacacaaatatacaacagtaactcctctgaagctgtatactaagatcacatgatgaatgatactaaaatttgacaatattccggcgtccattgaaagattcctttgccatatgttcatatacgtcgaatggccaatacattaaacaaaaatgaagaagggctgacacgtacctatattccgggaacgattttatgagttgagaaagaaaaattacgttgaaactcaaccataaaaaaatttcagttaactttaatatcttaaggtatcttaaacgagcacgaaaataatctcgtttcgtcgtcgccaccattataatctcatcatgaccacaccaacagcgaccctttaaccccagaaatccaaaaccaaaccagcgagcgatccttaatccttgcagataaacaactctactcctctcaccccccgcatccatcgaactccaacctcttcctctcctcttcttccctcccatcgacgcgcagatctatcccccgtcgccgtgcgcttccctccgatcgcgagcagatcggatttatgcggccgtactgcttctgctgctgctgctgcgaggagcgccagccatgtcgtggagcttgagccgtggtgagggggaggaggcgggcggcggcggcggcggcgctggggtcggggttcggcggtcgcaatgtccagcatgtcggactcggggacgggcggccgcgggggcgcggagctgatggtggagcagttccacctcaaggtgctccatgccgtgctcgccgtgcgcgggccgcgcccgctgcagccggccgcgtcggcgtcgttcaggcggcgggacaggtggttccacctcccgctccacgatccgcagcctccgcccgcggcggagggagtggaggcgccgaaggcgggggagccgctcgtggtggacatcctcctggctcacgccgcagccggcggcggcggcggcggcggagcgggcggggaggtggtggagagatggacggtggtgtgcgagccctggccggacgccgcggcgggcgaggggatacccgtgaaccgggcgtacaagcgctgcatgacgatgcttcggtcggtgtacgccacgctccgcttcctgccggcgtaccgcgtcttccgcctcctctgcgccaaccaatcctacaactacgagatggtccaccgcgtcggctccttcgccgtgccgctctcccgcgacgaggaggccgccatgcgctcctaccagttcgtccccgtcgagacgcagcacggccgcctcgtcgtctctgtccagtacctccccagcctcgctgccttcaatctcgagatctcctccttgtcgccctccatgctgatcgccgactacgtgggcagccctgctgccgagccaatgcgtgccttcccagcttcgctcacaggagccacaggttccgctttcccgcaggcgctgtccaatcagccgcagcgcccgcacagctgggcgacgccagcgctctggccgcaggcgcctaggcagcaagctagattttcgccacctcatttgctcaacgcatcacccactccatcgccacccaattttcccagcgggtatcttcaatctcgtcctaagggagggtctgcaccaatgagcataccacaggtgggtgacaggaggagcccaattcaccggccgatcacattgccaccaacgtctccgaggagagtaggggagacaggaacatctagtgcacaacagtctccatcagagagatgcccctcgtttgggagggcagatggatttcgaataatggatccctatgcaagcttgtcgccaggacgcaaggtgatccatggttttaaagcctccaatatgctttcaacttatatttgatacttgtgtatgccttatcttcatcactgctcaatactggatccttcatgaatcatataacttttgagagtgagtgtaaggcaattcatctggtatatctgaagtagacttttctgttttcatgtggctgagtagagcctactggcatttaccttggaaactaggaaacaaactctaccaagagctatttcaagtcaatgtttagcagtacatattcacaagtttaagttgttatgttaagtttagcttcatgatattgtgcaacaaaccatgtttgatagtggaatgtaagccattattagtactggagttgaagcagcctaaatactgtttgttagcatatacaccatttagctctcatctctccttttttttttggcaaaaaatagactacatatcagggtctcttattagttgtgaactgtttcgattgtctcttggttcttgctgagaccatattatttgttgaaaagaaatgcgttcatagtacttgttgaaacagaagaatggttgttgagttagttattttctgaggcttacccaaaagcagcttttgatcttcaaatggttggatatttggattacccttgtctgctgcaatatatgtctgctcttgtacttttaatttttatttagtggattgcctttatgggacttaatcttatcctctgcattagctatggataacttatttatcttcctctagctattgaagccaggaaaaaaatatgtatttgagttgggtctgcgttgacaccgtttgacccatgtgcagggcaagtacactaaggacgaatttgccaggttctctgcactctcctcctgtgattcccctcgacaagatgatatagatgatgcagattatccctttgctgtggatgatgttgatacaccgagctcccagcctgggtatgtatggtagtaacttaaatattctatctatagatttgatgaatttcgccatttgctagggcagtagtgcatcagataaagccagaaacgaattacatgaagtcttatctattcatatgaaatacgaagtactagctcctatccgttatattttgggagggaggcagtactaagttgatttagtatccatagatctagttgttaaagaatgctagaggctatccggttacacaaatatttgatcgttagagctatcaaatcctattatgttgcacattatttgattttttttttcaaaagtttaaatatgacattaaggggactaaggatttgaaaaccttttggacatgttattttgtcatactacaaaactagtgttagaataactggtagagatagcaaaaaggaataataaaaatgagggttattggcttagttaacatggactcggtgtgccttgatcgacagctctaccaatatgtagtttattgcaaagatctagattttgcatagttaccagttcttaagtttctttgctttatagttagagtgaacacaatcatatgtcagagctaacagttgctacaaatgcaaagcacaaatttggacttgactcgatgactttttctttttgcaacttctaagttctaacctctatgtaacctgcctcttagtcacaatcaacaagttttaacatattaaaatgttttttagacaaaaggccaaagccaagctatttatagaaagcataggtagatagaagagtgtagtcgggattaccggccatcctggtaaagtttctggaacaaaatagccactaggctacaactcgacaatgattaacacactggccaacaaccaaaagcgatatcaagatacaaccagaacggcagaaagaaactaacaaagcacttataaaagattaaattgtactagtggtcatcaaacacatatcaaacatgtcctacatgtgcaagtatgtttgttatggcttggccctggacttaaatggcaaagggtgtagttgtgctcgacaggagggtgcagcctgaaccctcacctccctggaaccctggaagagaacagagtgacaggacagaagagagtaggctaagttcttgcttgtgtttaataatgaatgccacctctgttgtatagagaaggtcgtttgcaatatccaaataatgttcctaacgatcctcaacaatagctaaacagacctaaccaagaaaatgatacgcaaactaacatttaactgatcaacggcactgattaatcctgtagtaacacataatctggcttgctgggtcgaccgaacttatgtcctcacataacaaggtaatggtcactcaaacctatgccatcacagtagctggcatggcattgatgcctatgggttaggcaaatttgcttgctaatgacttctgtgaacacctaatgaagtttatttacctattacaccaaaatctaagctagttgaactacttgcacgtgtgagataagtctgcagaagagctccaggaaagtacaattcagcactttattttcttaatgacaatccatacaatatgggccttcccctacagttcaccataaaaatcaattacagaaccattgaaaacagaaatctacaaccccaaccggcagtcactgtaccaccatattgagtgaacaacttgaatggcgagaaatgctacatctgacaagctagatggatagcacatgggagagggatgatgattattcagggatgctgattgctgagtatctggtttgtggtcgagggtcaaatttcaggccttaggaagagtgaattgctcaaatggagttttccttttacttttattacactcgtacataaattaaatagtaaatttcatagaacccccggtattatggtccaaattgcagaaaaccacgggggttttggcacgtgacacataaccttgggtattatattatagtactatagttttataaaaccacactgtcaaggcgtcaacaaatttaacttgacattgtagcaaaataaaaaatgcttaacttagatggctaaagttttttatgatagataaaaaaattcattaattcgagttttgagatttgatattagaaactcatacttatgatgaaacaaagaacaattggttaacaatgaggttttgtgaaactctagaaccatgatatccggggttgtgccacatgccaaaacctttgtggttttgttcaacaaggaccataatactagtggcacggttctaatttccccaaattctagtggcacgtagccgatatcgtgaatagtagtggcatttatctaaaatggcatatttgtagtggcatgtcctaatacataaggttatgtgaaatttactctaaattaaacatctagttttgcttgtttgggcggtcattgttatgtggtgccaaaataggataattatattcaatgcattgagctacatttgttgcgtgatagtctatatggtgtattgaataagatgattagtctattttactattcccagtgccatcagatattcttttgacgcagcaccctatattaacaggagattcagatctaatataaccttatctggatatgtgcctctattattattcaccccattcatgtttatctttgttgagctgtacccatggcttttgataaaatataacagttatgtatgtcctcttgtatttctactattcggttctttgtttccactactgagtttctatggttctaacaccgtttctatatgcactatataatatacaggagcagtgatgggaaggaagctagagatcaggcaagttcgtcgtcccataaatcacaagatgccgcagttggctctctggtgcacctgctcaaaactgcacgccctctgcgaaactctaattgtccatctcaagcatcagcggttgaatctagtgaagcagcctcaaccagttctgtcgtgtcccgtaggaaatctgatgcactcgaagagctccaatcatttaaagaaatcaaggagaggttgatgtcccggagtagagcaaaacagcaagagccaccagaaaaaccatagcaccgttctttccttcgtaaacttcacaggtgaagatcccctaccacaaagcgggctatgcggtgagctcagtgacgttatgctaaggaattcgtgtgtatataactgatggactgatgcttttagttaaagagaagatacgagttaccactgatttctgcgagaatccctcgccattcttgaactctagaagaattacgccactgtttatacgcttttatacgtaggtgggagcctcttgacgaatatagcagctccagcgtgtgcgtgtgtaattatgtgactgtactgactactgtgccgagtgttcggtaaattaaagtatctatcttcaaacttcaaaatattgctcgtaatccagaaatcaaaggcttaatgttctgtactcctatttgagatagagatgtgaataggcggtatgaggatggtataattaattctgccagtgatgaactagtgaaccgatgactttcaaataaattttgcattgttggaactaaggcaagaggaaccccgttccccgtttgccatacagtgcataatttaaaatttgcaaagttctaatgccagcaatttggagaagaacttgtgttgatattggtatggatctggggcaaaattcttctggctttttttagtgcaggctcgcagaagagaagcggcgttttcagtgactaggcaggccttggtacctcgcattctgggtctggggcccgaaaactgtagccttgggccggtttccgcaggaaagtactgccatgaaagcccatttctaccttcaaattgcacgcgcgctctttgggtgggttggagtccattttaatccctttaaaccgggtatatcgcgaatgaatattaaaacaactccatcgatatgtacatggctatctctcacctttttcctcaactactcccttctcttagtctcacctccctctcttgcgggagctccagcacctctcttgatctcctttgttccaccaaaccctagttgccttctgccatatcaccgtacaacgggaatgaagatggctctggagaggctcgacactctgacgagatggttcacgtaatcattctcccttgacaccgtcacacgtcatgcaaccaagcaaagcttggcgtcctccttgtgctccttgggcttttcacgctcacgttgttgggcctcatctcttccctgcgccatgacccgcggatgtggctccttgcttccatccaatttaagaatctccttctccgcctaagacctcctggtgacaacgccatcaacctctcgcccttcaactacatcaccatcaaagcgaacctcctccagctcctcaccacgtcgtctctcatccatgcacaactctccaaggccctctttgccgccacagcttccgacttccctgctaggtagcgtcctcccctccatcgtctcctttcttggtaccgccctctcctcaggggatgtcacaacgaccaactccttccttgctatagcggcatccctcttttccctcttatgcaatgcatttgaaggcaacactccatccgcctcaacctaaagtactaccttgagaactttccctctacactaatcgaggtcttcctctccacctcccactgccttcagacggttgttgtcatgatgacccatatgaatcccgcacgatgtttgagtaccttcactcgtgttgtgagatcttcgtcaccactttcccaagttcaataggaggagtgtggtggcttaggttgtactcgagctcctcctcctctgtcgcctgctagccaccggttgtgccgtcggtgacccacaagtaggggtgcaaggggcaggcccgcgtacccaattacgcgggattacccgcttttttgtattgtaagtgggttcacgggcctacccccttgcaaccttacccacaagtggagtgcccataggagggagtgaggggagagaggggggtggtgtaggaagaagatgggaggtagtcacttactgggttgccttgtggatgccacgttagccacctcaaatttgagaaatctttttgaaatggttttaatacttgagaaaggcgtagtatagattcggccaatagttgagtgaaaaatagagtttgtcgaattagtgatgcagagccgcaaagaacaagataaaacccatttcttgtggcaaaccactggcaagcggtgattgtgagtggcgacgtgatgtcattttgcctctgcccgctgatcagcacgcacaggcagcagcctcaattgaagaaaaaataactctggtacacgaacttaaaaaaatattacaaaacctttacaaatatttattttaacaattaatttaactacaaatatacatgacacatcattgttaagaatagtttagtaaaaagttaatacctagcctttaaaaaagcacaattattttaaaaacatggtacaaactcaggtgctcataacaagtgcatacttatccctatgaacattgacggagcgtggggctcctcaccgggagaccgcgcaggccccctttgccggttcggccgggggcgctaagtgaggttcttcgccctcgatcggtctggggaatgtttcgcgagagagtaaatgcgcaagacatgggcgatgtagacaggttcgggccgctgagaagcataataccctactcctgtgttctggtggatctgtgtatgaaggagttacaaagagctggagagcaagagagttcccactctagagcccctctcactcctcttttctccagtctacttgctcaggtctcctctagtctttttttccgtccctccttttttttggtcccccctcttcgtaggcatggtcctccttttatatctcaaggggataccacatacaccatttctacctacccttcttttgggtggggacccatcctactttgaccaaaacttggctcgtactttcgcctgacaccgggataaccctgtcctccctcattaatgggcggagatttgcaatggctgctgtccgaatgaccctccgacgggatgggtcataccaacctccactccgccggaagcaggtgcaacgtggaagcacggttgtttgctgatgacacgaccggcgtcagaccagtcacagaccggtcattcttgtccaccacgtgtcagtttagcatgctacacgtctgcacttcttcatacaatgacttcctgcaaatggttcgataagcnntggaatgtatctggccggggctacggcgccaactcaagnagttcccacgccggctccggctagggacgagtgcctgnaggctctcatcattccgacnggacggggcgaggcgtgtgtcagnccgcctgttgccccctaacccgcgatctgaccggtctgtgaccggtcacacactgcgaccgatcacggaccggataagcatgcgctatgctgcattaaatgcggcgtgaggcgctcgtccaacccgcaataaacgcggttaggtgagcgccgctgtgctcacctaacccacacacgtggcgccaaaccctcagggggtcggggcaccccagcccccggggggtcgaaacgggagcggcccgacccctcggggagatagagggaggggcggcctcatcaacctcgggcccgacccccccgagggggtcaggccacgtgggtgaccgcggctgccccaaacctctagtcaagatatccccggtcccatgtcaccgacagtagcccccggcgttatgccagggcgatcgccctcctcgaggaaaacgctcgggcgtgacgccactcctcaggcctggtgacaggtgggaccggtctctacaggcggacaggaatccagtggtcgcaaatcgcgcgcatcggcaagggaaaaaccgaccgacaataatgagcggctttcttcaagaccgctacattacttgagtagcgcgcgaattgggacgagccggttcgtttcgcctggagatgtgatgatggtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaggccgggctgccgcgccgattcatgccggaatctgccaccggccgggaggtggttgcgctgggtgagggacgcccggcgccacactacccggggcggtccgtattcttccttcccttcgcaatggcagggctggtcccgtcattctcttctttcttcatggatgttctggagctttatgatctccagatggcgcacctcacccccaacgcagtaatgacgttggccatcttcgcgcacctgtgcgagatgttcatcggggtgcgcccatctctccggttgttccggtggttcttcaccgtacagccggtgtcgccaccgtcggtagtcggtggctgctacttccagccgcgggggccggtgctgaaccgctacattccctgcgtccttcgcaagaagtgggatgactggaagagtgactggttctacacccctctcgccgacgaagcgcgcctccgacttccgagccagcccccggcgcaggcctccagctggcgggcgccggtagatctgggagacggctacgacgccgttcttgaccgcctggctggtttgcggtcccaggggctcacgggggccatggtgttcggcgactaccttcgtcgccggatcgcgccgctccagcggcacgcccggggcgcctgggagtacaccgggcccgaggacatcatgaggacccaccaggggcgcaaatgggactgggaccctgaggacttcagaatagtggtccaacgggtgctgaatctcagctccgtggaggcatccttcatctctcaaggggtccttcccctctcctgcgatccagagcgcgccaacatcctgaccatcatgcaggaggtcggggcgtcgggggagcgggccccccgaggccacaatggcgcgggcgggagccgcaggggggaacaatctaccccgggagggggtcgtgcttctgggccccgtgacgggggcccggggggcagccgccctaccgacgcccgggggaagaggaaacaggaggataccccctccccatctcctccccgagggggcggggcggtgcgtgccagcagcaggcgcccggagggtgctgtgccgacgtcgcggcccgaggggaagcgaaaaaagaagcggctccacaagatgggggggaccgaaccataccggggaaacctcatctcccccccaaggtggtcgtttagccgacctcctcgcaggttcgtccctgcgcccactgcggccgtattcattctcccatctcccaaggcaagttttcactcacccgtttttcgtcttctagtttttcttctacctcagcgagatcccgtcgcgcccttcccgccattccaagtccggccggtctgaggccgaggagacggcgaccgcggaggcccggaggcggggagctgaccggcgagaaaccgcaaaccgcctccgggaagccgaggaagctgcccaggaggctgtccgggcttgccaggctgaggaagccgcttgggaggaggcccgactccaccgggccgaggagtccgtccgggagacggaggcggcgcgcgcacgccgggcggcctgccaagcctccgacccgactccgcccgaggcgacgacgacttccgaggccacccacgacgaggccgcgggcgcaccgctcgggcccgacctctcgggcgacgctcaggacgggccagcttcgggggacgtccctgagtccggcacgtcgatcggtgggacgagccgtgcggcatccttaccgaggcggctctcccccatgccttccgctgccccactgagcgcggagccccttctgcaggccttggccaccgcgaacaccacggtgttggacgggttaagtgcccagatggaggtcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtttttaacgcggcgcgggacgacctctgcctccaatacgggagccgggaggcggagctagagaagaagctcaacgcgtcccggcagcgtgaagaggcccttgaggctcgcgccacggtgctggaggagcgcgcccgcgccctggacacgaaggaaagggaactggcgggtcgcgaggccgccgtcgccatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccgcggggcagcgcgggaggagcaggcgcgccgtaatctggaaggcgcccgtgccgagagggccgcactggatcagcgggccgctgagctcgaggcgcgggcgaaggagctggacgcgagggcgcgcagcggcggggcagccgcgggcgacggcgatctagccgcccgcctcgcagctgccgaacacaccatcgccgagctgcagggcgcgctggactcgtccgccggggaggtcgaggccctccgcttggcaggcgaggtagggcccggcatgtttcgggacgccgtctcccgtctagaccgcgccgggcggcaggcgggcctctggggcgggcggatcgcgaaatatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctactaggccagggacccggacttctccccgtgggcagcgctggacgagttctctcctggaaccgaggatggcgcgcgcgcacaggtccgggacgccgccgtccacatcgtccacagcttcgagggtacggcccctcggctcgcgttcgccctcgactccgacgaggagggcggcgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcagctctgttcgttgtgtatatgagacgaggatggtctgtgccgcggtccttctgtgtcttggcttgaacgaggactcgtgcccaggtcccagcctcaaacggcgcgggtcggggctagtgcctggggagatccacgtgtcgagactggccaggccgggagcgcggtgaccgagggttatggggacccgattgtgggcctttgccgattcccccccggagttcaccacgccccggggcacggctcggttctgggccccgtttggcgattttagccggcccgggccactgagggcaggatcgagcacgagcgtgctaattcaagccaagattcttcgaaaggaaacaatggcacagacacagtccttaggaaatcgaaaatgcttttattgaaatacggaagagaaaaaagataagcttatgcatgtggtagcccccggccaaccctgcacgcccgggcggggtgcggggttggcccgagcccgagacctgacacccgacccccactaggggtagaagcgacgaaggtgtttgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgatgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggtttggttcgcccaaagcaccgctggcaactcctcgatccacgagtcgccatgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagttcactagtgaactgggtgccgttatccgtaatgatacggttaggcaccccaaaccgagcagtgatgcccctgatgaatttaagtgcggagtgcttatcgatcttggtgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcttgggccggctgatgggtttgcttggcgtggaactggcacgccctgcaccgccggaccaggtcgaccgcatcgttgacagtcgtcggccaatagaaaccctggcgaaaggccttgccaaccaaggtgcgtgaggcagagtgggctccgcactcgccttcatggatatcggcaagaagctcgacgccttattcccgaggaatgcacttcaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactctgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcgaggcggaccaggtatttgaggacatctccgctcggcgaggtcaacgtgacccccgcaccggcaccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgactgcgtggcgtggttcaaagtgcaaatcgaactcagagagttcgattgcccatttcaccacccgtccagtaccctctcggttatgcaagatttggccgagggggtaggacgtaaccaccgtgacctgatgcgcctggaaataatggcgcaacttcctcgaagccatcagaatagcgtaaagcatcttctaggcctgagggtatcgggtcttggcgtcccgaagggcctcgctaacgaagtagacgggccgctacacctttcggcggggccgatcttcttcactaggggccgcatttccagggcgctcttcgtccgagaggccgcgcggggcgcactcagcttctgtgccgacgacctcggggtcggagggcgacaggcgcggccttcctgcagtggccccggggccatcctgggggtcgggggcgcctagcaccgtcggacaagcgggcggagggccagctccggccgtcgggggccttaggccaccgttcggctcgggggcctctcctccctgctctctcccgggtcgaatcgacacagggtggggacgcgcagagcgaggatcgtcctcgtcacgctccgagaggccgcgcggggcgcactcggcttctgtgccgatgacctcggggtcagagggcgacaggcgcggccttcccgcagtggccccgtggccatcctgggggtcgggggcgcctggcaccttcggacaagcgggcggagggccagctccggccgtcgggggccttgggccaccgttcggctcgggggcctctcctccctgctctctcccgggtcgagtcgacacagggtggggatgcgcgaagcgagggtcgtcctcgtcgcgctccatgaccaacgccgcgctgaccacctgcggggttcccgccaggtagagtagcaacggctcatctggctccggggcgaccaggactgggggagaactgaggtacgccttcaactgagtgagggcccgttcagcctcctccgtccagataaacggcccggagcgtttgacgagtttaaataggggtagcgccttctctcccagcctcgatatgaaccgacttagggcggccatacagccagtgacgcattgcacatccctaagcttgctggggggcgcatccgctctatagctcgtatcttctcggggttggcctcaatgcctcgggcagagaccaagaacccgagaagcatgcccgcaggcacgccgaacacgcacttgtcggggttcagctttatgcgggcggtgcggagactttcgaaagtttccgctagatccgaaagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcttggatgaatctggcctccagaagtcgcgccacctcctcgcggatgaaggcttgacgttccggggcctgccaccgcactttctgccggaccggccttgcgcccggccgtacggcgagacggtgctcaatcacctccctggggaccccggtcatgtccgccggtctccaggcgaagacgtcggcgtttgcccgcaggaaggagacgagcgcgtcttcctatttatcgtccagaagaccaccgattcgtgtggtcttggacgggccgtcgcccagggcaacctgcttgatcgggacctcgtcgcacgtgatcatccgatgcctcggggcggctgggacggaggtgctgagcctctcgtcgccacccgcgggcttggatgccgcggcgaggtggtccgcgcgctgctccatgcaagcaagcgcgactttgaggtcgccatggacggtgatggggccaccggggcccggcatcttcatctggagataggcgtagtggaccgccaccatgaacttcaccaacgcgggcctccctaggaccgcgttgtagggcagactgaggtccgccacatcgaagttcacccgctccgtgcggaagttggcggaaccaccgaaggtgaccgggaggtcgatatgacctagcggccaagtgtgccccggcgtcacaccgatgatcggctgggacggccggagcaccatccccggggccttgatggcatcaaaggctgcgggggaaaggatgttgagggctgcacccccatctatgaggacacgccccaacttcacgttgcaaacggtgggggaaaccaccatgcgatctgtcctccccgggcaatgcatggcgggtggtcggtctggtcgaaggtgagggcaacctccgaccaccgcgcccgccgcgtcgcctcatgggtaggggccgcggccagaagctccgcttcatggccttgaggctccgacgagaagcgtgagcgcgtgctcccccatcgacggtggcgatggtggccccgggctcctggaaccctaggtcatcgtcgccatcgtcaatgttctcggcgggggccttctgcttggcctcacttcgccggttgctggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgctggtcgggcgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccatgcctcctccttgcgagccacacggtccgcgagctgaaaaagctccgcagtggtctggggctccttggaggcgatcttctcaagcatgcggttgtgccgcacgccccccctgaacgcgtagatcaccgcgtgtgcaaggatgcacggtatggtgttgcggacttgacaaaaccgctgaatgtacgagcaaagagactcatcgtcccctcgctgtaccgcgtgtaagtccgcttcttcacctgggcgcggatatgtgccctggaagttcatggtgaactgctggcacaaatcctcccaagagtggaccgacgcgggtggcaagttcattagccaatcccgcgcctgtcctttcagggccatggggaagaaattcgccatgaccctgtcgtcacccccggcggcctcgatcccagtcgtgtagatctggagaaactcggcggggttgacgctttcgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgctcgatattgaggcgggcatccggcccctcacgcacatcttcttgggtgggaggcgttgacgagggaatggcagatgaacggcgggtaacggctgccgctcgccgcgcccttcgcctcgacgacacggagccggcagtagcaacgccagtggccttggtggcggaggaccgcccgccggcgcctaggcgctgctgcgccgtcatgaccaagttggccacgtcatctagccaacggcgggttggagtctctggatcagggacgacgggcgggtgacgcaagagcgcgcccgcagcctggagcgcgccctggggcgtgctgccatcaccgtagacgaggagacgacgctccccgtctcgccgtccttctccatcgcccgcgtgcggcgaagtcgcggatctttcgaccccctcgagcgcctcctcccgcctaagacttcggcgagaggggggcggtggagtacgagctcgacgacgcgggttctgctcgctgtcgtcaccgctagcgctcggagagaggttgtgcgccactgcccgttcggccattgggctgagcgggagaagcttggcgcacacgaaagaggacgagggcttagaaaaacccacgcgcgccccctacctggcgcgccagatgacggagcgtggggctcctcaccgggagaccgcgcaggcccccctttgccggttcggccgggggcgctaagtgaggttcttcgccctcgatcggtctggggaatgtttcgcgagagagtaaatgcgcaagacacgggcgatgtagacaggttcgggccgctgagaagcgtaataccctactcctgtgttctggtggatctgtgtatgaaggagttacaaagagttggagagcaagagagttcccactctagagcccctctcactcctcttttctccagtctacttgctcaggtctcctctagtctttttttccgtccctccttttttttggtcccccctcttcgtaggcatggtcctccttttatatctcaaggggataccacatacaccatttctacctacccttcttttgggtggggacccatcctactttgaccaaaacttggctcgtactttcgcctgacaccgggataaccctgtcctccctcattaatgggcggagatttgcaatggctgctgtccgaatgaccctccgacgggatgggtcataccaacctccactccgccggaagcaggtgcaacgtggaagcacggttgtttgctgatgacgcgaccggcgtcagaccagtcacagaccggtcattcttgtccaccacgtgtcagtttagcatgctacacgtctgcacttcttcatacaatgacttccttgcaatggttgcgatgaagcctggaatgtatctggccggggctgacgtgccaactctaggagttcccacgccggctctggctagggacgagtgcctggaggctctcatcattccgacgggacggggcgaggcgtgtgtcaggccgcctgttgccccctaacccgcgatctgaccggtctgtgatcggtcacacactgcgaccgatcacggaccggataagcatgcgctatgctgcattaaatgcggcgtgaggcgctcgtccaacccgcaataaacgcggttaggtgagcgccgctgtgctcacctaacccacacacgtggcgccaaaccctcagggggtcggggcgccccagcccccggggggtcgaaacgggagcggcccgacccctcggggagatagagggaggggcggcctcatcaacctcgggcccgacccccccgagggggtcaggccacgtgggtgaccgcggctgccccaaacctctagtcaagatatccccggtcccatgtcaccgacaaacatatatgccctactccggatatggatcctctataattgaactattaatgcaatatgctacaatgttttgcagtagtatttgagtagttagattaacaacggacggttcagatcaatccattactgtagcatcaatattttagcttatatccattgctatcacattcatactgtggatgtttatcatatgtctttaatcatgaatggatggtgcagtttcctcctaatgcaaattattgtagctcctttgcattttgtactctaatgcagaggatcccgatccccctactcctatgagcatttgaccggtatatcttgaaattaatactactaaaaaaacattaataggtgttagttggaaccacacaaaggtattggttttctcaaccggcatccaagcagatggcactgatgactaaaggcatcggtgtcggttacataaccggcacatataacaatatataggtgtcggttgtaaagaaaacatgcacctataaggtttgaacaactaacaccaatgaccctacaggagaaaaaaaaaccatcgagacaggctcgagacaatgagcctatgattaaaatccctaaagaatgaaacagatatccaacgaaattcacaaatttataggattaaaagtcacataatccatcaacacatcacataatattacaattttcatcacatggatttgaatttagaaattctagacaactcgcgactgttgtccaccatggaggagtctgcccacctgttgtcctgtagacaattgccgacaacaagatcaacaagagagaggagggcgagaggagggcgagagaaggaggaggagagtgaaggagaggggagtatggagtagggagaggacaagggacactgacctttgatgtcggcggtggagccgaggacgaagggactacccggcgttgccaggtgcctctagatctggcggagtgggcagcacaggggctactatcatcatcgtcgctattgccgatgaggacattacctctgtcggcgaggagaggtcgacgccaagtaccagggtcaccaaatccagcgcccattgagctagaaccaaggagggggtcaggcaacgacgacaacgccgcagtgatgagcaatgtccagaggtggatccacaacatggacaacggggatgacgtggccatcggtgacgaggacggcagggatgaggcggacggcttggggagcccgtcgcctcccttttcgtcggatctggcagaggggagggcgccagcgccgtcgcgtagccaccgtcatcgtgctgtcgtgccaccgtcgtcgtcgctgtcatcgtgtattcgcgctgccatcacctggatccctcgacagggagagtaagagtgggagaaaggaggagcgtagcagaagcatgtggggggaggcggcggtgaggacgggtgggagtggggcggtagtgtggaggaggagagaggaggaaggaggagggacaggagtggggtagcagtgtggatgataaggatgactaggagtgggagtagataaggttggtcggttcagtcggctccgaccaatttttttaataggtgtctgtttatttaaaattctgacacctatatgattgtaggtgttggttcttaaaaaccagaacctataatatattataggttctggttcttttgaataaaccaatactaatattttacgtgttggtttttatatagaaccggcacctatctattcacaaaggtgtcggtttttgctgctccccccccccaatgagcacgtgtaagtgtgaaaaaatactatcgatgtcggttttagctattctagcacctatagtgtctttctatagtagtgtaacagagtaaccacgagcatctaactatcgatgggtatatcgcctacgactgaatgaataattagccgtaaatacgagcagcaactatgtcaagtttaggacttgaatccgagtagactgctttcatcacaatgaacctaatcagtgagctacgcttgcgaaaagaaaacccacgaattttgttacggtcaacactattcatggtcgaatttggtacagcttttttattatcagtatctgaaaaataagaaacaaacgagcgcacatgcatagagttgtaaaaattcttttctttgaaaaggtgcaaaatcatagaggtatagccttatactccctctgcccctaaatacaagggatttt

SEQ ID NO: 512 - DNA, 16658 bp, Oryza sativa
  unsure (1)..(16658): unsure at all n locations
cccttattttagagatgaagggagcagtacaatctaaagtggattattggcaatttggcacgaaagggggaaagaccggatcggagggggaatgccgccggcggctggcttgcaagatgaagcccgtcgtgcagcgctgcggacactggacagtgctccacgcctcgattcacgggcgcgcgcgcgcgtggcctctactccgtcgaccgggcacacccacagcatcatcgatgatcgataaaacagtgcccggacgtttccccgctgttacactaccgcacgcccccggtcacgtaaccctgctgcactcgcagagtcgcagggcaccggcacgccacagcccacacccatactccgcccctgctgccagcctagctactctcacgcgttgcccgccccgtccaggttgctacacccacaccacccgcccgcggcctcgcccgcgcgtgcatgtgccgcgcgcgcgcaaggcgtccaaactacgtcttctcgcgtaaaagaaccgagacacgcatgaggcctgaggcgcgcggtggcgcacagctcgtgcgagcgcgttggggctttgcgggctatcctagatcggtgccgcctgatcgatgcccacggtctcgttggtgactatgtaagacaactagacgtgtctagaaaagcgagcttagctcctctcgccggccgagccaatctggccacgccttgctccacaactcgccggaccgaccaagcgcaaacggccggactgattgagctcgcaaacgtcagacgagcgctgcaccactacggacgtacgcgcacactagctttaggatatgatcggtgcgaaactgcatgctattcatttcattcctagagaaggatggatggaactagaagcgctatgtataaatctatattataatgtattcgtagatgaaattctagctaaaactactgctgcccagcttgcgattctcggcaccgtagtgctgattggtggatcgagcacgcaaacaatttctcggcatcgcgctgctattattgaatccgtctgacgtttcagacatgcgtacgtgtacgtggtgtactccgtgttggtttatgctcaactgaatatctttctttaaccaaacctgttatcgcagtgacgtcgacgtggttgaattatagctatacggccggttcttaattaactactctgtcatatttaccttgaggtcgtatggaattttgctggggaaatattcatatacaaggtgcttgaattggaagacacaatataaaagttcgagacaatacaagtccttccaataaacttattaattaagtactcttcaccaaatcacgcacatgatgacatgaaggcatccaactgaagcatttcctccaacctttttctatcattcctttggaagttccaatacgttttccctccatgtccctctcaatctaactaaaggatcattttcctttcagcttcctccaatttcctagtggagcacccaataacctcttttctctgatccatatgtgctaattttattgatgtgtaccactaatacccaacaaagcagcattttctcgttcatatgcactttttcctacctcttacattgcatatcaaacttatgagcacaggcacttttgctgttatagtgcatcatttgtggttcttttgcacttttaaaaagaaaagagttagcacctagatgtggtgcggtggtggtatgctctgctcaatcacatccatttctgcaccatatagaagatatttcctagcttagctagatatacatttataggcatgctaatgttgttatgtcgttctcactccacaggatgcatgtttacaaagaaaaaagttcgcacctataggtggttcattaatttccatgcagtacttaatttataggattattaactattgtttgtatattttaaccaacaaagatcatttccatctagctttctaaagaaagcccagtactgtaagtgtgtaacttactttttattcattcgacgcactgaggcaaaaagatagttttgggaaactattttaacagctcgagtggatgtccacccgtttattacatgtcatctaaatggttatgaaaaaattgaaaaaatatgaataagatagatcaatatgtaatgtatcaatccataaacatgcaagttaaaattcaacttctacagattgtaacaaaaataacaaataaaactcaaattactatatgtatatttacagttaaatttgttatttttgttacagcttgtagaagttgaattttaacttgcatgtttgtggagtgatatattacatattgatctatcttgccaattttttttgaaaatttttcgtagccatttagttgacatgcaataaatgggtggacatccactcgagctattagaatccatccccgctagtttttgtaaataaaggaaagacgccaaaaattgaacagaaagagggaaaagaaacggcgcaattaagccacaatatacaccgatatctcctagtagtatcaattgagctaattaagttcctctctaccaaatgaaatatagtaagcagtaagtactattgtgcacttgaagacactgatgatgaccacagctgtgatggcggttttccctttccggttgttcactccacgaaatatgcactacccgtggtggccacgcgcctgtctaatctttttatgccagtggccgcagcacattcttcagattaataaaaagaatgcgtcaagatcgaatcttaaaattttctttttttctgcctcccacccagagttggctatagcttgctagctagagccccaatgcaagccgatcttgcatgctaagtaaggactaaggagtaatatgctagtaaggagtaatatttgctatgcttgtcccttgttcccggcgcttgcaatgcccaaaagctcagagccaccgtgtgtgctagctgtgcgtgtggtgcttgctttgttcaattcattcttccttaatcgtgaatccgcactatctttagatcgaaatgaatgctactacgtaattaatctaacatataaccggggtggagtgtaaaccacgcgtgtatcacgcacagatcggtgttctgtgatcggatctttcgttatgcatcatcatcagcatgcatgtgcatgttcggtttgtgcatttgtaaactgttattttaaacgtcaacaaacatttgtttatttttctttcaatattttacagtacttcattcgtactactaacaacttaataatacacagcacatattgatatatacatataatggggtgatcattgtgtagtttggagatgagatagaatgacttagactatccctctttttgaatggaataatcatatcatctatttggtatgagcgtgtagtggtcctgcattttttaggaatcggatggtatgtggggtgatcctacgttattaagggatcgaccgggtgcggcccacatgttagtgagagagaggggtggattggattagtccaccacttaggtgtgatcatatggaatattttcttttggggaccatctcatcccacccatgctcaaacaaaacacctacaaacaccctgacggtccagcatgatccatcaaatccatcgaactaggtgtgtatcgcatgataacataatatagagatacaaccaggcccacatgttagtgagaaagaagggtgggttggattagtccaccacttcttgaggtgtgttcgtagggaatattttcttttggggaccatctcatcccacccatcctcaaacaaaatacccttgcaatccaacacgacccatcccatccatcgaaccaagtatgtatcgcgtgataacataatgtagagatgcagcctaacccacatgttagtgagagagagagggggacggattggattagttcaccactacttaaggtgtgtttgtaaggaatattttcttttggggaccatctcatctcacccaccctcaaacaccctgacggtccagcacgatccaccccatctatcgaaccatgtgagtattgtgtgatgacataatacggagttgcagccagccgtgaggcacatatgctttgtacacgacgagacgatggttaggggatcaaacgagacggacggcgagaaacgcattgtcactgtcacatcgtcgtccgggtctatctcaaagtggtcccggtccacgtcggcatccgatccacaagtcagcgaggggcgcgtggccggcacacgccgagcgatctgggccctccatttcgccaaccctagcggcctcacccgagtcacccctataaatgccggtggccgaggcgtgtggccgccacactgcgatccccatccatcttctccgcacacgctacactcctctcgatcgatcttctcctcccgtctcgatcagctgattcgcccagcctccggtagcttgcttgtgcttcgtatccatggatcctcaccacagctcccacgtccatgccggagccgccactcctaactgcacgtgcaggttgcccaaggaggaggatctagccgccgccgtcgtcgtcgtcgacgtcgaggcggctcctcactacacgtcgttgaaggcggccgaggccgacgtcgtcccgagaggagtcggcggcggcggcggcggtggcgaaggggacggtggcgaggaggtgaactacatggcccgcgcgcagtggctccgcgccgcggtcctcggcgccaacgacgggctcgtctccgtggcgtccctcatgatcggcatcggcgccgtgaacgaaaacaacaaggccatgctcgtgtccgggctggccgggctcgtggccggcgcgtgcagcatggccatcggcgagttcgtgtccgtgtacgcgcagtacgacatcgaggtgacgcagatcgagcgcgacggcgacatcgacggcgccgatgccgcggccgcgagggagaaactgccgagcccgacgcaggccgcgttcgcgtcggcgctggcgttcgcgatcggcggcctcctgccgttgctgacgagcgggttcatcaagccgtggggccccagggtcggcgtcgtgtgcgccgcgagcagcgtcgggctggccggcttcggcgccgcgggcgggtacctcggcggcgccaacatggtgaggtccggcactagggtcctcctcggcggctggctcgccatgctcatcacctacgccgtgctccggctgttcgcgacgatctttcacggcatgaacatctcgtcgtcggcgtgatgatgcgtgtgacgcagaaatcgatctatctggagatgaaaaagaaaataatcaaggggttgtgctagctagctgtttaattaactactcttggtttgccagtagtactgtacctagtggctgattattaactagcgaatccctggataccgaactgggaataatcagggggtgtaagtgtaatggttgttgtgaatttgtgatgaggcaagaccaggcaaatggtctcaaatgagaatattggtgttaattattgtataccgattcccttctcactttgcctcccgtttgtttttgatttgtctgtgtctctgtgacagttcagaaactagctgatgctcttggttgcgaatatccaggtgtgccactggcacgttgaattgtttttggttgattggccagcaaatgccaaagaatgcgttgaaggtgcagccgggattgccaatggtcaaaggaacttgtaccaatggaaaagaacagtttagaacacagaaaacaagaacagtgcacagattgtcatatgccccctcagagagtccagtaaaaggcccagttcatcttgggcctatttatgccacgaaagcccatcttcataaggaatataggccttcttcttccacactaaagttcagatttctttatatagaattaaagttacagacttgcgaaacttacactacagaaaattacttttgaggtgtaaaaaaacaagcactcgaccgatccaacgaaaatatctggtgatcacagatctgatgatctgttagcctcgagatattctgcacctgatttctcgatcttatagcatagaaaattatcaatccagtgacccggttgcacaaatggaaggtagaataatataagaaaaaggacgatacagctggaacgttgacaaaagaaagataaacacggttgctttcactacaaattaaaatggtataatactactccactaccaataaaagttccgctacaaccgtacgcaatattcagatcttagcaaattgaactggagagcatttctcaaagaagaaaaccaaaaagcctaactgaaagtctgaaattcaactggaatggatctctcgacgaaagatttcattttcttttggagtcctgaaagccaaaagagagaggccgctggttttgcgagccatgagcccatgaaggctacgcttcccacgggatcgtctgattcgtctccctcctctcgtcggttcttcccaacctctcccaacttctttttctggattcttgtggccgccacgcgccaccgcggtttttgtaccaactggggtacgaacgagagacgacctcgcgcgcgcggcgcgaaagtcgcatgtgccaacggcatcgtgccggcctcttccaccggatccctctttttctctatctctcgtggcggccacacgcctcttgctaatttaagccccccaacttgcacgtcggattcgtcgcgatcccccggacagatcgcgttgtcgcatggcggccacgcgcccaccgggtagtttattcccatcgcgacgaatatttcggccatgtttccatctcggagcacgtaatccgggatgctttaggtgaactgctccacgcctccacgtaccaactaccacgccaacgccaaagccaacgccaaagctcaccgtggtgtgtggtggccctttcttgatgaaagtcgtctgctccctgtacagcagataataatatgctcgcggttttggcgcgccttatgtttaaaaagttttatctttgaagaacagataataatatgtttgaggtcgtggctggcgtgaggtttatggaaacattatgtttactcttggtcggcttatttttatatataagttgggacagctggattcttatgatatatctagattagtcgtcggtttgcttgttacatgtataatagtttaaggctcgtgagtcgtgatgtcctcgagcttagctcatgtgggcgtggctaaggctccaaatgagctaggatgagcatatatatgcaaaagttcatgagcttggttgtgtgatgcaaataaactataagattaggtacaaaactagtatttatctgcataataaaatagtatgtaggagtgtaaaatatctttcatagcatttttcttgtttgctaattttaaaatttaaattgtggttttcctcctttttatcatggattttttttctattggatacagatattatctcattaacaagctttcagccaagctcagatttcaaatatgttgagcttgagcttgcttggaagcttgaagttcatagtaggcttggcttaagttttgcgctgagcttgatcctaacaattgggctcactcaagctcggctcgttaacaacattcatcacatgaccaggcattataaatatataatagtttcaatcttttcttgacgtccataacacggtagttttctttactccaagttgagttaaaattattcctttaagttctttaggattaatcagggagatggattctaatagctcgagtggatgtccatccgtttattgcatgtcaactaaatggctatggaaaattttcaaaaaaaattggcaagatagatcaatatgtaatatatcactctacaaacatgcaagttaaaattcaacttctacaagttgtaacaaaaataacaaatttaactgtaaatatacatatagtaatttgagttttgattgttatttttgttacaatctgtagaagttgaattttaacttgcatgtttgtggattgatatattacatattgatctatcttattcatatttttttaatttttttcataaccatttagatgacatgcaataaacgggtggacatccactcgagctgttaaaatagtttcccgattaataagtggtgaagtgaatgtaactcaacttgttttgttccttatggtggaacccattacccacccaagttcaagtcctaaacttgacacaggtgtttgtatttacggctaattattctttcagtgataggcgatacacccatcaacagcgagatgtccgtggtaattttatcaattttaagatatagcaatccactttttggatgtgcttataggggtaggatgtacgtgtgtgtgcgcattcatagggataagggtgcgagcgttgtgagcgactgcgttgtattgtatttctttaaaaaaaatccttactaagtgggtgttgcaaaatgtggaattagtgattttctggaaaatgaatgtggccttacagactttgtggctagctcattcaaccatccacgattccaccgtgtgcaagagttatttattttgtcagaaaggtaagagcaagctgttgaactttcggttggacgctctgaagtctgaactggtcagtgcgtgctggaatagccatacggtgcaatgctccgggtggacttctagtctaccccaataaaatggactaaactgggcatatgaagaaagagttggacaaacataactgaaagagagttggggttatgtacgtatgcaaaactgtgttctgctgcctgctggtgtggatatttcgccaattggatacgaggcttgctacagatcaagctgatctttttccctattcatagacatggatgtgcaaaagcattgtcactaattactgttctggcttggatatcaagatattgtatgtcttgatattacagaatccgtatggttttttttttaagaaatggcaggagctctgccaatcaaataaaatgaggataagagagtaccaaggccggcccctttagatcacaccagtatatgttcatttacagttgttatccagaagccataggaatcagataagggattgttgtcaatatgcagaattgctaaattaagaatgtaataagaattggagcgctaactgtatattactcttagctttatccaaagaatactggatgtattgtaccatctaataccccctaaacaacacccatatgcataactaaaaaccagaaaacaacaaccacttggatatctttgcaatcttttgtgcttcttgcgggggaattaatgggcctgtaatatcataaaccatattttatttctgagagtacataatattattatccatgacaatggcgcttgtaagttcattaatatccattacataaaaacaaaagggtaagttcaagtggaataatctctccaactgtaacacaaagaaaaagagagatactcctagatgagttttcagttcaggctatttgattccctctgtcttccttgtgctcacacacctagtactacacgatgcaatgctcttttacaacaaatattcttgtggttgccacgtgcctcgccagtaatttagaggctaagattctagctatgcatcgaaccattcaagccttcccgtgtcagccacgcgctcgggattaatataatgctaatatgtccatcacatgagctggatacatctaacttggccatcctccttttagcacccatttgcactaattagtccatccttgacttggaaaatttgtggtctttccatagccaaatgacaaagaggtgacaaaggattaggtgagagtttacctagcttgtgccatgattataaatagctatgagcccctagatatgttctgcccataccattaccatagacgcaggtctttctcaggaagtgaagagagcagcagagttgcatatcttgcagggtttatcaggtaagctctatataggtggcttcttctcttctgagctcttcatttttatttgattttccttttgctagtgtcatttttctgcttctagaaaatggagaatactcatgaatgtcattctgctcctgtttcaatacaagtccttgacctgttctctaactaataaggagctaggaagctttgatctgcagaagattttccggcactatacggcatgttgttgatcatctgacaatgttgccacaatttcatgaagttctctctgtaacctttgtttctttcccaatctaacaaaatctcggccggcaatcttcagtcagcccggcgaaaacacgattccatagagtttatcttgcggttgaatttccaaaactgaagaatttaatgccgatctttcagatatgatcagtatttcaaccatcggtatatgaaatcagaatgcgctaatcatcagtataagctgaaatggaaccaataatgcatcttactcatgtgcatttccttgtctgttataaaagttatgccctttacagctttactaatgtctaatgcatgaaatagcagaaattttctaacacctggtgctactgtaatgcagtttgcggcgtaaaaggagcagtgtgtagcaattaactgaaactcaaatcgtcgaccgctaattaactgaggtattcagacaaagaataacaggcatcatgcaacggtggacgcgcaacgggatgctgaacttctcgcagccggcgtcgtcgtcgccgttcggattctacgacgccggccacggggcgtcgagcagcggcggcagccggtcgcacggctgcaggagccagaacaaggaccagcgcaacctggagaagaacctgaccaaggtgaggaaggagtggatgaaggtgaaggaggagatgggctacgcgaggctcctcagcgagcacctcagcgagacggtgacggagaccgaccggaaggtggctgccatgctcgaggagctcgaccggacggacaagtacatgcaggatatactgtcgtcccagcagaaatagtagtgacccatgacatcagatattcagatgcgtattttgatggatttctatgtatttacctagcagctagctagatcgtcagcttcttttctgggcatttttgccattgtggtattcggttttttagcagatcgatgtcccggtacagggtatatataaatcatatgttaccgatatgttctgaaatgtcgttaaaattcttcagcttcgcctccctctatacatgccacttccttggttagttggtttgcttgatgagtcatctcatccgattacccattacgtaagataaaagctagcagcatatatatgccattaatctgcacaaggagcaagtatttgaaacgcaggaatttttccggccagttcttctgaaaaaacaaaacaaatatatatagctaggttcttgtaaaaaatatttataaaaaaaaactgaagttattgcgtttcaaagagaacgaggtaaccatcgcgttggatcaagttcctcatgtattttcggagcgattagctttcattagatttaatggcacgcattgtgcgtgctgatcgaacagtacaacctgtactacacacacagtactacgtggtagcagtacaagaggactctataagtggaagcatggcaaaggcgacggactaactttgacccgaccaacaaatccccaattagcaaacaagggaaacgttagccctttctcttcttctctttaccgtgcaagctaagtccaggaaagtgaaagctcagggtgtcgattacatcatagctgacgatttctggggggtggtacgtagtagctagctactcctagctggctacccctctctcctagcaaaaggcaaatttatctactccgtatgtacaattgtcaaacgtacgaggagacagcaaaaatatatatattgtgtgtatgagtgcgtgtcgccattagtctaatgggtgcgacttgattagtgattacccacttgggaaggcctcccctgcattatgccattaacaaaatcaactcgacgacgtcaaaaccaggcgactcaccccggcctaggacggagacgatacggtgggcgccgtgcctgacctgacgcgcctcgttccctctcccgccgtattcaaatgcaaatggcagcacgggctgggctccatgtacatgtgatgtgagcatagtttattttttgatgctccctccttgttgatgcagagataatgagtatctcgtgcgtgtttctccggaaaggtaatttaatcccgatttggccttggatgggccagagatccacgtacttggatgttggctcccgctttattttcttttcctttttaaacactaattacgtttttttttgagaagggttttaaacactaattacgtaagctggaccccgggtgtttctttcagaagtaagctgggccaggtgtgcttagtctctggcaggtcaggtccatctctaccccagcacacgcttgctgttggcacggacggcccaaaatgctgtaactctactcccgggacaaaagcccccaaaacatcgaaatgggctgagaagcccatttttccaatccgacgagtgacaccacatctgacttctgaggaataagttcactttagatcccttaatttgtcgtctagtctgaaattcatccctggatcgtaaaaccaaatatgacgcgtccctcaactagcaaaatcagtgcaaataagatcccaaggtggtttggacgacgatttcagttgacgtgacgcatacatagctggtttgacttggtctttgtcctacatggcggtgatgtggcattggaagcaaaatataaatttcatttttataaaaaatgtgaggcccacatgtcattgggtcccatcctcctctcaatctccatggacggcggcgccgaacatgggcaacgcccgctcatccccgacaagtagaggatagcggcggtggcatcctgccccacccccaccacgaggggaggagcggcaggacgagggatcacctggcgacgtggaggcggtggtggcatcgatgaggagggcacaaaatctgctggtcgtcgtccgccttgacctcgccgaacgtgccatccccattcaacctccctgcacccctcgtgtcgtcctcgacctccacttccttcccccgcccgctctcgagcaatctcggtgggctgaccagatcaaaggcaacagtggtggtgagttggggtccgtagcggtaacatcagcgaggagggagtggtggttgagggggagacaatcatcgtccgcttcagcctcgctgaccgctctatccttagctagcctccccgcactctttccctcccccctggcgtcatcctcgacctccacttccctcacctgctcgttctcaagcagtctcggtgggcggaccagatcaagacggcggtggctgcgagttaggggcagcgatggtgacatcgacattgacgaggagggagtggtggaggggggagacaggcaaagaggttggggacaagggagagagattggtcggagggaagggtcaaggaagggtggaggctagcggcagaacacgtggcgtcgtctcgtcgatccgggaagcggcgacgacgacgcccatggcgagttccattgattatgaccaaaggagcaaggtctccatctcctccctttcaacccacggtgataagaggagaggggagaagaaggcgccgccgtccatggagaagaggagggtgagacccactgacatgtgggttccgctattctgttttaaatgccacgttaccgttacgtaggacgaggatcaagtcaaactagtcacgcaggtgccacgttcgtcgaaactgccatccaaaccaccgagacaaatgaatggatctaaagtaaacttattccgacttttaagcatcgttcatggtagactatttcacgtctaaaaataatcataagagagcgatatataaaccggtttgctgctgcgaattcagttgccaaaatcaaaagggaaaattgtaaccatcacgagagattctgaaacatggatcttgtggtgctgcagcctcagcatgcagatgtacgttgtcaaccggacggtatctcaaccggtataatctgtatattcttgccgtgagcgtcacccgttaaaagttcccatcgaactgagatacgtggcttctccggtatctaccaggcttaatttctctcgcttcaggtagagctgccaactacgtggcctgatagcaggccatcaaaatgtcggacgaatgcatccggtggcacgcgtacgccgtaaaaaaagtggcaactatagtagtactattttgccaagcgaaaacacgcgaaattgggtgaaaaagaccgagaaactggcagtgggcgcgagtgggtcactggctcactgcgcgcggggcgcggacacgttggacgggtggagccgtgagatgctctgtgtggtgacatccgaagcgtccaaacctgtgtacatgggccatggcccatggggctcgtggtcgaaaatgcagagacgtgtctgctttgcctgcacttttttatgctgctctgttttacttactgctccatcgctgctgattacctgtgcgtgaattgcagtacaacatgtcagtttacaatcgagttgtattctcatagtttcatgttttttcttggatataaagacgttctaggatgacatagcattttagtgcagtcataacctcgaaattacaacatacagtactaaattgaggacaagagaaaatattttttttttatttcacagtctggcttggctattggaaatatcatacagtgtcttcactggaataatgttatttcgcataatcattcgaacaggtagccaggtaggactggaaattctggaaagaaaaaaaaagaaaagggaaaaaggagtagttaggcgggcagtctccggaaatgaggcgccaatccaaaacgtgagacgggaaacgatcctcgcagccccgcggctgacattatcctcctcaccatcatcgccaccatccgcagcagcagcagcagcagctcgcgcgcataaagccctccacgacatccgcacgctcccgcggcgcgcgcaggcggcaggctaaggcaaaaggcgaagggagggagagctagagctagcgctcgcggcagaggcaaaggacgagaaaagccggccacctccgcccgccgacagccatggcagcaaccgaggcgccagtgctgcgggccgccgggcccgcgcgccggccggccgtctccgccgggtccgcctcgcgcctcctcctcggccaccgccccttccccgcgccgtcgcccgcctcgtcccgctcccgctacgcctcggcggtggcggctggcgtccgcccgcgcccgcgcccgcgcccgcgcaggccgcgcctatcggtcgtcgccatggccggcaatggtgagcgagccacagtctggcgttacttgctgtgtttgttccagttctttttttttttgaccctggacgtggggatgatggtctgcagtgtaaagtgtgcactgacggtgttcgatgaaatgggccaaaaggattatctttcgttctttctcagagttgaagatgattatcacgcagtattatagaatttaggagtgttctattggatagtgtattagttgatcttttgctactactagttttgcaaaagagaaggttgaggcagcatgctggcgaccgtgcttaggattgttgatgggctgctgctttgttagataaaccattgatgaagttgcttctaactaaagagtaattggtttagaagctcttctggagctcataactactcatggcattgatttctgtaaatggttgttgtagtactagaatatcttcccaatagaacaaactgagaagcaaggaatagagagatgcgaggatatggctccataaacatctaaaatagaatatacacatagctatgtaattaaatgaatgtcctctccatgtttgtgtagttagcaaaaagaatatggtcgatggcattttgctcttacacaatagacttgtatgcatgtaacttatcttgtcgatgcaacatattgaataaatgctttactttcttttaattgctgtcttttacgcatctcctaatgaatattgtgcagaagtgagtttctattttgcagtaaagtttgtcattaagttaattacataagatctggaagccaagtctcttggattccttttcacttttcattttgtagattcacagttttcaaccaaaataaattacattgctttcttcaacctatcgattacattaatattgacatattttacttttgtatacagatcggcaagtgcctttgatggattaccgcaatattggtatcatggcacatatagatgcaggaaagacaacaactacagaacgtgttttgtactacacaggaaggaacttttttaatggtgaggtccacgagggaacagctacgnnnnnnnnnnnnnnnnnnnnnnnnnnnnnnnnnnnnnnnnnnnnnnnnnnnnnnnnnnnnnnnnnnnnnnaacaaacatagannnnnnnnnnnnnnnnnnnnnnnnnnnnnnnnnnnnnntcttgaggttgagcgtgctctcagggtgttggatggagctatatgtctatttgacagtgttgttggggtagaaccacaatctgaaaccgtgtggcgccaagctgataaatatggggttccgagaatatgtttt

SEQ ID NO: 513 - DNA, 583 bp, Oryza sativa
tgatggaaactattgtagagttgtttgatgatgttatgcacacttatctagaaggtggcgaaatagacgaggtgactgtcaagagattgatccaaaagggcccaatatctgccagctttgttcctgttctatgtggttcggcctttaaaacaaagggtgtccaacccctgcttgatgctgttgttgattacttgccatcaccacttggcctaccaccaatgaagggcactgatccagaggaccctgaactgatccttgaaagaaagcctagtgatgatgagccattttctgggttagctttcaagatcatgactgacccatttgtgggatcattgacatttgttcgcatatactctgggaagctggttgctggttcatatgttctcaatgcaaacaaagataagaaggaaagaatcggaaggcttctagagatgcatgcgaacagtaaggaagatataacagttgctgtggcaggtgacatagtagctcttgctggtctcaaagatacaattactggtgaaactcttagtgacccagataagcctgttgtgcttgaacgcatggaatttcctgatcctgtcat

SEQ ID NO: 514 - DNA, 703 bp, Oryza sativa
atagtatcttattttacaaattctcttcaaaagtatatgtctttcatgaagacaacaaaaaaattgtcacatgcaaatttggggcaaaattgaaccgtcccatgatgcaagtgtagtagtgcacaattagccttgctcgtcttcagttcttcacaagtttcaggaccagttccagtttgataccggtgttacctatgatccttcagtaactgatgacgacctggaactatataagtaattccagaatggctaatttgtgttgaattcattgcatggttagtatgaactcgttgtgattaacatgaactgcattgtccagttgtgagctgagacttctgaatcatgtatcaatgttcagatcgagcccaatgttcatcccgttgtacgcaattggcgcatacatccacatttcatcggagctgaggagctgcaggattggacaaaatatgataagtggatcttgttacaggataatggatgatatgaactgaactgtattctgtagatgctcaccttgatctgaagctgcaggaacttcacatagtggactgcctcctcaagcatggtgctgatatcaacctacaagatcaagacaagcattgttcttttagccatttggttcaagaattccatgtcatgtgagtgtaattggtagcacttatgttcagaagcttactttggtgccattgggcacaaggttctg

SEQ ID NO: 515 - DNA, 2636 bp, Oryza sativa
  unsure (1)..(2636): unsure at all n locations
atctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcttgnctcgnctggnctgcanggcaggcggcgcgcgtgcaccacgtacgcgtcgatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcacctcggtacgtgttcaatatgttgcgcatacttaatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctaacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcc

SEQ ID NO: 516 - DNA, 1424 bp, Oryza sativa
gagacggatttaagttggtttttgagtctaataaagtagtcgtgtctaaacatggatattttattggtaaaggttatgagtgcggaggctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctttagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtgggggaaggcattgttgacctcaaatcatgtgttaaacagagttcctaacagaaataaggacaaaacaccatatgagatatgggttggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattg

SEQ ID NO: 517 - DNA, 842 bp, Oryza sativa
  unsure (1)..(842): unsure at all n locations
atagggcgaattcgagctcggtacccaaacaagctcctaagcaatggcatgagaaatttaacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaannnnnnnnnnnnnnnnnnnnnnnnnnnnnnnnnnnnnnnnnnnnnnnnnnnnnnnnnnnnnnnnnn

SEQ ID NO: 518 - DNA, 2285 bp, Oryza sativa
gttaccgtcaaattcgacggatcgtggtctgaccgaagatgttgtgccggtccgaccgcctgatgaacatcggtctgaccgatgtagattgatcggtcgaaccgccgagatcacctaccgctccctgtagcagtcgccggtctgaccaccggtgtgtagccggttagaccgccgagacccgatgaaacacaaatcgaagaactcttaaagtggatgacgactttattgattctctctgtgtttacaaagtgcaccaacagaactccttacaaaaatttcgactaaactcgaaaccctaactcaactatcaactcaattgttctcaaaagcgataccgagaagcctcacgctccctctctatttatacccaaggtaggcagcctaaagccacgaaccaaactcatactagaagtcctaatcaccctaggaaaccctctagtacaagaaacaaactatacataaccaatcataccaaatttggactccttccaaattcgactccgtatctcatacgaacacaatacctccatcgtatgccatatggaatctttatcaaccacgtgcattgaactctagccttagtatcccgcatgatctctgaccaccacggacgtcgtcttatccccaagccgactcccggtccatcaccgcaaatactcttccggcatctcgagtcacctacacatagaacaaacaaagaaaccatattccgagaccaagctatccccaacttaacttattagtagcaaacaacagtattacatacgcatagtatctatctagaagtcataacaatgacacaatcacggatatccaaataaacaacccgaaaccgaaaccgacacatagtcggccggtcagaccgtggactggccggtctgaccgctcgatcaccgccggtctgaccggcatacacagcccggtctgaccggacccaaatccaacagtatcctgtagatcacatgtgaaatccaattatctccaaaaccacttcgcaaataaattccaaatatcaaaaccaataatctccaatgccaattgttcatcacataataataatcaaaaacacatttgattttacaagcagaagaaccttgagcttggaaaccccaatgttcaaaagcttcgtcctttgagtagcatgctagattgttacccatgtataatatgtataatatataatatgtatatagatcctagaaccaaaacgttctctcgacatatatgtatgctagctgggtgcctgtgcgttgcaacaggaacaatataactttttaaagaaattttgcaattgacaaacacttaaattctacaatttgacaatttgcccctagttgcacaggtctccggcaggcatacaatttcaaagcgataagtatacatgttgtaaattaaaattaaaattcctaggtgtaagaaaattatcacccttttgtatcttgagatttattcacatgcaaggcaccagagttcaataagccatgaagatgcttctctcttattttagaagttgtttctaacctggctattaagttcactttgtcactatgctcctaaaatgatcagtcctgaaactattgtttacacttcagcaatgcttatagatgtaggtgattacaactttactttgagtccacaaaatttggcatccatgaaaatctgctctctaattgagctactatattaattgatcatttgcagttggggatataaacttttgcaaagttaattaattacccagaatctgtggggacttaacacataaagttaaccttcggtcatcattgtacaagagacaagacagagtgcatgcattttaaaactcacacagctcatgtaaatatgtatatgcaaagtgacagtagtgaaaagtacatatatgaaattttagagttgcctcccaaagctttgtactcgagttataacaattagtttggtggaaagcaaatattgaatatcatttcgatttttcagcggctactaattctcaagttacagacctacgcttatggctactgttacaggcctattcgaaaatagcatgacaacaaagagaattgggtttttgacatatatttttttttcataaataggcttatccagttctttacaacctaatggttccaaattgcagtccacaatctgaatctattgtaactttctcatttacagagccattgtcatattggcttgcaacaaattggatttcctcatttacagagcatacagaattgattgccaacagaaattcaacactcataagctgaattttttttttaaaaaaa

SEQ ID NO: 519 - DNA, 23326 bp, Oryza sativa
tgaaggggcagtgaagggctgagggacaccaatgtgtgaagggggagattgttgaaggggcggtgaagggttgagggagggacaccaatgtgtgaagggggagattgttgaatagtcccacattggttgtggaagggcaaatgacctaagatgggggagattgttgaagggccggtgaagggttgagggagggacaccaatgtgtgaagggggagattgttgaatagtcccacattggttgtggaagggcaaatgacctaagatataagtgggggagcccctcacctcaatggctaggttttggggtaggaaaagccctttacgatcctacaaaaatgtgcattgttgtgctgttaatctatctctgaatacaacaatagttactccgatgaacaccaaatgatgtcaatcaactataacactatgaattggacaatctaattgcaaagcaaaccataacaatggattaaagactaataataggctccttttggggagcgaattatagaaatcttacaattagaaaataatcatggattaaagactaataataggctcttttggagagcgaattatagaaatcttacaattagaaaataatcagattgtatggaaaacacaaaaatcattcatagatatctacacctaagatacaaccaaacaagcaatcacattttttgaccaaacataatcttcggagaagtcttgtcattgtacactcttgccagacaaccaaatatgtgcaaatcgatgccccttagacggccatatatgcatagcataatcaattgttacgacaggctaaacttgtgcagctgcgccatcacttcctctcaccttgtcaagttgccggagtcggcgttcgctgacaacagcagcatgtatgacttcatcaacgagtcatcctctgctgcttccgttcctagaatggaacgcttcgaatgctgctcttgcatctgaaagcagcagcaaattcagcttttaatttcattcagtggctcttgttgaaatgatgaacacaaaattggcaaattacagcaaacttgcaaaaaaactaataagatttcagtcaagttgttgaacacaagatcgtagccatttttctgaagtatgtgaagggctattcacatgaacaaaataagccttatcccccccatccccccaaagctttcaattcccacacaccccccgaagcattccgggagagtgcagagctatgctatactaaaatcaaggaaaaatctcagtactgttgaccataggcacatgatgagaaaatctagagtaaattatatctgtttttttcagggaagcttacagcttccatgctcaagaatattactgcacaaaaattggaggaaaagatagccaaaagatatgcacggttgatgatgtttgcaagccaatatttatcatgaatatcactgacactggtaaaaatatagaactccagccatttgaaaatatatgcagttactttgttccctatttttaatgtaagcactcctgtgccaaaagaaaaggttgcaagttgtaatcaaaatagtaaaactggtgatcagataaaactttataaatcaccaccaaaagatttgaatctatttcagtaacactacatatgtagcaatggtagctgaatcaagtgatgtctgagctgctgtgcaccttttggtgctctctagtgtgactgtgaggacatgtttagagctatattttttttcaaaggaaaactattcagataatcaagatggatatttttatgtccaaggtgctctctagtatgattggtgctctctgggccaacacagatttgcacatcgcctacatttgcaactcgaggaatattaagtctatgaagtattactgagcatatgggccttaaaaacttaaaagatgatctccaccatataatcagtctatacttggattccttgtcctccaattctaggtaactattccttgaatcttcaatcagagctagcatgtataaaggaccagaataaatctgatgctatccacttcacctcttattatagtcagaactcacaactaaatatcatttagcccctacttttgttttagtagtatataaactattcaagcatacacttcactgattagaactcaaaacaaattaatctgtcatgctatattaacaatttggtctattgtgggaaaaaagtatgacccaggaattgctaatgttgcacatctctatgtttagcaaaaagtaaacataaccattgcactcatcgatggacatcctaaccattctctgtttctcccactgaaacagacagcctttatactggcatataccttttttcatcaatcttgtgcttgttctggtcaaccttcagaattggattgatgaagcttgtcgcagtgagctctcttgtaggcatcaccagtgcagctacctcctgtttcagctgtccaagcagaacaagtggtcatccatgaatgatcaaatcacaacatttcgaaagtaataatttattatcagaattaattagtgatgtgatcttgaggttcaagttatcatccaccagccagcgaagtggcgaacctatttgtctagctcttcaacgtacacctacattgcacgtttttctcaacacacctcccacagggatatataatcactttcaaaatttatctaaattatgcataggtagaaactaacaactgtattagtgagaaataaattgtccaacgcaaaaaaaaaatccaaatattgacccacaaaagccaatggagctaaaattattcctatctcaaccaatacaaattccacaaaaatgataccagcataaatcttgaattatcacttgaatcatttgtcttgcttgatatatatgtttgatggacctgtcgtctgtgccaaaagaattaggtcgttaagaatagtactttcatgtcttctaaaaacttgtaagaatctaacaaccttgtactacctaataacttcaggtttcatcagcattccctctcctccaacagacacatagcacttaaggttgccgtagaaatgagattccatcatatacctctagaggagtcacactcatggagcaatgtattttcccttgcaagaattgcaatcactcaccttctgaccttcagacagcatcgtcactcaccttcagatagcatcatcagttcatcattcaccttctgaccttcctatggcatcataacactggatgtaagaggcatataccaacgaaaacaggggagcaggaaagatgtaacataagacaatgcattgaagacctcatttacacttccacgtaatttctgatatcttgaatttgtgaaaatggcgcgtaattcaaagatataaattaacactcaattgatgcagtgaaattgctaatatagtagtaatggtcatccaatctgagttattaggttgttagagactatttaagcctaatctgataatctctaagtcactcaactaacagggaaaccaactaaaatgctgagaatagtgtaataaacctggaaaggagagttggatctggtactatctttgcttttgctcccattccattataatcaatctgagatttgcatttctcttgccccaaaaattattagtctattgtacgctgagattacctgctccacatccctgatagctctgctctattctaacatcaacactgcccacccccttctgccgtgatagctgtgcccttgggcttgccatggtttcgcgttggcatccttacatcccttgggcttgccatggtctcttagcatccttgcaatcacagttatatctatcacttcagctgaaaacaaatatcacaccgcgcaattagtatacggtataatcaagcacacatgtatgcattatccagtgcttatcatttttcttttctttgtctaacagaaggaggaaaaaacttttgcctaagagaaccatcttcagttaaaatttaagaaacacataagtatagtttagggaaaaaggtccaaatagttatgtcaaacataatatctgaataccactttttcagctcaaaatggaatgaaaatataatccaatgtaagaatatcaaaatgcatgtgttagaaaatacaaattaaaccaaatatttgcaggtaggcagtaaaatatctgtagtatatatttacttacttcaattaaaaatcacagtaaaaaatggatattaaatgacataattttagtagcatccagtgagcagatgttgtcacggagcacatcccataggtttctcctattgggtagacaaagtgaaaagaaattgaggacaatcccgggagatttacaatattagtagtgcaaaacattgtcacatatcgacaagagtactaaagcaatcaaacaaccattttatctaatgaatgttgcaattaggctcaccatgaccctctcaatcagtcaatcttatcaacgcagtaatcattgctctgctccttgcatggtgggcacggccttaggaagcacaacagggaagatctcctagcagccatggttagcggggaaaaaatcataagtatacatattgttaatggtattgaaggcagaaggctggtatgaagcacgaacatatagatgtacaactgggtgattatggaatagggttatatatgcaacctgtgcatctaacatttatgtacaactggatgattaaggaatagggttttggcagtaatacaactggatgattaagtatagtcccacttattccattgaaggcatattcttccaatcaatttaggtagtataaagtgtagcgcctcatgattagtaaagaattcagtcatgacaaaactatagtaataagcagaagctttgattatattgatgaataagcagaactaaacagatagagaaataaaccctgcaacaacaggcactagaagaaatttatagacatcacacggttatgcatcttcagagagcacccaggctgaatatggcatcctccctcttatcctgactcaagtatttgcagacacattagtgaaaaataattaataaaacgtgaacaaaatttcatcaaacactattaggcaaaatgaaatcgttatatcaacaatccttaaaccacacaccaaaatacttcctctccgttggtggcggtgtgagcagaccccagctatccttcctctccgtcgcggcgcgagcagggaggcagagcggctctggcgggaggcgagcggctccggcgggaagcggcatgcatgcaggaggatcgctttttgcggcagcgcagtggatgagtggatgacgggggagcgacgacggcgtggtggggaaggcgaggacggcggaggggcggcacgatgtgcggacttgccaaggaaaaggggcaacggttctttttctacgccaagggaaggatcgcgcgtgggcgtggaaggatcgcaagatgaatctcatccattgattgttgcggatctaatggtcagaaataatagttgtagaaatcacgacccccattacgatcgtttttatttaattatattatattatagtaggacgtgactatatatatatatatatatatatatatatatatatatatatatatatatatatatatatatatagctactaatggtagctggtttgtctaaaccaactaccactctatctatgagagactctatccacctatactttaaataaaattttctcttaaactactcatccgatctacgatccgattacaccatcatgttcgtaaaaattaaatctttataacagaatctcacatgattatattttgatgaaaaataataaattacttttataatatatctaaattacttttagatttcactaaattacttcttagacatataaaagtaaattcaataaagcctaaaagtaatttagatatattatagaagtaacttataacgaaaaaaaaagtaactttaatgcatgccttttttcattgatccaaaagttacttctaattaacattgaagatttatagagagttacttctgaaccatgcaaaaattacttccaattaacattgaagttacttttaaaaattgttaaacttacgtgtgttgatctgtgctgattaaatttaatttctagataaagtcatatttttatccctacaacgaatttacttctaatgttgtgacaaagttactttagttttgtttaaagatactttataatatatgtaaattacttttagactttattgaatttacttttatatatctaagaagtaatttagtcaaatttaaaagtaacttatatatatgataaaagtaacttacgtatataataaaagtaatttgcaaatataaatatttttcatcgtaatataatcatgtaagatcttgttgtgaagatttaattgtaacgaatacaatggtgtaatcggattgtagattggataagtaatttgagaaaactttataagaaggaagaaaaagacatgcatgtctaagaggaaaaaaagcatgcacgtgtagtagtacttattctcacaaccggttggtcgctagtttacactaaactaagaggcttctcggtttagattttgccattacaatagtagtatagtataagtagagagtagagaatatgctgtgtgttggaaacagatttatgtatgtatatgctgggccgcaaatgtgccatgtatgacggataacgacctgaccaaacttttcttttcaatactcccttcgtttcatattataagtcgttttactttttttcttaatcaaagttctttagatttgaccaagtttaaaaaaaatagtatctacaatacaaaattagtttcattaaattcaatattaaatataatttgataatatgtttgttttgtattgaaaatgataatatatttttttataaagttggtcaaacttaaaaagtttgaagttaggaaaaaaaagcaaatgacttacatagtataaaacagaagaagtatataataagacttatatagtataaaacagaagaagtatataataagatctactgggatcatccccgaaaaaaaaaagatctactgggatcatagtagaaaaaaccggaaccagctccctgaccggctcggttccctcaaaggatcgcatggctcggttccctcaaaggatcgctcacacaatcgacccggtgtgaaccggctgcggttttcgagcaaagctagttgggccacttgatagcatctttcttatgagcccaacttgatttttatgggagaaaaaatggtgcagggatgagattcgacccaggctgctaggatagatgcaaaccttgccaaccgctaggctaagttatactataacttagccgctgtgactggaaggcaacacaaaatatagggaataaaccgcggttcatccagtgacccaactgttggaccgatagaccggtgaagccagcactccaccgggacaacccggctttttctactatgactgggatacggtggaatagctccacactccgttcttgagccagcctagttcgtttctagatggtttttttttctatctcggcattttttttactggtgtaggttttctagatgaacctgcaagctgcaaatctctttttgctggacaactaaaattctgttgcaatattcacggctgtcaggcgatcatatgcattaaaagtcatcaatcggcagatgcacaacctgtcaccttcccgttggaagaaaatagttacacataaggacttggtcatatcaattactcctatatctcatttgactgatttctataaattaattaaaatgtcttcgtttcctttgccgagtttgctggatttgtttgagtcgatcaatctgctcatttggattttgatatttcgtggccatcatctgtacattttttttcttcgatggggagaaatatatgattccaggttctatttgtcagtttaaatataaaatgattttgcataagagatgacagcacaaagagttttaagaacaacaaacgaagaaaaagactaggcttccaatcttcttgtaaggttccagccatacacggagaagaactccaacacacgcttctccagcagtttgctgctctcaactatttcttcatcgcctcccttaagaagcaaagatcaagtcattgcccaatgcgttcctatgaaaatgacctgcaagaaagatgtaggattggagcaattaaagaccacatcattgctatataaccaaattgcctaaagaaatgcagctatgcccacaaacaatattctcttgagcctggttcaacacaattcagccaattcccaaacatttgagacatgctacacagttgcctaatctcaaatgtaaaaaggagcgcactccaaatatacctagccattgagcaatcaaacaaaaggtgttatattgttacctttgagttacaaaaacaacttagactacccttccaccttctctttgctagattatccttagtgagaattaccccttccttaaggtaccacaagaaaattttgattttaagtggaatcttgagcttccaaatgaaattcttcttaggaaccaccccttcatacatgagcaacttgtacatagattttactgtggaaaggccatctttattgtttttccaaaagaagcgatctttctaatctgtcaaaacagtattaacaaccttcgacactagcttaataccttcgacactagctcataccaggcttcaagtttcttcccagtattgatcttctgaaagacacatttaacgggattctactcattaccttggccactacctcatttttatttctaactagattgtaaaggttaggatacttcttctcaaaggattatttaaggatgtccgcactatttaaggaataaggatgcacattatggatttgctccaacggtgccattgacatgtggacaagcatactaaatatggggaatgtagttgacaatgtaggcattagaatagctttaaaatgaaaaaaaaaacctcttagataatccctccaatccacccttcagcatgaagaaattcaacaatcttcaatccagcaagcatcttgctcaagtgagccttcgtttctctcttttgagattccaccccttgtttcgctttctgcttgagtttgttttgtacaaaactgcataaaaagaagcaaagtcagagggggtatacaaccaactcccaggttcaggaaaagaaggaaacaaagacaacttattcgattcagccttggatccattcagttgcgttgccctctcttgattttccttctgcgtcatttctgtgttgcagactgcaccggaatattaaaaagaagctaagtcacatgcaatgcaatctcactccaagccagatgtttgatgaaaacaaaacaacgaacacacagaaaatagggaaaccctgtattttattaatcacgattcattaacatgaatgtttacaaatacatgagggctcccacaggagttcgccttttgccttcgcgaggaatacttaatggaaaggtatgctgactggagattgcgtgtagtccgctgattcccggcgcctagcaatgaggcggccggttaattacatccacaggaaagagcctatggaacacctccgattaagctgcgcttgtgatcgtcgtcttcaaaattgattgctcgccgaaggttgaagttggtgcagagatttaatgataactgtgatataggtggctttgttttgccgaaacctgttcacaatatattatcaccatgtccatacatgagtcaggtatcataacaaaggggatgacttttgcctcgtcggtgcccagtcatatatgccagcttttattagatgtggatatatcgttacttttgcctcgtcggaacctagtaacatgtatccgttcctatctgtttggacatgttaataatatcgtgacaccgacctcataaatactcggccataatttttaacttccaaagatcacgaatagctcccatgtgtgtgcatggtatcaaaatatattttgtaaaacatcggttagattgtccaatcaccaatgaaagttggacatatctagcgccgttgttatcggtatcatagtaacaaatagatgatccaatctccaatgagggccggacatctaattttgagcatagaaaatatatcaaatagtgttcggataatccgatcgccaatgaggaccgaaccagccttataccatcgattgtataaatggagtttgatgataaccgtgcttcggctctcattgatctggctttaatcatcaagatcaagatagattaaaaacgcgcagatgttccgatcgccaataaggaccgaacatctattgtgtttaatctagaaaattaatatttattcaatgtgctcaccatccagcgcaaatatcctgaatggcggcatgttgtcgataaatgactcgacttgatgaaggacgccggctgcggtgtttaattctctccgcagcggcgccggtttgctatcaccggccggcttcaatctcctctcctgattttcctaatctactgagaagaatgggatgaatgaaaatgggcagatgggtgtctcctgtggcgtcctcggcgtcccccgctctagatgggttctgcttcttatataggcagcggcgacggaagcggcctccgaatttccagcgccctgtgctaatcttcgtgataagccgacgcagagacgagccaatccgtcaacgtgtactgcagtctggagataattatgtgattaacatgtctaatgacagtgggccccatatgtttaatcgccacagccaatgaccatgcatgctcacgtagtaacgatagcacttcttatttcttttgttttaatagttccaatcttttgaatcgtatatcggatttaaaatccatttgaaccatcactttctattcaattatacaacaaaacgagtccaatatcgaatatattcggacaccataatatttaaaatttctagacccacatgtcatatagacacgtctcgtatatattcagtaaaattgtgctacaaataatattctcatataaaattaaatgcccaataatttattatttcttctatgaatttttagcacaaaaattcatcaaacaaatgccccccaccgagtgtagtttgtacgcgaagcaggacagacttcactcggtgaaatactcagtagtatattgttacgaaggattaatccatctccgtgtggtacatggcttgattcacaagctggctgccaatcggcaaatgacgtgcatgatctgatatatattgaagccgagttcatgtatcatacgggctcatggccgtatgtcctatatatataaataaagtctgtacagcttcttaatcgagtaattaaaacagagctcatgttagatcgttaaaatcttcgatcagagctactgcaaattaacggtgatcgactggggaaagcagtcgatcgaatttctttgctactgttcaagacaagaaaatgcagaaggctagtgatcgtgccgatcataccagcgtgtgcaaccccacttatacttggcaggagatcccagatgacccaccattgcctggccatgatagtgatgaaggtatcaaggaaacttcccagcaagggaggggccttggcatgcaaaaatctcacggcgaaaagatcataataaaaaaaagggacagaagttaggttctgaatcgttaaactcttccgtgaattgatccatcttataagtgcctcttttttttaaaaggggaacccctatgttgaggcgtcctcaatctacacattatacagtggactagccaagaaggcgccaagagaagataatggcgagatgtttctttggtgtgatgacttcaaatttttctatcacattgaccagcaaaatatctcacccgaagatgtaacggcaatcgggacagcgaagaagtggatgtggttgtctaaagtagcctcttgtttgaacatcaaacagggccaccgacttattttttcatgtggatcatcacagcttcctcacagggaaacataacatatctatcataccgcaacatatgttgatttttccggcggaggatcaaacacgccgtgtgatactatctgcaccatgcccccaactcaacctactagtaagcttcttgatgacgaccagatggagtttctaacaaggcagtgggccccgaagccactagtaagcattgtaatggggataattctgtcatgcgggcaggagaaaccactctgcaaggtacaactggtttctttcattttatacttctctgtccactctgttttccttttttttatgtaatcaatttcacacactacccttcttctcatgtgctccagctaggattcaacacttgttcagtgaatccaagaagttgtctatcaatgttgagcatataatcgcccaagtttcacaagcggtgaacatgaactgtggcgcagaggaaaactccctgctcaaagaatttgatgggaacaaccccgtgaccctgccgaaactttcagatgttgtttcagcccgtggtcttaaacatgtctggtctgagatcaaagcgtttcaagaattactcaagcaacgcccggtacagagagatattatacttaaagagataagcatcaacctggatctgtggagtaacttcttctcaaagccacctcctgaaataattaggctaatggaagggttacgcgtgcttaagggagcgctatcggaggaagcgccactgccaactactaatcttgttctcgcacaacaggaccagattaaccaacacgtcgatctgctccgcactgctcaagacaaggtggagtcatcgtgtgtcgctttggaggcactgacgagtcaatataatgtagagcaagcagtagaggagggcaacaagagagagtgctcacgacaagcacggaaagttagagcagagatagcagtgttgcaagcaagacttcaacaagtggaagatgcccactccagtgcacaacaccgacaagatgttgtaacagagaacttgaactcccatctcgagcgacatcgtcaagaaaatgagcgaaagtatggcaatgtcttggcagcagcctgtagccgggttggttgctcttcttcaatctgaaagcgggaagtagtcatctcccaccctcagcaaaagtaatggcaatttcatagcctattgacccaaaccacctttgaaatatagccttatcctatcctccttcctgggataaaggtaaaaaatatgaggcacataattgaaggaaaactcagaaaagacccctttgttttcaagagatcctgatgaaacgtgagctcattatcacaagttacacgagggagttgaagcattaagcgagatcccgtcgttattcagaaattgagggcatattacatcctccagcagtttgccattcgttacctcatagcttggcgaccggaagaaaagccaacacacaaaaaaaaatcccacatattttttttctctctcctccttggaaacaagacaactcatttattgtttccccgagtcgagtccctgttgctttgcacatgaactctactcggcgggggcatccgtctcatatgctaataatatttgaagcctgaatttacaagatgtgtgtgaagaaggcctttatgacgcgtggcaaaaaaaacacgtggcaaaagaaaagaaggatgacaacgtctatgatttccggacggaaattattcctactaagtttactgtggtgttcttattacagtgatatgattacttaatatatggttggatcataccaatgtccatgattttcggacgacaattaatattataagttgtacagtgtaatgtgctttctacagtgattttattatttaattgggtttcacccgtgtccaagattttcggacgacgattaattccaacaattctgcactgtaacgaatttttctacagtgatcttattatttcatgaacaattggattatgccaacgtctatgattttcggacggcaattaatcctatcaagtttatactgggacgcgttctcacagtggcccagtcaattacgtacagttgcactgaaccagcatctatgattttcggatgatggtcagtcaatatttgggagcagtaaagcatgccagtacggtcaatgcaggactgtgaaacccttcgagtttagacgcctagtaccgtaaccattttaacggtcgcgtctagcttgattaattttctattggttggcaccgatttattttggtcgcaatagaattttataagatggtatgattacttcgccatataatcatcagtgtgtggcacgaatttttcgctacgttttcttccttaaatttttttttgttctcacgccgcggcatgattcttcgccacaaggaattttatgtcatagcatgaatcttcgctatggtatatttatcgacatttgcattgttgcatgaatttcgctataatttctatagcggggaggctggtcttttaaaagccagtaaaaaaaattgaataaaaaaaatctatggctgaaccagaatcgtgaagaattagtggcgttactgttactgctacagtagtaaagccactaaaaaatctgaacgtgagcatcttttatgtgaggaaatgtatatatataaagaaaaaaaaggaagaagccagtgcacaaagacggttggtaacaatgcaacgctcctattaaatttgaaggagttcactccgttgttctggtgcaaatcaaagtatataatagcaaataaaggagttcactctgttatatcagaaacaaataaaatatctgaagagctattacaagcctgaaacaagattttaaaacagcgtctactcatctaatgagcagcctatgaaaaaatcaaatatattgtagacatattgggacagaccaaactcgtctggcttagtaaagtcttcaatattttggagagacttttggtgtacgctcgcctgctctaactgtgccgcaatctcatatcctcgatccttagcttgtcgatgtcgctcaagatgggagttcaagttctctattacaacatcttggtggcattgagcacgggaataatcatcttccacctgttgaagttttgcttgcaacattgctatctctgctttgattttctgggcttgtcgagagcactccctcttattgccttcttctacagcccgttctacgttatattgactcgttagtgctgccaaagcgacgcacgatgactccaccttgtcttgagcagtgcggagcatatcaatatgatggtcaatcttagtggttggcagtggcgcttcctctgatagcgctcccttttgcacacgtaacccttccattagcctaattatttcaggaggtggttttgagaagaagttactccacaaatccagattgatgcttatctctttaagcacaatatccttctgtatcgggcgttgtttgagtaattcttgaaacgctttgatctcagaccagacatgtttaagaccacgagctgaaacatcatctgaaagtttcggcagggtcaccgagttgttcccatgaaatcccttgaactaggagttttcccctgcaccagggtctacgttcggtgcctttagaatttgtgcgacgatttgctcaacatccatagataacttcttggattcattggacaactcttcaactccagtcagtgaagctgaaacacataagaaggaagggagtgcatgaaattggttatttgtataaaaaaaggaacaaacagaaatgtctataaaataaaataaatgagttgtaccgtgatgagaggtgcccccttttactgtatcagcacaagcctcggtacgcgtctcgtcgtcctctaggagatgcgaattaacgttgtccttttgagtagcacccggaaaaatgggcgaatctaaacagagactggtttcagggtttgcccctccatccaaaagagtggctagatcagaaaaatcgcctgtaagaagatctgtgggcagagtgcctatatcatcatgtggaatagccaacccttcactgtaggggtcgatatgcgtcatggctgacgagttgagtacagtctcatttcgaggaggtaacactaataactcctgttgtgaggcttgggcagacacatgagttgtgacattgtctgggttggcaatgcatgttctgattttcttgatgtcttttccagaccggtcgggtcctaccctcacaatctctgtagggttcgcactcgaggcgggtaatggcaacgttgtcttgatctcggtttgagcgctctcctcctggtgctcaggagagatcgagacagacttggctgttctttgcttaggtgtgcccaccctacctcctgaacctcctaaaaaaaagaagggggacgaaaataaattagaggaaacagtaaccaatgaccattcatattgataacagagtatatatttttctttaaaaaaaatttggtaaactgcatgcctgatgtttctgccccgggtgcatttttcgtagttgcagctttggtggagtgttttgaccgtgaacagaataggctcggatgctttagaaaattgaaagcttgagagcacccgttgatgtaatcaagtgaacgtatggtgtcccgggcgaaaggttgaataaatattgagtgacccctcggcctatgaaaagctaggtggcgccgttgcaaaagttgcagcgattcatccctagaattgccatttaggtaacttggaaaatcaaggctacgtgtcctgttaatggtgatcataaggaaattggggacatgctggtcatagttgaacatgcgagcgaatcgatgaggacagtaaaccaaattgtcaaaaacttcacctctcctataggtgacgccgccaacagtgcagctgaccaagaaatccacggctgccatggaaattgccctgtgtgccttgggagaacggtcatcaaataactcgacctcctggtcggatgtgggaaaacggatgctggaccgtcccaagaagtccagtgaacgtaaagccgttccagcatcattaaaatcccaaaataagctatgtgcgctcttaatatccatagactcatagtctctgaagtctataataaagggcgggttcatcaccgggcaagataaagttgccgacgtaggaaccctctccaaaaagatgcaaaccagcccataataaaatggcctggcacaaatgaagaacagtcactcgcagaagcctgacgtgcagctacttggtggtagacattgtccagggcacgatataaaaatgccatgcttgtaacaccaatggcccagcggctgccttgagcgatttccattgccatagtaaaaacctcggggcgaataaagttgccttcctccactggaacgcaatatgtgcataaccatgcggcgataaaagctgcccggtacaccaccaatgggtaggtgtgtacgtaagtcatttcgagaccacacatgatagcagtgggtcggccattccgaatctcaacacgaaaatttgggccctcatataaaggtttttttggatcagcaaaaccattgggtaaaaatgactgaaaaggcacagggtggtcgccgaagaagtgattgacccatgtcgcgatggttactattccaggaccctcatttagttgtaggggacactcctcaacatatatattgtgcagagtctgcacatgcccacgagctgtggatggtaaagggataaattcttcataaaggcgccctgaaattggtatgcccatggcatcgtacattgtatggagaggataacccatctctccctggctggtgactaaagtgtgtccatccacattccaataagttaaaaaggcggccactaatgaaggatctatcttgcatttataaatagacgccattatgcctcggagtacgccggccttcttgagatatgtacggtcgtacggattcaccattagcatacgagcccatagcattagcttgtcattgggagaaatttctagccttaactgcattggctgatcttccaaccatcgcttggttcttgaggtaatgaacttttgtgccaatgtagcagtatgacgtggcacatcaaaagtcccggagtcattaaataaaaccggcttcaagagacacatgctgccaggcctccctcttggctgtgtccctggttgatcttgatgacctacaaggacatccttgcaattggcaagtaatttttgaaatggtgtcgggacacggaatgctgcccagtcacgactctgcgtgagcgacatccactctgcttcacgtataagttgttgaccccacttaatattcaaacatgaagcaacctgactcatgaaatcatctgttttctttgcttcaccattgttggttgattgtgcatcctcgggtaaattaccggttggctctgcatccttaaaaaaatcaaaatcctctcaccacaataacgcttctccgttttcttcttgcggcggtgcttctctttcatacccgctaaataatatgtacattgagattggcattttctgtaagaataaaagagaaataataaaggaagttcaggaagctcatcaagcaagtagtatggtcacgcttatgttttaaaacaataaagtggttcaaggttgatcatacattgtgagcagttgttttaaggtatcctgtgcgcatgtcacgagaaccttctgaactgccagattccatggagtttcgctggtgatcagtaggggcgcattgctcctccgtattaatcaattcaggatcacgatcgtgttgatctccggtgatttgtttctttttggctcgctcgccctgaaacggatttgaacgttttctttgctctctctccccatcttaaagtactatcaaaagtgggaggcaaaaatagctgacaagattattgaaaagtacatgcctgatcgtgagggtttcaaggtattagcaagatatgtaaagcaagaaatagtcaagtagagcaaacctggtctttatcacgtagatcggttcgtttgtcccgactagtgagacgaacaaagattagagaaaattacttcagaatagaaggacgacaaattcgaaaccctaggcaggcgtggctgctgagaatatatatgcccggcgatatggagtccatgccggattaatcactaatcagttttgatacgtctcggacttgttggagatatactggtgatagttaccagcaaaattaatcgtttatggagaggtttatctgaatagatgatttgttcaccgagtattagcctgtcctacttcgcgtacagactatactcggtggggggcatttctttgatgagtttttgtgcaaaaaaattcatataagatataataaattattgggcatttaattttgtacgaaaatattatctgccacccaattttattaaatatatacgagacgtgtctatatgacatatgggcccagaaattttaaatatcacggtgtccgaatatattcgatattggactcgttttgatgtataattcgaatagaaagtaatggttcaaatgaattttaaatccgatgtacgattcaaaagattggagctattaaaagaaaagaaataagcaagtgctatcgttacttgctttgctacgtgaggatcattatctccaatttggaaattgacaggcgattaaacacatgggcccaccgtcattaggcatgttaatcacataattatctccagtacacggcgacgcattggctcgtccctgcatcggtttatcaggaggattagcacggggcgctggaaattcggaggctgtttccgtcaccgctgcctatataaggagcagaacccatctagagcgggggacgccgaggacgccacaggagacacccatctgcccattttcattcatcccattcttcttagtagattaggaaaatcaggagaggagattgaagtcgcctggtgatagcaaaccggtgccgctgccactgcggagaaaattaaacaccgcagccggcgtccttcgtcaagtcgagtcatttatcgacaacatgccgccattcaagatatttgcgctggatggtgagcacattgaataaatattaattttctagattaaacacaatagatgttcggtccttattggcgatcggaacatctgcgtgttcttaatctatcttgatcttgatgattaaagccagatcaatgagagccgaaacacgtttatcatcaaactccatttatacaatcaatggtataaggctggtccggtcctcattggcgatcggattatccgaatactatttgatattttctatgctcaaaattagatgtccgacccttattggagattggatcatctatttgttactatgatgccaataacaacggtgctagatatgtccaactttcattggtgattgaacaatctaagcggtgttttacaaaatatattttgctaccatgcacacgcatgggagctattcatgatctttggaagataaaaattatggccgagcatttacgaggccggagtcacgatattattaacatgtccaaacatataggaacggatacacgttactaggttccaacgaggcaaaagtaacgatatatctatatctaataaaggccggcatatatgactgggcaccgacgaggcaaaagtcatcccctttattatgatacctgattcatgtatggacgtggtgataatatattgtgaccaggtttcggcaaaacaaagccacctatatcacagttatcattaaatttctggacccaacctaaacttcggcgagcaattaattttgaagacgacaatcacaaagcgcatttaatcggaggtggttcataagctcggcctatggatattaattaaccggtagcctcattgctaggcgcggggaatcagcggactgcatgcaatctccagtcagcatacatttccattaagtattcctcgcgaaggcaaaagacgaactcctgtgggagccctgatgtatttgtaaacattcatattaatgaatcgtgattaataaaatacaaggttccctattttttgtgtgttcgttattttgttttcatcaaacaaaatggcacgcccagcggacctgattctcctcccatctatgctacgctacgatggtcgtcgttaaattattcaaatttgctcactaattggatggtgctcattaaaatcatgaaatggcatcaatgtatggatggccggttcaatatatatacacatatgtgggctcgttgtgcttgcgcgcaggcaccatgtagtttgtgcaattaacacgctggcggctggcagtaataatattaatttccggacacctaattaacgatggaagatggccatgatcatagagcctaccatgcaatatgcgataaaaccgatgcttttgtatgcatcgttctctgttaatttttactccgtaataagcactgcagcatgtgcttgatgtgcagccgtgcttatattacttcctccttctgccgttcaaatgcacaaagactgttagtgaattgttgggctcaactcagatgcatgcgcactgcagtccatcagagccattcggcttggttctgagacattaattaatcgagggaggaatgcacctagcacatcccagcatggcatgatcatggctgccaatgtgttgtctcctaatgctcttctctcatctatgctacgcacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcaagttaggacccgtcacaggtgactcatctctgacggcccttgaaataaaggccgtcagaggttgaggtctccgtagttagaagctgtcacaggtgatctacctgtgacggtcccaaaagtaaaggcccgtcacaggtaggtcacctctgacgggcctttatttgctagtccgtcacaggttatgttacctttgacggatttttgttccgacccgtcactgatgagttaattccagaaaaaaataaatgctaaatattggctagcctcaggatttgctagccatgccctctgaaaaatagaaacatcacagatatattctagtcacagatccatcacagatacatcacccccccaatataacatcacagatccccaacaacacatatatgcagttcaaatgccacaattttgcacagcaaattcacaccccttgaaagccacaatttcggtcgttgctcatagaaccacatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtccaaatctttcacctctcttagaagtgttgacatgttgtggcacacgtgaaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaacccgactccacttaggtacgatgactaggagaatccaatgtcgcctgcgcagtggttatgtagcgttagtactaagaaccttaacttcaaaaacaatatacacgaagggtattgtcctcttattcttggttctgtgcgcacatgatgtactccttgtcttgatgggcccataaacaccggttgacatagtcaaccacctcagtgaagctctgtcgtaaattaacctcattcaccatggatggatcaaggaatccaacctgattaccatggcgacgactctcgatccaacacaaccttaaaatatgtacgtattagaactaat

SEQ ID NO: 520 - DNA, 2122 bp, Oryza sativa
cctctcttataacttgcactgtggtcggccatatattttgtgaccgcggatttctactagacctacttgcacttgtcccgcccgacatcgacgtatgttgttcatgcggcaattttgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaacttttgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtatcaacagcatgggtatataaatgaacaagtgtaggggcaaaaaaatgaacaagtgtagataatatgttcttattgagcaattcatcactggccatttaataaggaacacattgggcagcagcagcaagggtatataaatcatcaaagaatgacagaaaacaagtgtatatagtctcctcttatcaatccagaaaaaagagcaagtacagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacaagtagcccacaataacagcagtggcaggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatatttcacatctcaaatatgcatatatttcatcaaaaaaaggagacagtactactaacttcatgtaaacagcaattcatccattcaattcaatcaagtgtagataataaaacagcccacaatcatttatgtggcagcagcagcaagggtatataaatcatgtatataaacaacaattcatgcaattcacctattcatagacaaaaagggtatataaatccacaagtttagataatctgcaaagttccttaatcatcaaagaatgacagaaaacaaaatgcatggagaattttggtgtctaggtcggttccgtccatggactacactgaccaatccaccaaaatttcccatgcattttgtattctgtgatggtttgataacctcggaacaacattaaatctgcggccaatcaatcaattcttccatttgaactaaatttcaaaccctaaacctaataaagttccttaattatcaaagaatcaattcttccattcatgggcatcagagagagaggggtacctggagaggagacgacgagcagaggaggcggcacacggcgacgacgagtcccggtcgagaggaggaggcggcggagaggagatcccggtggcggtgacgacggtc

SEQ ID NO: 521 - DNA, 324 bp, Oryza sativa
tagagcaattttattttattttatttcacttagttcttttattttccttaacatattttcacatacactacatatttttttatacttaattattttatttcactaccagtagtaattgcacttcattattatactactttaattatattatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataa

SEQ ID NO: 522 - DNA, 3555 bp, Oryza sativa
  unsure (1)..(3555): unsure at all n locations
attacaactgtttaaatctttcaacttctgtttataaatgctcgctttatgcaaatgaaccactctagctctcctttgataattccctgcatcatacccctattccggtatgacttgctgagtacagtgggtagtactcagtcttgctctttttttttcccaaccccagagttcgggtatgtgtcagatggagatttctctgaggagtaggcttcgtccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacagcgggagcggtgtcgtcggcgtcgctccgcccgccgcccgccgtcgctccatttcgccccgctgctgctccgcttcctcccgccgtcgctccgtccaccgcccgccgccgcgccgcttcgctccgttgccgcgccgcccaccatcgctccgcttcctcccgccgccaaccgcgcaccgtcggccgccacgccgcttcgctccgtcgccccctcggtgccaccgctcgcccttctctcatggcagtgtagggggagagagaggggggatagagaaaaggaggctgacatgtgggaccacatggccccaccttttttagttattttttgtgtagctgacatatgggtcccactattttaattattttttcgagataaaattgccacgtaatcgccacgtcaatgcccgtgggacgaagacctagtcaaaggagccacgtaggcaccacatagatgccacgtcggctaaaaccaccctccatactgccgagggaccttgtttacctggttttcgtaagttgagggacgggtcgtacccggttttacagtcaagggacgaaaatcagattgaccgacaaatagagggacctaaagtgaacttattctggcctatgttggatacttgccccgtggatttccggcccatcctgtgtacaaaatggaacatgagtacacaaacagtgatcctgtgacttcgaagtcagaataatgttatcaccgacatatattacctccataaaaaaaaacttctggtttacatgtagcctacgtgtagatttgtagttaacagttgatcttttaggatcgaagatgtaggttttagttttatagaagttagaagaatctgtttctgtgtacatttggtgaaaatatgtgaaaaaaaatagagatttggaggaagagacgtccctccaaatattttattaagaagaaaattatgagcgtgttgggaattgaacacatgccccttgctatcatatggtttctatgtattattagagtgttgataaagacgataatgtttaagggcgacacacaccaccgaatatgtacaccatgtttacacatttgcaacgatatttttctagcaatacaacactcacattatagtataaggttggatttttttgggggaagagagagctagcatgcgtttactttataatggaagacatgttatgacaaggtgtggcttaaaccaagcccgggaacagacacaaaaagtattcctcgtatttttgaatatccacaaattttagaagaaaaaaagacccttatatatataggtatattacatatcagtatatgtatacaatcgagtgattctaatacttttcttcgtaacttctaattaactaggtgaaaccccgcgtattgctgtgaaaatttagtatgagaacaattaaaaaaaataacgtgtaagatagctagataccatcagattaaagtaattaatatggttatgataatttaaatttaaatagtatgtagaatagtgattcaaatgtaaaaagtacggtggtatgactttatggaagaagaaaagtagggagatagtttggaccgtagattaatcatctaaaggctaaaaataattgatgcgatatgacttaattagaggaaaaaaggagaaatataatttggaccatagattaatcatttaagcactaactaagtgaggatgaactatataagaacataggatatatcataaaacataataaagatatacattgaaacattatgttgaaacattatgtgaattatgttgaatgataatttaacatgtttatatatatttgaaaagctcttaaattataaaaactataaagatataacatgtttgcacgatgtttaaatgtgatgattgttagtggatgatgatgtagcatcttgttaattagtgaattagtggataatgatgtggtatcttgttagtggatgacgatgtggcaactttacatgttaagcttaagaagttagtgaaagataactttatagtaagataggatttggccaaataccttaaacctcccaaccctagccacatcccctgtcatggcacgatggggatagagtcgcactatggttggcacataccccactagtacatcttgtcacccctacatggctacgtagcaatacacatataatacagaaattaatgctcacgaaattcctgctaattaatactagttgattaggcgcccgtgttgcaacagaatcaaaggatagattggggattagggatcagaagcgtttgactaaggagcacaaaattttcactgacataaggaacccacacgttagtgatatgggattagggcacgtacaaaggtctctatttaccgtctctcatggttgctaatgaagaaaattcgctgatgtgaaagagagatgatagaagagagaaacaccgttgttttgcatgacatcggctagacaacactcatggtggtagattcactaccaccatttttatagtagcatagacacactccgactgagtcatgcgtctacaacttttccactaccttttccgactaattacccaattacattagcgatgatcatgcgctagcatttactccctccgtcccaaaataaaccaactccataccagatgtgacacatgtatcacatcctatgtagataaatttggacataaatatatccggatttatcgtactatgaagtatccaaatctggtacgaggttagttttattttaggatggatgggtgttttattttggaacggataaaagtagattatattgggtgcaacaatcgaggccacacatatgtatatgcaaaacaaagggaggaggaagagtgtgatgccaatatcgcgnataatgcgtaccatgcccaaaaatttaattaanaaaananannangggttctgtggttctctgggccggctgtcgtccgtcgtaccccgatctcgagattgaccagaccagcagagccattgtattgttgtgtgcatgcggccggccggcaagtgcacggcctcataatgctcctcgccgctcccaactctctccagcaagctgcacccaccacatgtgtacatagtagcattcatcaccattcccctgataataacaag

SEQ ID NO: 523 - DNA, 3479 bp, Oryza sativa
atcgattctaacatcaaggtttctaagtagatgaataaagtgacggattattgctgtatatgataaaagcaaggttcggcggcgcttcctctgggctggaacaggggacatcacaggcggcaagtgcaaggtcaattgggcaaagacgtgtatgctgaccatgcagcgagacctaagagtcttgaacttagagaaatttacaagggccctacgcatgcgatggctatggcacaaatagaaagacccgagcaagccttgggtgggcctcgagacgccttgtgacgagattgacaagatcctattcgtggcggctacaaatttatcgatcggcgatagaaacatagcacacttttgggactcgccgtgggctgatgggcgcaggccgaaggacgctatgccacttgtctacgcaatctccaaaaggaaaggaaagtccttgcgtcaaggaaaggagaacaatgcatgggttggagacctagatttggaagcgaacccgctggtctcgctcgagctaatcgactagcttgtggccttatggacagcagtccgcaatgttcacctgaacgatgagcagcccaaccagatcgactggaagttcactagtcatgggcaatactctgcatcctcagcttatcaagctcaatgtattggagcccccagcacaaccttcgactcgctgatttggaaggtctgggcaccgaggaagtgcaagctccatgcctggcttattatccaaaacagagtgtggacctctgatagacttgcgactaggggctagcagaacaatagatgatgtcctctttgccgaagaactgttgaaacagccatacatctcgttttcgaatgtcgcttctcaaaaaggatatggacctctgtggccagatgggtgggtaatcatcttcttgaaccagggcactgggagcctacgcagtcggtccaggaatggtgggagaaactggccaatacggtaggagttcccaaaaaaggatggcacactctcatcctccttgttgtgtgtgagatctggaaagagaggaatcaacggattttcgagaataaggagtccacaacgacgtatctgcttgctaaaatcaaagaggaggctaagctctggatgctagccggcgtctgaaggttgcgtgagcttctgccacaccttgtatagtgtacaactagccccttgagttttttcccttttcatctctagggggtggattttttttccttgctatgcgcagaatgtgcctttataccttaaaaaaatagtttttcccttaaaaaataataaaaacaaggttgaagtaaggaatcggtacattaccagtttaccacatactagctgctactggtacttattcacacggtcacacacatgcatgtgctctcctatacttttagttaaccaccaactttcttaactaatcacgcgcatcaattgtttaacttgtcctctgcaggtgatatacgactttgttgtgtattttgtcttgtctaggtataataattaatgtaacatgtatataatatatccatgcttcggttagactaatccacctttaattagtgttttctttcattggggcaattaattgctttatatgatatatgcatgcttgctgcaatgcagtttaatgcaagctctatgatcagcttaagtgaaatcaatgtatcgggggattgattttagggttttagaattgagacttcacacgtccctgtctctcctcatctttcctttatagagatgtcggtgggactcgaggattaatctcctactagaatatgaactcgtttgtaccgatctcacaaaaacaaaatttatctctaagtttctttcttgatttggaagtaaaccggtgattttatctcctcctaattcttatcggcagttaaccaataatatcaaccaacaatgctatcgctatgttgccgtttgagtggatttgatattttaaaatagtcaaattatcagcaaggcgattttaatttgaaggccgagaattggattcagaataattcaaaatacaagtgaacggcaattcattgcaaatgaaagtcctgtttgcaatacggattataggatttgaattattatccaatgaaattcctattccaaaatggccaacatttttcaaattactgtaaaatttgcacacttcatttaggctgagttcgacatcatgggttgggaattctccctacatggcacgcaaaacgaagcagcagattatcatacaattaaataattattagctaaaatacctgaaaaacgagatttctatagttataattattagctaaaatacctgaaaaacgagatttctatagttttgaagcagcagattaacatgattttttaaacaacttttctatagttttttttttgcataaaaatacatcgtttaacatttagggaagcacacgtacgaaaaaatgagagtagaagttaggaagagggagtatagaacacagatttagactgagttactaaaacacttcaattaagcctatttgaacaaaattcacttgaatcggccaaaatgaaaagagtaattagacagattacaaccagtttaacatcaatctaggcctagggtgcggtgagattgagaccacacagtagacagtacatcagagaattaccccatctctgcaaatgccatacatactacaggactaaattcctcaggggacagatcatcacatttcaccagcaaagagcccagcataagaaaccaaaacaagcaatagaaaacaaagccatatgagtgagttcctttgaccagatcaggatatgtgttgttattgcctgtgttgcagctgctactgtgtgttgtgtgatgcatgggaagatatctttgtgttggcttctttgtctttgtgcaggtttgtagtctttagaccacacatccactccaaatacatggtctgcttctgcagtagagagagtgcaatgcttgtgatgctagcttgtagctagatagggccacacctgtgcctgcctgcctgccattgatgcaagcagaccatctttgtttcaggctttcagttgaggactcacagctgtacacattccaactgccattccctcatccttctccttacactttgcaaagacttcctcttttttttttgcatgtaacattgatcagtgattttcgtactagtagcacataaacacattttgtcagatgttaaaaagaaaatgcaagaaatcttagggctctctaccctttgtgtaagctttcctttttcattttttacatgtagcattcagtgattcccatactactagtacatatgcacattgtgaaaaatggtaacaaaaatgcaagaaatattatggctctgttggaatataggaagcatttcgctgacgataagtcgctgttttcgtttgtataaaattactgaaatatggagtttttattgttattataattcttgctcttaaaaaaattgtttgtgctttgataggg

SEQ ID NO: 524 - DNA, 968 bp, Oryza sativa
taaatattttggaaacttatgtcaaaaaaagggagaaaaaaagaaggggaaaaggagaagatccaaaccaagcgccccctagacatctgactaaaaattgtgtgtccctggtggtgctagcttcctcaacggattcgcggcggctctggcctgagccgcttattcatcgccgtcgcagcgaaggcggcggtgtcggtaacatcatcaacaagaacagaatcatatgtactggtggtggtaatctcattggagtctgaacattgcaatggtcgcttgctgctcctcctgttgttgttcatgtccccaaccatcatactgtagcaggcatgtacattctcctgatcaaagaaacataaatcacaccacataccaaagtcaattacatatctaatttataacgacattttcataatcaaatgttgctcaactactactttgaattagtttttttctgttctatctgaaattattcaagtgactgtctgactgacattctcaatgttgagaaacacatcaaagttaattacatctaattttcatcatcaaatgatgctcaaatcctactgatgtatgttgggaattattattagtttgcttctaaaatgtattgaagtgagtgagtgaatgagtgactgaccttgtcaataagacaagatggagaaaggttgctcatcttggactccaatgcttcttttgtcagtggagctccataggatgcagccaagattgcagctgcagcaacagttgatggcctgtaatctagcacacttccagctgcatcaaacacaaatcaaaatcaaaatcaaatcaaatcaaatcagaacaatgcaacaaacaaagaacacaaatcaatcagatgccagatattttttagagagagagagagagagagagaatattctgatttttgtgtgtaccttcagctgtggcaaagatgaagccgacggcgttgagggcaacgcgggcgg

SEQ ID NO: 525 - DNA, 11035 bp, Oryza sativa
  unsure (1)..(11035): unsure at all n locations
agctcacttcgaggatccacttgacagcggcgaggcgggcttgcggagaaccagtccccgtcgccgtcgccgtcgccgtagccgtcgccgccggcggcgtcgaagagggaggaagaagaggagcagcagaagctagcctccttggagaccatctgctccacgtactcctcctcctcctcctcgtcgtccgccgccgcaacggcattgtagaacaagaatacgtcgccgtcgtcgtcgtcgtcgaccacgccgtcgccgaggtcggcgccgtcttcttggcacgtcagcgagaagccgcacgccgccgagcactcctccgcctcctccatcgacatcacccctactgtttattcaggtcagtcaagcaagaaccatgctacggccggcggcgatggcggcggcggccggagaagcagaagagtggtcagcgagagtgagaacctctcctcctcaatttaagtgggctcacgtttcattaactttttttttactgccgtgttttttttttaccatttgtgttgttgttgaccattgacagttctggtaaattcaggtttgtactaacagtacgtctctggggtatgaaagcgcagtccgtgaaaaacgtaatcatcatggatctggtttaagatccaaagaatttaatgtgccatttactctgcaaatgataagagtttatgcttacgcttattagccaaaatttgaatttttaactttaaatatggagatgattttgggttttttttttcatcgaatcttatttttcagtctttacttttagatcgttaagaacatgtatataaaagttttattcacaaattacttttcgtttgcaaatatgttgtttggcttatttcacgaataagcgaaacgatgaggcctttaatcacattgacatctatctcctcaagaactgtattttggatggatgcaaaactttgagcagaagcatggaatgtagctgcaatgtgattaagatcttccgtgtaaaatgacacctgatagtatggtgaagaaatctcaaattatattggtaaaatgatatacaaaagtgaaaatgttttaaagtaaccacatattggttggcttcagctcataaaccctaaaaaataaagagggccgggtagtaacgcatccccgtcccccctccctccccgcgtcgctctagcgcaggtggctcgggggttgtgcggcaggcggcgcgatgacggtggcctaggggccctcagctgcgactcaagaggtggcgttgccggtggtggcgcggcttggctgcgcggcggcagggtggcaactcgccactacgtcgctggaatggtgtggtgcagctagggcggctgggtgcggcggtagtagagcggcctgcacggaggcacgaccaagcagaggggcagctaggtgcggtgatggtggtgccagtgttggcgcggcagccggtcggctcaaaaggtggcgcaagcgtcggtgcagtgatcgagaggccgggaacggcagtggtgatgccagcgcagacttggctggagcaggcagcgatggcagtgccccttcttggagctcctcctcttctccttggggagtttctaggttggattaaggcggtagctggttaacgggggaagctctgaccgccgacacgacgccatccaggccgggttctcctttggccaaatatggcgaggaggccagcgagtggcgggacggaggaagcctgggccagcttccaagggtggcggagggaacaacacangtgtgaaagtaggcccgtggtggggtggaggcctcatgctgccactgtctgtgcggtggtttctgagctgatgggcaatgaatttcaagcaaggttgcagagttctaggcgaaaaccacgcctctctctcccttggcgagtttctctaggtgaaaaccacatctcccatagatggacgatggcggcgtccttgatgtcgtgacctccgtgggggcatcgttttcagagtctcgtcttctggtgttgtcgtaggctcagcggcaatcagccacgcatagctaagatcattttggttggttcctctctcagtgggttgtgcttatgtggttggcatgtggttcttggtcgtgcactttggtgcacttccgacctcaatagttttctatcgctttttcttaatatattcggatggcctcctttggccttctccgcgaaaaagaaaaataaacgagccagagaaacataatttagggcaggacatttatatttctactcataacggtttaaaaaccatgtctggaaataagaaaacaattaaaaaggcctagaataatgtaaaattaagtttgaaaatttaaattttggccgtgtcttataagccacaaaacaaacattgacggtaatagcatgcattatgcatccagcatccatatttgagatactactctaaactgacaaggcatgctagaatggtcctaacattttcacacaaaaagtggtattttagtctgtgggcaaaccctagaatctaggaaaaattggctaatgatctgaaaaaaagtaggttgaagcctctgcaggctacatataaaataaggattttgttgagagtgtaatctcaactaccacctagcatcatcttctccccaaaattctaaatgcagccaagaaaatgccacatttcctcttcagaatgtactcagggttgagacaaaaacactcggtttaatttggctactaatgaatcaatgtgggccccacccccatcagggaaaaacaagcaaattctgtgggtgatcagagacataatacagccacaaccatggtatctaatcaataataatgcagctactctatagcatctcacaacctaatcctccctagctactgacaaaatttgacagatttttaaccttgacaatttttttcagagttactgtatgatttctttttcccctacccatgtccatggaattttagccttcctcgtgaactaggacaagctgtctgcaatgtcccaatcttgctactacatccagatgctaattaatagtggggacatggcaaatttatatacacatatatatttacacgaaatttatttacacacttgaatatttggggtcacatgacatgagatggtgctgaaaatgttgggagagtgaacaaaaacccaggattcaagggccaatgttttggagtaccaaaacagtgccaattcaacacgcatcgtcccatgccaagatgcaaatttcagtagtacccccaggtcccccaattgcttgctgcccatttgaaaacaagggaagatgccaagatttggcctgaactcacactaagatcaaggagagcaatatggaccacttcttatccttgctgctcctgcatttggtgattcagacaacatgacgagcaaacggtccgcatctgaaatcaaaggatgaaatataatggagtgcagaagttaatataatcaggcatgtcaaatttacatatttgtttttagataatgtcaaactttcagatggagtgaaaacaaatggcaatctgaaagtttttatatatatatatggagcctgagtttgttgacagttcttgtgatggactgagacataaagaaatcttcgaatacaagcaaataacagattatggagtttgtaatttgcagaatttgtacaatcgaatatcataaagaaatctcaaattcagaattgtactttgcagagagagcttcagtacctcttatggagttttgctgatacagtgctcttcaaacaaacatcagcatgaacacgcaatgatgatagcatctagtaacactgatcatcaggtttcaactttcacctgtaagaacaaaacaagaaccatgaacaataacttctcaaggaaattattaaaacgattcacagttggtcatgttgaaatgtactgtgaccgacggtcctggatgtggatggagccggtatactgcatttaaggttgtgcaagccattctgtccaacatttcctgcaatggacaatcgtacacagtaaaaaaacctgtcctcctacctgaattataggtttcttcgacattcatttatggattgcaagcaagcagatgtgtgacacagatcaaacaacctcaggacacatcatatcatcaagtttgctacaggaccctgcataaaccagccttgaattcaggttcctcagtcccacatgagaaaaaaaaaaggaaaataaaacaaagtgaagaaagaggaggacataatatgtatcctagccaacattgaagttgcagcattcaaggatcaagccacaagtattgacttaacactcatcagcatttcagactagtaggcaaacctaatgcacacaaggtgatcagaaatatattcagaaaagcaactagcaagtaaacaatagtaatcagcatttgagagaagactatatattaagaggtagagtgttcttccaagctgcccccactttggtgaagcaaggggttcagagactatagtgatgctatctactctgccacttaagaccactcagtgatgtcttctttgaccaatgcttctacaccttcacagaagcaagatgataaataaatgaagcctaagtttggtcatgtcaatgtctcaatgcaaggggcccttcaccatctctccctatttcaatgaaagcagtgaactgtgccaatcactaggggacacaatgggcctttgcttgtgagatgaagcaaagcattaggaggagatcttgtccactaatccactaaagccacacagtggctaaactctactagtgccaaacttgggcatgctagttctagcactaacttagcttacccttttttgaatcaccaaaacaccaatgatattatatatagagtatgaaatgaactagattatggagctaagtacaaaagggggcacaaaatcttgtagacctatttgtttaccttttgttttccaggcctatttgggggtcaagtctttctgtccaaagaataagcaatttcttctgaatcaaccaaggaaccaactctactgcttctagcagtagacatagtaccattgcagtgtaatggacaacaatacctcaaggacaggttgattggatagctcaggacagatattgtgccactatgttacaaacattttgaacaagaccttcaacaggaatttgagtgcaattgaaactattttgtaactactaactgcatgtgatttaattccctcataattaaaaatgtacttccatgtttcatttactcgaacccaaacctaacagcgatttatagttgatcacgaataattttccttgattattaattgatattcccgcaatttatccgtataactttaacaaagaaaattgtctgaaatttgatgattttgccaagtttctgtcaaaatccatccacatcagctgcttgacacttcgacagtacagtatggtatttatataaaataaacaaaaccttgctccaaccatctaaaatgaaagctgtgtaggcccttgggaggctttaagtcatgcacttatgttgccatcattgatgaaaagctggataagtccctgcacgtcggctaagattatcagccaggctttatgccaacccaatcagattaaagtggctaatcaaaaagtctaaccttttacaagctttaacctaacattaggacagcttcccaatgtttgactggtacaagggttcagtcagtcagcaacaccaagaggagcacatgcaagcactcatgggaggcacttatcttgagtttcacaagaaaatgttacaataccaactgttgtaatatgctggttggcagatgagacaatgaaccacaatgcaaaggaaaagacagccgactaatagcaaaaaaggacttactatctcagaaagcatatatgtaagtgacatgataatgaagcaaatacatgtagataagatagttatacaaaggttaatgtagcaaatacatgtagataagatagttatacaaaggttaatgtagcaaatacatgtagataagatagttatacaaaggttaagtgggagggaccactaatatgtagtggtctcaccattttgttggcaccaattacctgtagtgtatctgtgcatgcgatgtattgtttgtgattttgattcttattttgcaaccataatagaatgatccatccttcaatgattcaatcttaccaggcaatcaataacaaatatgcagtatatatgtacaaagttaattttaaaagtttccttgaaggcatgataaatgggaagagccaacaggacgttgtacttgattgaaaccatagtatgtgcaaatcttgtatagagaagattgttccaaaataatcgaataaattcttcaggttacaatcttttgcagacagaatagttggtacaggagatgtgaccaatcagaatactgtaatcacatggaagtttctgtccaatgtctgtggtcttgagatcggtggaaacttgctggcaagtgacggtctgccccatcaggctatcactatacggatttcatacaggtttcaactcttaagagtaggaaggacatacagaaacatcaggaattgagtcaaggatataatgtgttgaaattgtaagtatctggcagaattctgaataaaccaatgccatgctagatagaaacactattatctgaagcaagtttggattatgtgattatgccaatgtgaggagcccaactaggcaggaatctctgctgtctttctggcactacaacaaaacaatttgaagaatatatgtcagcaactcagcataaactataagataaatgattaccacattccaaaatgacttttacagcattaccgtatgcagagaagatttttacagcacaaaataaaaggatgaagcgaaagattctctcttacaatatattcgggcttcactgaaatatcaagttcagtttccatcatcattttcttcaagcaggtactcttctatttgatctctgaaaaaaaatgccataaacaatttagcaaatcagtgcactgaaggactgaatagggcaggactttaacagatgaatgggccaactgcacatactacacatggtcacgttaaatcaaacattatcagacaaacaagctccaatatccaaaggttcaatgttttcatttgctaaactaccaatagcgctcactgtttataacaagaaatgaagtactccataaagaaacagaaaccactatcaccttagcaagctatggctgtcagatatggtatccatttttccagtccataattttggtagtagtgaaaagaaatgttcattcaagttttcaccggctggtagaatctggaaataacagctttgacaacaatgagcagtataaagatcaattttcttctgagccttgtgttttgtgctttccaaattctggagttctgattcactgaacggacttccacacatcagacagagaatctcagaaaaagtggactcatcgctatcaaacttctggaattttggacgtagtcgcgatggtaggaaatcatgatagccatctgccgagaatttgttaaaagagaagggcttgagcttttgcgcagttcttacaatggtatgctctcgagaagggttctcttcctgcagatggtaataatagctgtaaagatgtgttgtcctccaaacaattaacaaaaataactgctgagcaaggatgtagttcaactaagaataggtgaagtgtaatttgacatgtagtaattggcatgataggactgaacttacccgtagtcgtttaataaaggatgcaactaaactgttgatgccgttcgaaggcctatcgagatgttgctgtgtttttaaactaaacacattcagttagaatcaatggcatttcaagaaataaacaaataaggtttttcccccttctcttacctatctagttcacagaggagagtaagctcttgggctaggcaatcacggagtgggagaacaacaggtatttcccaccgtgtatcaacatactggacatcagcaggtaaagagtaaccttgcccctgggtagagatatcaatttcatagtgctcctctaatttccatcatgttcttttcaagaattatgaattggtaacaaagaacagaatacagagaaagcagcacatggtataccttcacagtcgcggacagaacatggcatgctattgcagaagcacatgatcctagcatgatcttagcgtacccgttttccatagcaatctgatcaacaacacatcaacatgaaacaatagacattaactcatccactgatcaaaaagcataatacaagagcaaaaaagcacactgacggaccttttgcaacgaaagcatgcgtaagcaccgaaggaaatcctccctcccagtgtcatcaccaatcatatccaccgcctccctcaacctgcgttccccatcctccgattcggtggagaacacatcctcaagacgcgcaatgtgcatcgctttaacgcctgttgacaaactcgacacgatcgacctgatatcttcaattgccatctcaatctcgtctctcggcttcgaacagagaacactttcatccacgaatgccaccccgacaccgaataccggtaaggcttgtgaattgctcacgtcccagctctcaatcgccttgcaccgcatctcatgtatgaattgcagcgctaccctataattacatcacgtagtagtacaattacacttccactctaatgatcataaacacatgaagattctatgcaaagtactataatacaataacacttccactctaatgatcataaacacatgaagaattctatgcaaagtataatacaataacacttccactctaatgatcataaacacgtgaagaattatatgcaaaggaagagtaataactttatgtagcacaaaagaaatgaaaattggaaggaaaaaaaaaagaagagggaagcgaacctggaggcggggccgccggagaaggcgaggaggacggagtcggtggggcgaaccatggcgttgctcgtgacggcgagcttgaactccccgagcaggttggcccggaagcactcgccgcacaggccgaggcctccggcgacggcgacggcagcggcgccgccgccgcacttgccgcactcgcgggagagtgacaggcggcctaccttctccgccgccgcagcagcagcatcttccacctcggcggcggaggcggaggaggagcagtggggcccgcagccggcgccgccgcaggaggagacggcggggccggccatggtgtgggtacgcgaggcgggtaagcacgcgagcgcgtaggtttagtttagggctttgggattctatactactcctcgaattgggcctagctgggccgtctcagtccaggcccaatgggctttcacctgggccgtcccctcgaattaggcccatttttttcccttttgctttgaatatttgaaatgaaacgcaccagctggtgttaggtttcagtgtttcatattgatacagtactagcactttgctacgttatatttggatgaatgtatgttacatctttaaataatgtaaaagtaatgtggagatgacgatttgacattgtttacgtattaagttttaaaaatacaacaaaatcataaattatactatgtcatgctaacatgatatttaaaataatcgatataataattgttagtgagtgatgatgtgacgtacttgtatatgatttaaaatactatagataatacttaacagtggatgacgatgttgtacacttgcatactgagttttagaagttagtgataccaactatattaaaagtataagggttgtttagattagtgtcatttcaaaccatgtcttttttaaaaaaattgccaaagatatacatttagtttttttaccaaactttggtaaatatataaggaatcctatcaaaatttggcaatattacccacttaccaaaattttgacattgccaaaatttgataagatttattttgataaaataacagccagttaagaagaagttagaagattataatcatgtataaggctataattagaaaaaagaggaaaaaaacgtactcagggttcacaatctctgaattttgaacatctcgagctggcccgaatgtagatctcaaatgtttttgtttgattatttttcaatttcattcaaaatttgtcgaaattcatcaaaattaacaaaaaaaaaatctacgtctcattgtggcttgaaattcactggccaatcgagattgtgaaccttgttgtcagttcggtatgttggctatttacaaattcatttaaatcaggtcaactccacgcatgagccaacatgaacaagtaaataaaattgataaaataataattctacgtgtgcttaagatcatgcttcgaggtggaaactggaaatgagatattgagacaatgggacttaaaaatttgcttccaaaaagaatcaaaagcgactagattttgcattgcttacaaaattcacagcaaacatatagtatcttaattttacaaattctcttcaaaagtatatgtctttcatgaagacaacaaaaaaattgtcacatgcaaatttgggggcaaattgaaccgtcccatgatgcaagtgtagtagtgcacaattagccttgctcgtcttcagttcttcacaagtttcaggaccagttccagtttgataccggtgttacctatgatccttcagtaactgatgacgaactggaactatataagtaattccagaatggctaatttgtgttgaattcattgcatggttagtatgaactcgttgtgattaacatgaactgcattgtccagttgtgagctgagacttctgaatcatgtatcaatgttcagatcgagcccaatgttcatcccgttgtacgcaattggcgcatacatccacatttcatcggagctgaggagctgcaggattggacaaaatatgataagtggatcttgttacaggataatggatgatatgaactgaactgtattctgtagatgctcnnnnnnnnnnnnnnnnnnnnnnnnnnnnnnnnnnnnnnnnnnnnnnnnnnnnnnnnnnnnn

SEQ ID NO: 526 - DNA, 908 bp, Oryza sativa
cttatgttagcatttttttttcacattcagttgttgaaaagattatgttttcaggagatgatcatgttctagtacccttgcatagaggctctggggatcagtggctgctccgcggccagcccgggatttgcctttcgaagtagcaccagcatctgcaacctcctgggatgaactggaatcattgtcagaaatggaacagctcccatttgggatggcaacacttgcatccttctccacagtttgcttggccttcttcgctcgcttcggttcagcctttctcgcgcattttgaaccctgcatttcgatcattccaagcgatttttacattagcactccaaacatcttcctgaaagataacaagagtgaagaatgatcactgatgagcaaggacttactcttgtttggccatcaaattctccttctgccgactgttttctcttgttagtcccactaaccgaatcaagatcctcgtggcccagctcgccattaccgaatgaatcaagggaatggtttgggatcacattcagaaactcagttgcaccttgcacctggaccatgctcaggtcatgtggtgcaatgctggagctgacacccagggcctcatttgagtcactgaagcagtatccttcatactcagatggagcaggaatgctactagcattgctgttgctgtatgcagtgctgctagcattgcagctatagtagcatggattggaagattgatcaaaccatgggagctgctcatggccttcctcctcaccatggatggggaatgcactgaagagttgcgccatcatctccgactcatcgctgtgcgatggcaagtcgaagacggtccagctcatatcggcgatcagtcctccaccctccattctgatgtgaattcaggacttggaggtagacaactg

SEQ ID NO: 527 - DNA, 2974 bp, Oryza sativa
gactcagggcatttttcaatcagaatatcaaagaagaaagcatcaatcaggtattgcacttagatgcagctagagaaaaaccctcaaattaacaatctccacaattccaaacggtagtatatatagcttggtatgagtctatgagaccatacttgttcaaacaatacatactatacacgaggcatgcccacatagaaatgaagttttatcatgtcagattgctcatcactcatcagtgataggaaaccaaatatttcaccaaactgataaacaaaactaaatcatgactgttgaagtaaatacggtcactgaacactcgagaacattgttgccggagcaactactttgtcttcagaaattcaattttgactgagctctgaaagattttaaagtcacaaactggtacgagtaacaatatagcacgtccacatgaaatctttagttgccagatgcaaacgcattgtgccgatctaacatatgatcagtggccacagaagataagatagtgtccaattgtgtttcaaaaaaaatgaagtaccacaaaccactgggcaccttgaattgccagcatcatgatctccacaagtcaatgcagaagtccatgatcacaaattgtcagtgaaagttgtacaggaaagcaggaatgcaatagtgatagcaagcagaacaacaaactccaaaataggtgattctcattccccatgaataattggcactcctttaaaaaaaattatgccgtgttttgatgtattacaaggatcattcaagtccgaattcccaaataactcatgtgcctacaaatttaaagatgagacttttattgcagagcactggatagaacaagctaatattgtcacgaccgatatcttagttgcttccaacatgcttcgagaaggacactgatattaatagggacaacttgagaggcccttagttgtttcattccgcttagtctgccttcacaaggacaaaaactggcttgttccccagcttgtcccgaccctgaaaaaacatggcatagttagagcactggatgtcatcttaagccatgttatttctaaccaaagttttaatcttgatctaaattcctggcagtgacaaatgcagataatcccaaagttttttaaaaatgagatttcgatcatgaagagcacatcttttgaattattccaaagtcttttcaatgagtttctagtcatggtttgttaatacttcctttcttgtagctaatttcaaatttaatgttaatctttgcatgagtattacccaaaaaataatgtacagccaaaaggaaacttcctacagtcgacgactatataacagtcaagcactaccatgaaaaatctccttattcacatctaactaaagcttctttttcttttctttgcttgagcatgcagatcaattacccaacacatacccacatgctaacttaatacactgttctgtataagagaatcagagatattgatgcgtcaaaagaattataccttcagttctggtagttcaatgacacatgcgcactcaacaacctctgctccagcacgctctacaaagagtgaaggttaattgagttaagtaaaccatatcacaaatcataggaataaatcccaaaagtatattcagaatgttaaggcatattccattcaaatatattaaaaaaaacaaagaaaacatgaacagcatagctaaataaacataagtccttcgaaacatcaattccctaaactccatatatatgcactacagcgaatttatctcaaagtttggaaaataagtattggagtcatatggttttcaaatctacaagtacgaaagtacaaatcgaatggaccggacataaactatatctattttgtagctcaagaaaaggggactttttatgaatagcatgtcttataaaatttaagtagctgaatttaggacattatctatagtgttcaaactacaaaaacaaagcttaaacaggaccttaccaataagtttaacggctgcagataaggttccacctgtagcgattagatcatcaacaacaacggcccggccatttggctccacagctcctacatgcatttctattttatctgtaccatattccaaagaatattcttccgagatcacctcacctagtataaacatgtaagattagccaccacatctcttaggcaaaggcatagttgttcaataactggaggcaatgtatgctaaataacaaaaagtttagtacataccaggtaacttttttggcttcctcaatggaacaaattttgcacctagtgctaaagcaatgggcggaccaaaaatgaatcctctagcttcaacacctgatatttcacaacgagggaaattatgaaaagaaaatgtacaacagaatatatgtgcatctcagttgcatcatttataattctaactttttaaccatgaatgcatgtaatgtcacaaaagaagtagcacttaattttacattaccagcaattacagtgatccctttgtccttgtatcgctcaacgaagagctcgatcgtgtcacgaaatgcatctggcttgagaagcattgttgtgatatcttgaaacataatccctacataaagaaacagaaagaagaaaggtttttattttatatctgaaaacatgaaaaatatattacacataaaaatgtagcgcatttttcatttttatttctatagctatgttgaaaaactaacatgtcattttaaaagcattctggccaacataacactaacccaagttccatacaacaccccacccaccatagagaaaatcaatgtatgaccgtctagagagaacaaaaaaaaagggcatcgcacaaaactaagctaactagcaaacaagcagcaggacaaaacctccacttggataaataaagatctatatataatctattaaaccaggaaaaaaaacattgttaattactccactcagacagttcatactcagttacgaactaactactg

SEQ ID NO: 528 - DNA, 2366 bp, Oryza sativa
acaaccacacaatctgcgtgctttagacgacgatgaataaatatcccagcgcagagctgctacactctcgtgaaatccgagatgaatatttcacatggccgaagcaaaaagcgggagagagcgagggaggtgggggcggaacaccagacctggcttggggaagtcggggatgacgcggatggtggacgcgatccgcgccacgcgcgcctagaagcctcctccccctgccgccgccgccggcatcaccgccacgccgcgatgcccccgccgctgcttcccgccgagggatccgagccgcacgctcgcactcgcgctccagccgctcgacgcggaggcaaagcagcagcagcgcgtggtcgggaggcggcggagcaacgacgacggcggcggcggcggcgaggtcatctgcttccgctcctccgcttcgcctcgcctttttattggccggagcaaaagcgggtcagcaaccgagattgccacgcggagcaacccgacctcttctcactgacgtgtgggccacgctctcgatggggcccacgtgtcggtgggtgagggtaggttggtgggtggggtgcgagagagagagggcgtggttcatgatgccttcaccaacccgggggggtgtgttggattgggccgacgacacgtgggcccaggtgcgggcccacggcggtgtgggtggggggggtgacatgtggggcccaggtggaggtgacagctggggcggctcgattcttgcgtgtgcgtcttccttccttccttcctgagttggatcatctttcgcgtggttcggttgctcaaaatttcagggtaaaaaaaatgaagaggttcaaaaattttatgggctcaccttcgagctgcatcagtgtcctggctgggttcatttgagagggttgaaaaccttttctcgcacgtaaaactaagcgatgaattaacaaatgattaattaaacattaactaaaaaatttaagaaataaattaatatgttttttatatttataaattttttttataaatatgtacctttaactgtttggaagcgtgcacgtgaaaagtaaggagtagaagttactactttcaaagtgttcaaaagaacacaaatcacatgggaaaaatgtatagtgcaaaccacatatctagtgaaaatatgaaaattattattggatctaaaaatagacgcatgagatttatctacatcatcgagagtaaaaattttacttataaatttagccatgagtaaaagttttactgggaatataaattttactcttagtaacatagacaaattaatcaaatgcgtccatttttagatgtaacaataatgtttaggtttcaactgcatatgttatttgcactgcatattttcccacctagaggagtcctataaatatctagtactagtaaaaggtttcctcaattagtaaaaccagatcaatttatctctaaatgggcgatgttgatgtgcgttacttttgatctagtattttatgctgacatatggtacttacatgacatttcttgtaagtctctctaaggaaaaatggatctatcatttttttttgggtgaaatcatgcatcatcctagatttcttaatggcaactttctttctttcctcttgtgccaagctccaaattaactcaaatacatcccacctatacaaaattactttcaaaaacactaaaaactaattgcaaagtgcatcttcccttttgggccagcccaacccatctaactgtaagccacacctagtgctagcccagcccacccgatccagccggcccatctgccctagccacaaggcgtcgcgcgccgccacgtcgtcgatcggatcggtgaccccgcggcggcgacacgtcgtgcagcaaccaaattaagactttcggataagggaaggacggaggtcctaccaaattttcttccttaaatcacataaaaacttttcacctgccacatcaaatatttaatagtattaaatatagaaaaaaactaattacacggatacgaatcttttaagtctaattgcgtcatgatttgacaatgtggagcaactataaatatttgctaatgatagattaattaggcttaataaattcgccttgcagattacagcgcaatctattagactatatgtttaatactttaaacgtgaatcggtatatatccgatttgacatgtcataacttttcacacttctcagtgtatgtatacgtttaatacggcatggagatcgcttaaaaaaaaaggtgatcttcaccaatcccagtgtaaactacgaaatttcttactggtggaaagcaaaccctaaatccaaactagtctcgccgatgagtccgccgccgccgcggcgatcgagagcccggccgag

SEQ ID NO: 529 - DNA, 6899 bp, Oryza sativa
  unsure (1)..(6899): unsure at all n locations
attttttttgaattagacgaacggtcaaacctgtttagaaaagtcaacgacgtcaaatatttaggaacgaaggggacaatattttggaacagccagcgaacactatagttaagtactccatccgtttcaagttataagatgttttgactttggtcaaagtcaaatggtttaaatttgactaagtttatggacaaatataataatatttatacatttccaaattggttttattaaattagtaattaaacatatttgtataataaatttattttggttcgaaaatgtaactattttttctataaacttagtcaaacattttataacctgaaatggagggactagaaatttctagtccttaagaaagtatctggagataccaagattttacactataaattttggtacctcaagatacttagtacgtagagggaccaaattttacactataaaatatgatacctcccggtactttctaaagtatggtaaaattacccatagttaaattgctagagagttagcatgcatattgaaacatagtagcatatctttattactcccttcgtcccaaaataagtgcagttttacattattcatgtccaacggttgaccattcgtcttattttaaattttttatgattactatttttattgttattagatgataaaacatgaatagtactttatgtatgactattttttttatttttttttataaatttttcaaataagactaatggtcaaacgttggacatagattttcatggctgcacttattttaggacggatgtagtatgagctaagtgactaacgtaactgatacttgatgattggtttgccgtgttgaagaacatggagcatatttgtctgaatgccctggcgctctataaatagtgattcaagtagtacctcactattatccttctgtacaactctatacttctgtcatttagtggtttgccagcacacgaccttatgtactttggcagctaatttagtctggtctaaccagttactaactgtaatcatgacagcttgatttgagagagaatgtcgtgattgcagtatcaaaaactagagcataatctacgtactaactgttcttctggaaagaaaatagctggggcaataaaacagccaacagaacagttcagactttcttaactagcgtgttgtgtgtacattatttgcttcttttctcagagcctgtacctagctagttgcattgagcgccttgtgacttgtcttcttttccattgtttgctgcagtcggaaacggagtgaaacgatgcagaagccaaagcaagagagaacaatggacaaggttggagggattggatgtatatggtaagcacaatcgaacaagttgtctgcatttgtttttctttttccccctctcatctagcctggaattagtttcaattgcttctgacatttgcttcttttcaatttttggttgcagtctggaacgcatggaaatgttgagacaggagagggaaaaacaagagtttgcaatgctagacagcatagattggtagcttatggcaacggatccaatgaaggtcttgcgcagtttgcagctggttgaatgacatgggggacccactttggtattacccatatgtcagtaacaagaagtgcactgaggagtttggttcattgtcatacttatggcaagccacactttcttaccatcttaaaccatatgtcagactacaaattataggccaaaaaaagtgtggcaagccacacttgcctaacattgcctaaaatgagttatggcaatgttagttaagaaccaaacagcccctaaagatatcatgccgtacttacttatttattacaccatccgtcccataatataagggattttgcatgacgatttccatataaactgtataatttgtttttctttttatctatactagaaaaatgcccgtgcgttgtaatgggtgaatgctatcttaatcttattattgttatacggtttagctaaagtgaattcactatagaaatttgcttggatataattttttacaagatcatgagctacaattatgagtctgatcatctcaagttagcatgcaaattttttaaagagatttcttatatgactccttctatattttcaaaagcaaacgaatttaaaaacctactcaaatacaaattaattccaaaagcaaatgacttaaaaatcgactcaaacacggatgacgtatcaaagtaccagcaaaaatatctttaatttttataatagtagagatttaatgctccatacatgtgtttaaatattcgatatgatattttttaggaaatattttctgggaactaaacagggcctaattaacatacccatgcaacagccccatggagcaggagcatatccgatccgattggtaagagcgaggccacttaccaggcctggcagtttcctaacacaaaaagaaccgcgtgattgaagcatataccccccgtttaacgccgttggctttttagcatatatttgaccattcatcttattaaaaactcttgtaaaatatgtaagactatgtttatataaaagtatatttaacaatgaactagatgggaaaaaaattaataattacttaaattgtttgaataagacgaacgatcaaacatgtttaaaaaagtcaacggcgtcgacggagtgtatatatatacactacaaaaattgtgcgtgcgttgcaacggatgaagactattttaataataatattattatatggtttaattaaggaaaaatttactgtgggaattcatttggttatatatatttttagagctgtagttagtagtccggtcatctaagttagcatgcgagttttttttggttaaaaggatttcttatacgactccttttgtatttccaaaaacgaaaacgtttaaaaaccgactcaaatactgatacgtatttccaaaagcgaacgaacttaaaaaccgactcatatacggatgatatatcaaagtatcgataaaaacatcttttaatttaatttttataatagtagagatattgatagaggtatacacgctagcatgcatagcttttactcatcgtgccgccgtcccctgggtggaggccggcaaaaccctagatcatctcacggtggcgacatggaagcgcatggatggatggtcctggaccgcattgtccgctgctggagcgacgacgacgacgtcgtcggcggcgacgatgaccccacgtcgtcggaggtcgcctacacctgcagcgggcaccccatccgcgtttccctccgcgtcgccgacccccccgccgtcttccgcctttacgtncaccgccccggctggccgcgcgtntacgacctgngcgacgccgaggccatcgccgcccaccgcggatccatcctcctctcggcgcgcgtccccttcgcggacctcggcaccgtcgcgccgggccaattccccgtcgactactacgtctacacggcggcgaggggcctgcggcgcccatcgctcacgcggctgcccccttgcttcatcggtggattctcctccccggaggtcgaccgccacttcaagccgcaccggtgccagcagcagcgggtcatggtagagcagaacgtcggcttcttctgccacggcgccggcaatttcacggtggcggacatcaacatccataagggtaaggccgtcgagctctgcgtcctcaaccactatgctgattgcccccaacaaccccaatggaaggtccagatcctggagatgcagcagcaacccaaccaaaaccaccacctcagaggttggtggaccgacgccgttcttcccctgcacgacagctacctcgcctgcgtcgactgctaccatggcatcatcctcatcgacgtcaagacccagcgttacttcaactacataccgctgccggcagaggcgaagcatggccgccgccgcgttgacaagtacagccctgatccagctcgttctgcctccatcaacagcgctggcaatatcacggttgtctgcatagcggacgacaatgccgcagcaggaggccgcaacaacaacagcactgctggctctgctttcatcgagatcgagtcatggtgtctggtcgacatccacgaaagtagatggattcttgatttcactatggaagccggcaagttctgggatatttgctctgctgcaaaccagcccctccttccacatgcgccgcctactttccccctggtgagcatggctaatccatttgccatctccttcctcctctacgacaaggccaacaacttcctcctcgaggacaagggcaatggcctttactggatgattgaggtagacatgagaaaccaaatcctgctgtcaccagccaccctctacatcagtgaagaagaagaagagctcttcatcaatggaaaagaagaagagcaagaaagatgttgtgatgagagatacccgcccatgaaatatttttatggccataacttcatccccagctggttcccctcttacttgaagaaaggtggcgacaccacaaggtttgctatgttttcttttttatttgtgatacaaaaacatttaccatttgtgtgatgtgttcaaatatgaaaataataccagttggaatatccattcaattgctttagccactgtttaggaattaacaagcagataactggatagttaaatggctgagcagttagcatattggaatagagcatatctttattagctaaatgactttgacgattggtttgctatgttgtaacatgagcatatttgatcgaatgccctgccaatcctgcaaatagtgattcaagcaataactcggaattattcttctgtactcctcttctatacttggacattgcctcttaattaaattttcattacattcatttttcttttcgcacagttaaactagtagagcctttcatttggtgaaagttttactgatttgccagcacataaccttaagtaatttggttagctaagttcttggtctaatcaattaccaactgtaaacatcatagcttgatttgaaggaacatcgggattgcaggatcaaaaactacagcctaaactgttactgtttcttctgctggaaagcaaatataatattaggccttaagacagacagccacagaacagtgcagactttcttaactagtgtgtcgcatttgcttattttcttaccgtctgtatctagttgcattgatcgccttgtgacttcttttccatttcttgatgcagtcggctgcggagtttaatgatgcagcaggcaaaacaagagagtgtaatgcaaaagattggacggtaattaagcacaatgaacaagctgtgtccatgtttttttatctagcctggaattagttgcattgccagggttttcggtttctttcggccattttggttttaccaaaattcctgaaatttcggttttctgcactttttggaccccattttttgaaattttaacataatttagctgattttgaccaaattcgtaaaaaaaaagagagaccgaaaatttcgaccagataatcacttgccgagggatccgaaatttcgaaccgaaattacaatcagtgtatatagctgttgtctgcccatgccaactcccgcaacatcggaaggcgtgacgaggtgatcatggcgtagctgaacaatccagcaaaccttcgcacccaacgcctactaccacgacaagacagacagagcggtcgtctcccagagaacttttattttagttttgggtttgattatacaatcgggttttaaccgtatgtaggttatgttcttgatggtggtttaagatgtttaacactataggatgggttatagttcgatgttagaattattcccgtacctggactactattgtttgatgttgaatttacaagttcaatatgatgttttgcacaactcattttagttatcatagagtttctttttagttttctcgttgcaacgcattgacactacccaacaataagagaaaagctctctttaaaaatcacgcctatttataatctacttcgttagcttcgatgtgctcttcttaattatcatatatatactcccttcatcccggtttaatcatcactttccatgtgctctccttaattaccatatataacacatagtattatactccctccatcccagaaaggaggacgttctgcttctaaccaaaagtcccataattcttgacgctggcagcctggcaggcactagcaaactcctagacaagcacacataaaaaaaagaagtggggccatctaaaacagtagcgaactctttctcctccaaacgatttttgctctgaagcgctaccttatcctctcctctcgtattctcttcttccccatcgctcgtctctcgttttcttctccttccacgccacgtcttccaaaccagcaccccgcttttccctcccatcagcacaccgcaccaatccccatccatcccccctcccctcccccacccccagacgagcaagccatatccggtgtgcgacaacatgctcaacggccgcggcaacactgagagcgccatcagcagcaatgacggaaaccctaggggttgcagcggcggcgaacctaggggctatggcggtggaggccgtagggatggttacggcgctggctttggcgagagatcaggttgtggaggtgatgatggaggcggaaactgtaggggccgtgatgtcggaggccctaagggctacaacagcagcagccctaggggtggcggtggcggcggcttcggcgagagattgggatgcggcttcgacgatggcgacgcaaaccctaggggctgcatcggcggcgaacctaggggctgcggaggtggaggccctaggggcagcggcttcggcaagagattgggttgtggcggtgatgacagcggcaggttgcgaagtg

SEQ ID NO: 530 - DNA, 1792 bp, Oryza sativa
acatagtgcactcaaatgatgaatgcaaacagcctgcccagatgtggtgcgggtagcgggttcgaggcaagtggtttcatcgtgaatctggccgatgtttagaagaaggcaagaatgtgatctttgatacccaggatgggcccgatatggatgagtatgagttctggcctgatttggataatgaaggaggcgacttcgtatttgaagattggttcattgacgttgtgcccaagaaaaagatgcacgatggtgttgcaatggagaagaagcgaggcagtaaaattggcaagctgatgagctccaatgtgacttatggcatgggacgacccagttctaccattaccaaggcatccttttcgtcgaatgcttcttacccgcagggaggtgacctgtggcaggggacaatggccaaccacagtgctgaaccgagcaagcacttcgtggtggagtcctccaatatcagcgagcagagcaaggtgtgtgctattaatttatttgagtcaactttgcataaaaaattgaaaatatattatttaataactatggaaacttacagataaactcatgaggagcctgctatgtataatatatccatatacttctagctagtaacaattaggtaaccatagatatttaatcactctaactttaatgcattatgtaatgtgcaaccaaagccacaagttagtaagcagtatagtgccatatagctggaagacttgatctgttcaatggagagtcatgcaccatctaatgttctagccgttaccacacaggatctttattgcattccatttaatattgttttgccatgataagagtcttgcaacgcataatattactattattaattttagcttttataaaactaagataataaaatgtgttgtgaagtctgaacatagtctctatctgccacctactgattttgtaagtatgtaacaaaaatagaaattcatacttttcagtcctcttcttctccaatactgcaacttgcctagtagaccagatattataattattagacatgtgcttaaacatcagaaactggctgcaacagagaaaaggaagttcagcattttaactccattgaataaaattattggtaatacataatttagtactgcattttaactccattaaggaagttcttactgcatactttgtcaaaccggtgtagtaccattacgcataaatgcatggtttggtcagccgatcatgaagcatcaattcaatttgcaaatcacagaattggggaatggaattgaacaaccaagaataaaccgagtgtatagtggatctataaacatgtgccaaacacaaaaatgcccttcttaaaaataatataataaacaatatagaaagaataagtaatctaatcttttttatgaactaatactataaataaaagcaggaatagcagtcaggatgtctacaccttcatatgaactagaaaagactatgaatggttccaaagtgataaactaaggaaattcttgaaaataggtgcttgacatgaatatttcacacgaacaaaatatatgatcttgtgcaagcactcggcatacaatgtattgattactattattaaatttctgtagcttccaattttgatttgttttcatatatgttcaggaggtgtccatccaatttatgcccaacgaggaggagatacccagcgaggagaagatgccgagcgacaaagaaaatggtgatggtcagtttgtaggcgtggacctttgggttgattcacaggaggaagaatacgagctcattgatgacacgaagttgg

SEQ ID NO: 531 - DNA, 4800 bp, Oryza sativa
tacatattatgacacaagtgcacaattagttgcctagaagttgtatgactttctcatacaactgacgatcacagcgaatgcctctagcctcgctttgttcatgtgagggatcttgtacttattccctccattagcttccattacttcaatgcagtagctttgtagtgtcacgaatactctattcagagtctttggatcgtagtcattatattccttctgaacattctctattagctcctccatgtttttagacaccctattagcagttaaggactgaagtgatgcaaagaagccaagatctagacaattcatatcgggggaattgggaggttgattcacgaggcgaatatcaagccccatttgagctactgcaacactgaactgctcatcgtcaattggtacatgagttctagcattgtcttgttgaataaatattgttcttcttgcatcttctagaggccaacctgctctaatagctgggagaactttagagatcataaatgatctcatagtgtctctatcaaccttaattgtctttgttacaagtgtccccctctctctattatggcttctcctttgtgcgggttcctgttagtaaatcaaataggctaggtttaaacataaaaaacagaagtaaataacacttgtataagaaggttgtgttacctttctaacaaaaggccaaatgcctatcttaccatcaaaagtacaattgccttcagcatcatacctaggcctcgcaactgctgatagaaacattactttctcaattgcattcttattttggacaggtctatagtgttcctcctcaaggggatgcaggtagaaagtcctgttctttttggtggcattgaaccatttttcatctatatggacaatgttttccatttcaataaacttggggtcgtttggtaacgtacgatgatctagcataccaacacaccactgcagcctttcttttttgtttgcttccttcaaagaaggctttagtgagttagagtgacgtcgtagatgcccttctttgaacatacctagggcttcagcaagtgaccgtatagtgcttctttggcgcaatggaatagctgatacaaccgacaagtctattacaacctttttgcggccacaattgtaacgcttcctcgagtcaacattaacttgtactccatgtgcgatgcaaagctttgctctcttccaaatacgctggactgtacggatgctgacaatgaacacttgagcaactgcacgtgtggtgtctttttctagttttccatccttactttttgcaagcaacaattcataaattctttgcctttgtgggtttgtcaattctgtagaactgttttcctcatttccatttgcatctggatttggatttggatttggatttgcatcttcttcttcttctgagtccgacaactcctctctatcaaagacaacattgacagtatctatatacacgccatagtcccgaagatcatcctccaaggcttccagctcatgttgcaattcattgtcattgtctacaaaaaattttacatggtaagttaatgtatgttaatcagattgtgtagatttattcagtcctaaaatcaagaatgtaaacatgtttgtaactgatcaaaaagtaatgaacttttacccagttgaatttcttgttcctcatttccatttgcatgcatatccaggtcatgctccatgtcttgctgataattgtctaaaaaaaactacttgctagtcagtgccgcacaaagaatattgaatatgtttaggatttgcaatgtcatgactcataactgtagtttacaatagtactaactcttccatatttccatatcaagatccatgacttattcataaatctgttcgtaaggtagcattgatttattgtcatgctaattcagttatgtatttaattctacctctagctctatttaagttctagtgctgtacaagtaatttttttcaggtacttaattcagttcttgcttattttcagtagcaagtcaacaggaatattgtgtctgggactgggagctggagttaaggatgcttcacaattcaaatttcacaagtttgtgaccatctaagcatgattcaatatttcgcatcataaacacgtgatttgttgatgaatattaaatactaaaatttggcaagacgtgtgggttcttggcaataaattggttctttgtactagcaattaacaaaatcagttagtaaatcttgacatcgttctgctcaccaataggttgtgcctgttaattcttccaacatgctgtggccatgaccaaagttacttcctccctaattcgatgttaggtaacaatgtgctatttacagttcatttgttttctctatcttctgtaaagtccatatgctctaggattctgaaaagaaatggttagatgtgaactaaaatttcatactaggctctgaaatctaatctatttgtttgccaatgctttaatctgtttgaaaccatagtgacatgtcttgagttttactctctatgattactacacctgttgtctagtttctaaagtgtcttctgatacatgataatggaactagaagaactaaactctgcaaaactgtcacagtagcaaccttttgttcttttcagatcgtgtgtgtgtgtgagaaagagagagagagagagatagagcatgtgtgttgatgagggggtataatctgctgttgcatgtcatacaacaccatagttttttagagccagatttactaatgcaatcaacatgcactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaaggtcatctacctggataacatgccttccaggaacttcttcttctagattggcttgtgcttcattgaggtcaggtaaagcccctccatcttcctcttcttctgctaatatgtttagatctatagccattgtgatgggtgggtgtggagttggtttgtaggatgatggatgaagtgataaaaggcttgtagctgcctcgctgcttgaggattatggagggtacccttgggcggcaaagcaccatccatggagtttttgaatttgattagaccggttggattattttaagcccttatgttttggcgccatatcactcgaattaggtgtataacaccaatctgtagtgttgatactagtagtagcacccagcattaattggatgcttcaaatattccttttgtacagatgtggcagtgtacttgtcgtactcctactaagcattcaaatgattagccccaatcctataaattgagggcaaaatggtcattttcacacaacactaatttttcctaactaacctagaacgtcctcctttctgggatggagggagtattacgtaaagtctcactaaaagtacaccatacacatacatatatattactaggtgattcctcgcactttgctgcggaaattactaagtaatttttaatatatgttttttttcaacaatcgaacaaggagtaagcatgatgttaattattaacaacaaataaaactgatttgtcaagccatgtttgaagataaataaatttaatagactttgtagaagattatagataaaatttaggttgttggccagtatcgcaagaagcgaaagataggggaaaaagaaatgaaaagctaggatttattagcagtacacatgaaataaactaaataatatctctactttgatacggaatatatagatgaatgtacgctaagtattatgaaaatgatggatatatttgttgaaatattgtggaaactaatgataagagaggttatgattggatctatttgcattttgatttgtagaattaaataaattatggatggtattgcatgtttgcatgagctttttgataagtagttattgctagtggatgatgaggccgtcatgtttgcatgttgagctttagacttagtgagctctaactttatagtaagagatgataagtctcactgaaagtgcacgtatagaaggtaagattttcttaaatagtggtgggttctaggagttgagtctggagtggagttgtggagcagcctaaacctagctccaactctctagttcattttgtgagagaggtccacctaactctgctcccattttagatggagctgaaactatttggctgagctggtgttcttttcccctaaagatgaagattgagttttttacacaaacgaggtggtattaacgtatgattaattgagttttaattattacaatcttgaaaaatagattaatatgatattttagagcaatttcatataaaaatttttcgcacgaaacgcatcgtttagcagtttgaaaagcgtgccatgaaaatccaaaatttcatccaactcttgttagagaaatgaacgggatgtggagctggagctgtgccaagcatgcctgatccctttaatatggctccgctgcaatcaatcaaacctatttcccaggggatgtgggccaagggccgatgaggcggcggcggcgtcaccgacatggcggggaagagggtcagcgcggccgacagggaaggagcggcgaagaggagatcgatcggacggctccccacccggcgaacgcgaggaggagcacgcacaggcggcgcacgtgtagaggagcagatcggccatgttcgtgctggtgcaggcgctggtctacctcatcctccgtagctt

SEQ ID NO: 532 - DNA, 1136 bp, Oryza sativa
  unsure (1)..(1136): unsure at all n locations
gtcgagtcgatcttggtgataatggcaatagccgcacgccaccatcgccgaccgcacgagtgggacggggatgcaagcgagcttgctccaccttgagcccgcgcaccgccacccgggagccgctgttgtcggtcacaccaccctccggccgcgcgcgctaccggtgcgagagcacaaagcgagagggaggaaggaaggagagaaatagagaaatagaagagggggaaagagagtagatgctgacgtggcaccctgacatgtggggcccacatgggtcctacagtgactcagctgccacgtgggataaaactggggttaaaaccaccgagggatctagtttgcactggttttataagttgggagatgtgttgtatccggttttgcggttaggggacgattttgtgactcgatgacaagttgagggacatttggtgtactttttccttgtgttaaagcccactctgctagtctcaagtccaataactctggttaccaaagcccctaaagcccactctatctggtaaaggagaggtggttaaggctatattaactctgatgtgaaaaggacttcgttaatatgggtgccaaaaaattaccttcttctctgatagacgctccagtttcttcccctcctgttacagaaaaaccccaatccaatctagcttcgctgccatcgcttgctgcaatggcgaacaccaaccctaatcctcaccgtttcctatgtgctgatcacgtggttcatcaaggaggagtcatgaggattccccgcgttgatctcatagctgctacaaagctcccaaaacaccataaacagtatgctttggccttgctggaacggttgattcctgagaacctctggaatgaccattaggtaactagtacgtaccccgctgcgttgctgcgggtttaatagatgacttaatacataaatttttttgactcaaacaatgatgaaatgggaaattaagtgccttctcaaaatcataattttagttacatctatattcagatctgagatacgtacgattatcctttacagtgtttatattgaaaccgtacatgcaagcttcggtataaatgtnnnnnnnnnnnnnnnnnnnnnnnnnnnnnnnnnnnnnnnnnnnnnnnnnnnnnnn

SEQ ID NO: 533 - DNA, 4636 bp, Oryza sativa
gaaaactcggatagaatggcgactcttaaatggtgagtaaatccaataaattaaagcggaattgaaagggaaaatcatgtggtgaaatgatgaggaaagagtggggaatcgacttttgcaatcaattggcggaaagaacgtatgaagaagtagatcgacatagcggcgacgttagggtttcgtccggtgacgaaaaaactgtgcagatataaacaatccttaccagccagacggcagaaattcatgcaaaataaagaacaatcccttactgcatgtgcacgtactcttacgcatgttaaagaacactaacccgacattaaaaaataatgaaaaaaggatgaaaaagaaaaaaagtcagcggaaaaaaagacggatagaaagaaaggccgccaagaataagccgaaaaaatagggaaaaaagccgggagaaaaaaaggcgaaaaaagagacagccaaaaaaaaggaaaaccgaagaaaaaccgaaaaccgaagaaatgccaaaaaaagggaaaatcggaaaatcaccaaaaaagaaacggacgaaaaaaacacggaaaccttgtgtatttttatattaggtatagatatagatatagatctgggattggccgctaaactcaggagatgacgtctgctatcagacagctcagatcaaagcaagaccgacgatccaatggctatgacatatcgatgatgtggctgcaccagagggctgctttatagcaataattgctagtagtgggtatcaactatctaggaagaagggattacttctgattttcttgagcagacttagcatattactgtttggcgttctccttcagctctcggcgacggcgaaggtgacggtggccatggctccttagatcgacgatgatgtgggcttcggcaatgacggcggcggggtcacggggcaccgtcgggagagctcgtctacatgccaattgccgtctacctcgtcctcttcgatagtttgctgatttgttgctttcaatttgtacatatattgtggatctgttgtgcatgagcttgggatctatattctatgaatttgtaatgtggatgaaatggttgattttgtgcataagcttggggaatctatcgatttgtgatccaatcccataattttttgaatttgaagttgggatttagatccgttttttctctttcttttttttttttgcgaaaagtaggttttcattggcgggcctcttacgctaacgcctctgataatcagatcttcacttgcggtacctctaaaggggccacctgccaaatgttttttttatagcgggcgtgttccacctatgaaaatcattgattttcacttgcctttgatctctgtaaaatcaaagtgtgtttgattcttattctatgatgaacaattggcatatgtgattgttggttttgatatttggagattatcggcgaagtggttttggagatgattggatttgcagatgatttacaggtgttgctgttgtcgggtccggtcagaccggcgctatgcgagcggtctgaccgaccagcccgcggtctgaccggccgactctatgtcggtttcggtttcgggttgtttgtttggatatccgtggatgtttcgtgtttatggcttctcgatggatactatgtgtatgtaatactgttgtttgttaacaatgagtcaagttggagatagcttggtctcggaatatatggtttctttgtttgattcatgtgtaggtaacttgatgtctcgggagagtattgtcggtgatggatcgggagtaaacttggagataaggtgacgtctggacggtcagatatcatgcgggatacttaggctaaagatcaatgcacgtggttggtaaagattccatatgtcatacgatggagatattgtgtgcgtgtgggatgcggagtcgaatttggaaagactccaaatttggtatgattggagtttgtaaagtttgtttcttgtacggaaatgttatctaggtggattaggacttcttgtatgagtttggttagtggctttaggctaactacctcatgtataaatagagagggagcgtgaggcttcatggtatcgcttttgagagcattgagctgagagtttagttagagttttgagtttagtcgagatttttgtgaggagtgttgttgttgcactttgtaaacacagagagaagtaataaagttgtcatctacatcaagagctattcgatttatgtttgctcaggttcggcggtctaaccggtgagacaccggcggtcagaccggtggcatcacggcgatcagacaggcgggtacatggcggtcagaccagcgacggcgacagggagcagaggcgacttcagagcgatcggaccgagcgatctacaccggtcagaccggcggcgcaggagcagtcagaccgactgatcaacctcggtcagaccgatctacatcgatttgagggtaacttttaattccactaaaactttgaatttttgggtacaccaactattcaccccccctctggttggcttagttctttctatttgatcttacaatctctagcgactggcagtgctgtaacaccccaggtaaccacgtacctagagtgccacaccaaacatacactcaaaccactaactcccaaaattattagaaatttcggcagagtctcccctgtaaatacggacatccacgacaggcaattataagttaaactaataacaatatcattcccaccatacgatccatccttataatccatggggaagaaactattaaaaatctaaaagattattacaagaccgaaccatgatataatttaagtatcattatggacttaagcaatatagtttgatagtatgcagataaatgtgtatataagggtgctacttcccgcccatgcatgtcggtctcaatatgtacctaaaaccaattaaaacacaagagtgagtataaaaatactcagcaagtacaatatggagctagaaaacacatatacacatcattggcaataaagcatgaacaaaaggctttctttctttgataggaaacacattttcaaataccaagtcaaagaagataatagttctcatcccgggcaggcatgaattgaaatagtagtttccatcccagaaaatagtgaatacatcctagcatttgccggcaaagccgagtaagcgtaatcagcgcttacccacaggaacttgaataaacaaccaaattgcactcccatgactacgcatggtacttgaataattgaaaccggaatcaaagaaccaaattgaaaccatattgcacattcatggcaaacagggaacttgaattatttacccagaaccagaatccggaatattgaaacaagaataacatcgtaaacataggataaacatgaaaacctaaatggcgcgaacaacaatatgaatataagcagtcacatgtcacatagaaatatatcggaaataaatagatagagcaaacaatccatcaatcacacacttagttcgtcatgcacttgcctccaatgaagggttggtatcatgcacgatctgaaggaccaccacctaatcacaaataaaacctcagcaaacacattcaaacatgcatataaaacaatgaaaaagatgaacctactgccccatcccatcaaaacgcaataacaaggaacgccgcttgcactataaacaatattgttgcttcaaacctttatatcttgaaatatgaaaaggctatgactgcaaataaatatattttagaaatctacagaacaaggcctacaactcttatgtggaaatcatatttttattatgccattaaaatggtctaatttgcgcttgaaagcaggcttcacaatctgtccagaaaattcagactatccgcactaaaacaatcataactggagttctacttgcccaatcagggtgtactttaccaatatggaaagctaagaaaaacctctacaactttgtctataggcgtcttggctgttccactgtttagcccatccaaaaacagttcaatctactactatccagattatggcataaaaacaacagttatactcaaaaattcgtatcgtctaaaccacttgagataaaatcgcgccctttggtcagaagatagatataaatattatctacaactttctagttatacactttcgcataaaatatcatttagatctccaaaacttcaaaaaaccgaaacattgtaaatctgccaacgtgcaaaacagccaattcgaaccacaacaaacaaaactccttctctaaccttccttatccacgaattaaaccactaaaaccaccctagaacaactgatatgacaaggggaaaaacctcacctagggtttctttagagaacttgtgagaagacaataggggagactctgatctaatccctccttttactcccctcctcctcctcgtttcgtttttctatttcgctttttgatccaagctatgaaggtggagatctagggagggcaatttgttgtagaggggagagatgcgaacataggagaaggggaggaaggaggtgccggccagggagaggggtggcggcactatgaggggaggtgggagtcggttcccctctctcttggttttaggaaaaactaatgggctggatgtatgggccttctcatgttggcccacttct

SEQ ID NO: 534 - DNA, 541 bp, Oryza sativa
  unsure (1)..(541): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacaccctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatggg

SEQ ID NO: 535 - DNA, 504 bp, Oryza sativa
cgctcctctctcgccctaccattggccgccgacccaagcgcaccgccgttcctctccctccctcccgtcggccgacgcgcgtcgccgctcctctcgcgttgaaggtgcgcccggcatccttggcgaggttgccgccgccgctccgccgcaaggacgagggagagccgagaggaagaaaaggaagagccaagaatggagagggataggggaggggagctggcgatctcaccttgggggacggcgggtgtcacaccccgaagttctcctcccaagcctaaaatttaatttataaatgaccctaagaaaatgccggtgcaaatcaagagaaaaccctaaggaagtaatacaaataataatcgaatttgacatgtggaatttttcttgagttctacatgtcgaaattcactaacaggatttttagtggaattttcagagccctagaaataattttgaccaattaaaattgagcacaagcaatatttaaatccctggaaattcctttct

SEQ ID NO: 536 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnntattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaaggaaaatatatactctggtatcaatatgaatgg

SEQ ID NO: 537 - DNA, 6366 bp, Oryza sativa
aggcgttgcttcttgccatgcagcgtcgcgatggcggcctccatctgcgccggccgtcgtcatcgccatcagagatggttcagggcacaaggccgttgccgtggcggcggcggcgagctgttgcataatctccatcgccatcgattcttcgtgcggccggtaagaagctgacgcagtttatatataggcacgcggccgcgaacagtacgagacggataggatcagcgcatacaaccaattctatgtaaattcaaaagattgtgatcagccttgtgttaagttcagttcaattctgaatgcatatcaggtatcaccatatactgaggaataaaatggacatggaagctttggcaatctctgccgagaatcatgaagaagcagaataaggtgttgataatggtgagtgagggtgttgtgctcaatgaatcagccaaccagccatgtttcctgaaccacgagactattgacgaacctgaaagcacgacgacgagcaccacctacacaacacgtcaacacgcagctccccgaaggagagagctcgccggtgaaggaagcagcgacggcgtggttagtagcggaaggggaaaacactcttacagttacagggggtagaggacgcttctcggcgaaggaaagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaactttcgtgcagtttttttttaagaagcatagaagcacatcccattaagtaatcatatcactgtaataaataagaacaccacagtaaacttagtaggaataattcccgtctgaaaatcatagacgtcatcatcctctcttttttttgccacgtgttttttttttgccacacgtcataaaggccttcttcacacacatcttgtaaattcaggcttcaaatattattagcatatgagatagatgtcccccgccgagtagagttcatgtgcgaagcaacagggactcgacttggcaaaacaatcaaactgagtcgacccatttctaaatcaatttggtgtcgccctctctgtttttttttcttaaacacggtcatcacttagaaactatggataatttatcgctatgatagcaaagctgtccattttaatttgtttgtgactcaatctgaagattagtattttgagtacagaccaaggtttaatatctgcgttcaaagcaccagaccctaacaaggatagggcagcaaaacttatttgtcactgtagcaagatttgtgctacagtctccatctcgagtaggtacagcataaacacatgcaccatatacaggaatggcatcgaagaaagaaactatagcgagaatccataccacagtgtaaaatactgtcataaaatttgtatggtagcgaaaatcgtgccacagtgtaaaactataggccataagtaaagaaatgtagcgaaaattcatgctatggttatgatgattgtattagcacatgtatataggatgtggcgaaataatcgtgccatcctattattttgctccatagcgaccaaaactgtttggtgcggaaaaaaacattagtcaagtttgatgtgaccaattaacatgatttattgactctattgtgaccactttataactgcggtgacaaccaatacaggagccagtagtgaagagatgcttctcctcacaacatgtagaattttattaattctactacgactgtttcactagtaagaagccagccagtcgagctcaatgattggagggtgtagaattgcccccatggtattgagatatagcgcaagatcataccacacctcaatataagtttatcaactctattgcgattgttttactgtcacgatgcccgccaatgaagttaaagggtttcacagctccatgcatgccgcactggtgcacttcacttgttccgttgtagcgaaaaaaatctaccgcaccttcaaaagaattgatcaactctactgcgatcgttttaatgtaacgatgccagccagtggagtcaaaaattgacagcttcatgctatacacgctggtgcacgtcacttccccatctaataattgagatttgtccgaataatcatggacttgaataaaaactggtttgatccaatatcatgattagagcaggttattgtcaaaaatgtcatgaaaatgtagaggttcaaccatattacacggctgactcgctcaggaaatacattttacccaagtagtggaacaatgccaattatgagagtaatgtttatgtggcagaataagagattgtaatgatctggaaggagatccaaggagaaacagatctctcttttttattaccttctttaaatcaacgcaatagtcgatggtggtactactagagacggtattccctagtacaagtattcgccaccatgattttcacttgcgattcagcttactcgtgagttttgtgtaagggcatcacactttgtcaggatctctgatgggccgaagaactctctccaagcctcccttcagttatgtgcctcatgtcttccacctttgtcccagtaggggtatgggatatggctaatcattgagatggtttatgggtgataggctttggaaattgtgccattacttttgctgaggatgggaagtgactacattccgccttcagatcagggaagagtgacccattgattcaagagccttcctttatttttttctcttcttctctttcttccagattgtttttttttgcacacatattttgatcatacatttcatcggcttgatcactctccccctttagaacttggaaagtagtcaccacacctttagtgtaaactaagaattcctcactggcatttagtattttcttctttttttttatttgcccttgttaatacttcatggggtggcatgtggctccacactagaacttgacttttgtcagaataggtagccctttcaagctctttttcctatagttttccccagaagcttgcccccttaacctgggcaaaagcgaaagacatgataaaaacccaccacatcagggtttaacttggatcaagattcaaccgccctcttcatccattgttggtgtgagccaagtgctaagtgttgacttcgcttcatcgcgagatcaatcagttggagcatagtctgtactaggtacacatccactagtgacaacccaccaaaggtaatgcttccttcttatttggactctatgatccatgaaggagattgtttttagagaggaatgtactctttaaagataacaggggagatgtttgcacatacatattaaaataacatttttcatttattccaatgaggaatctcatggtgagatttcaactccaatatgtgtttgaattggcattgttctactcttggtaatcgactaggattccattgaaagagagggagagaacagaaagggaaggtagccaacataattaggctaaccatagtatttaaatggctaaatctttgatagataagcgttgggcatgatacttggtagtaccacacatagttcggttaacaccatgcatggtggtaaggtattgaaagatagaggagggaaaaaatatcgtttatttgatattggatcaagacaatgttactcccagtgttgaccaccttggccatgtgggacactcgctgcaaacgtgtgaaagcgagagtagaactacatcaagtagaataactcgtcattggagaatataatattttgaagatattttagtcaccctcataacattttatcaccaatgtcatatgaggagacatagtggaagcaatgcacatctaatttactgccccagccattttgcatagcactctaacttagagctgttgatcggtgttcctgcatagtccgtgataagtgatctattcaactcaagctcagcaatggcagagatgttgtgtaggaaattatgcatctggatttgcagagtggtgcttcaagggattgaatttgttgcacaataaattttggaacaaatctcttgcagatttaaaacacacgttgacatcgtgtttgccgctgtcgagctcaagttgtcaattggcattgttttgtaggctcactgaaggcaatcgagcctatggaatcagcttcggaatttatcattgaggggtcaaaaaattgccccctgcgcttgcttgtggtggaacacttgatgatttattttggtgactatcatcatgttggttagttaattgagtcttattgcttagattagcaagctctcatcttggtttgagaaattttgacgcattagcccaagggcttacacatgagaaacaagacccctgctgtctcatggagtatgattaacaataatagaggtagtcccaacctctatatgtatatttctataggacatcagggctgtccaagaaaatattattagagcgaaccggtattaaatgttgatatgcccctggcattcgacggcctctggatttgtcacctcaacttgaggtttgacagcgttgaagataatcgtttgacgaaacagcatgttgttcagcaaactaggagaacatataaataaacaaagatctgaagtgtttgttccctcactagggtgaccggtgctgaatttaaaatgtttttttattgcatagtcacatttggaaactttctatgtaactggcatgtgcagctcacatttttttaggccaatgttcaagcatcaggagagatgacccgaaccgtatgataaataaacaagagatataacgaatatctctcttaaaagtaatgagaatcatgtgaaaagaactcacacgcatagtagtcctttgattaatattttgttatctgagaagagtttttgcagcctcgactattttcaatcagatttcttcttcaaaggcatgcaagcagcgcatgagcgacactgcctggcttgctcaattgcaaggcttagctttgtatttgatgttaactcatgaatgagtctggaattactccgttgatatcttagttagccagtctcaccgcagaacatagccggtagaggagaaaagtgtagggatactcatgaatggtacaatgagtaccaagtagatttggatcagtagatcgacacatcacttgaaacaggttgcattgcttcattacataacttactgaagccaagtcgaataaccttgcatatatttaatttgatgccacagataaaaaaaatcttttgaatgtttaatttgagaaagagaggaataggatgtgcttgactgcataggatatatatgcagcagccacatataaaaattaatagaaaagcaatgcttacaaaagcatcgttcccatatatgcatactgcacggcaggcttttgtgagcctcttgttatttttaaagaaattaattaatttttttatagatcactggattatttttgtttttacaggaaatagatcgatacctcctgaaaactgccgcatatagacgttcccaataatttgttttcagaacagcctgaattaatgtctgtgaggtgactctctctctcaagcaagtgcgacagcaaagcagtgcacagttactatacttttatagaaaatgtcattcaataaactgaattggaaatacttgaacaacagccatataagtgcatatatcttgcacttttcaaactttttttttaaccagcgacatttgtcagtagccagtttcaaaagtatatatattagtatatgatagctaactcttcttgatgcagagaattacggatcagcaggaaagggaagacggcagcaatgcccggcgtggagcagtcaaataaataaaaactaggaggatgcaattgcccccggtatttcagtatttggaaatgtgtatatggatgtttgatccttgggtgctgccactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgggggatcctctagagtcgactgcaggtatgagcaatacctttgacggg

SEQ ID NO: 538 - DNA, 711 bp, Oryza sativa
atcgtagatgaatgtcctatgcgcatcgttcgtctacggagtatagagagggggtcactgattttgtcacattgcgggataatgcaagaaaaataggaatgagcatgcacatgttgtgcccatgtagggcttgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctattaatggctggtcggacaagagttttacagaactccttgagctgttaaaggatatgttgccagaggggaacaatttacctcagacgacatatgaagcgaagcaagtattatgtccgttgggcctggaggtcagaagaattcatgcatgtccgaacgactgcattttgtattacaaggaatacgctg

SEQ ID NO: 539 - DNA, 2633 bp, Oryza sativa
cgaaaatattgtttattacagaaaaaaactgtaactgcacttcctataaactttgttcattaagaacttaacatttaacatgtgagagaatatagtggtgcgaatgcacgactctctacttgctagtaataatgaaatgaaaatcacaaaacccagtcacagaaagaaagaacgaacgaaagaaagaaaagcccaagatcgatcatacatacatacatactgtatgatttcgtactagagagcatgaacgaatgaatgaatgaatagtattgcatcacacataggaaagacagagaaaacaattaaaatgctactctagctagcaagtgagtttccgatggagagagaaatccaacatcacatctggagttagctagctaagaaatactacaacactatacatcctatgtatgcaaactcactgtgtgtgctgccatggcgatcgaacgtcctctccgatccgattcgctgctgctgcctgcctgcctctctcgatccaccggctgcttgctcctggcgacgatcgacaacttgtgttgttggtctctgaacaaaacaacaaacaaaaacactatactagtattagatcagtttgtgtcgatcggtgcgtgtggatcaacacattatattgtgatcagagagtgatatgtgtgtagttaagtagaactactactagactagaagacattatggtagattactcctaccagtacgagcctcgcttgctccggacctccgctgctccgtgagccacagcgaggagaaagaagctgaggttttcaaaaggattctactcatctttatgtatgtgagcgcctgcctcccccctgtgaccctctcccaactcccattcattggttctgcactgcagctgcaggagtagctggaatttttcacagttggatccttttgaaaaatattattctataaatagaccctaaaaaacttattttaggagtgttatctttttcgcttcgctaacgttattgacgatgtggtctaacatgacttaggtcttgtctagttcaaaaaaattttgcccaaaaacgtcacatcgaatctttggactcatgcatagagcattaaatataaataaaaaataattgcacagtttgcatggaaatcgagagacgaatcttttgagcctaattagtccatgattagccataagtgctacagtaatcacatgtgctaatgacagattaattagtcttaataaattcatctcgcggtttccaggcaagttatgaaattagttttttcattcgtgccctaaaacctcttccgacatctggtcaaatgtccgatgtgacaccaaaaaattttcttttcacgaactaaacacaccgttagtttttgcattagtgactaaagttattctataaatagtccctcttcacattagttacttgtcttccacgatgggcgaaggagatgacgctaacgttattgacgatatcatgttgaaccacggcgccaataacattggccctgcgaaaaggatccattattagaataagggcccatttgaatcgcgggaatgaaaaaataaaggaatagaaaaaacacaagattctaataggaattgaagtgtaaaatagagaattgtaaaacacatgaaaaacatagaaatgactgtttgattgaacagtaggaaaaaatatgaaacaaaatagagagatatactcaaaggaaaatttctaagagctttgaactcttgctaagttttctccaaaatctctgtagaattgtccatacaataggagtttcaaagaatcggataaaattcaatcttttgattcaaatgcactcataggaatttttctataggattgaaaattttcaaaattcctatgttttttctccaaattaaaggggccctaagttttttaagggtctatttgtataataagttttctaaaaggatgaaaaaggtgaaaatcccaatcaggggtactatgttgcaaaagggtcaggacgtggtaaaagtgatgcaacagtaaaagcgagatgaaaaagtgactggtgcgagtatttactgctgctactcctattcctactcctactcccatggggctagtagtagtagctatagcctacagctagtacaacacccacgcgtctactactcgtgagggcacttacagtgcgtcaccaatttttgaggggcaacactgccacctactaagaactttacaagcgacaacctccacagtgcatgtggtcttctttttccttcacagtgggtcccacccttctctctcctcactttttacctcctctcctctctctccctgccttccccaaccaggccacaaaactgctccgtctagtgcgccgccggcgcctcccacacaccgccgtcgcccctctccccctccggatctggcggcccgccggcggcgacacggcgcgggagccggaggcggacgaccctgaggcgatctcggcgaagggcgctagcggcggacgaccccgaggcgggctcagcggagcgcgccagcggcgacgcggcggagacggcggcgcgggtggcgacggtgccgaggcagccaccctctcctcccccgaagcggcggcggcgccgccgcgctgcttcggcttcgccttgggcttcttcgacgaggaggacg

SEQ ID NO: 540 - DNA, 8124 bp, Oryza sativa
ttcaatgcaagaaagcatcggcagcaattgctcctcccgtttagttagtgtcgtccatggcctccaacgaaggtattcttctcttctttctcaaatattctgtttctcgcatatatgtttgctccttttttttccttcttctgctcgcttctctcttcttctgttcgtcttggtgatgacgaaactgaaggagtatttggtgattgaatctgcagaggccggattcccttctctcctgtgggatgaactcaacgacgacgcggggcaggatgaactcgacgacgacgcggggcaggatgaactcgacgacgacgcgagcgcgggagaacgacgaaacgaggtcacgacctccacaatgcgcgcaagtgcccgttcctcacgccgctcgccctggatttggccgaggaacacgtgaccaaagttggacgcgcggacttgagaaaagtgtgccagaagctaacgtggcaaggaatctatgcgctggcgcagtgaggctgaacgccacctcaccgcattgtaaatggcctcaggtcagttggcatcagctcatcatcactttgctgagcaaaaagagacctttctcttttccctaactaaagaaaacataaatccaatgttttgatcgttcatcttatataaaaattattttaaaaaattaataacacatataactactaattatgtttaatcatttaatagtaataaaaatattaattataaaataattttaaataagacaaacgatcatatattaattataactttcctccataaaaaaactcaacccaggagggaaagggatatgactctcctgtaagtccatattgtttgttttaagaagggttacatctcctcatttataggccggagggagggagcactcatctataggccggtaggctaacaaaatgtgaaattcaattgtaatggcctgtttagttcgtgaaaagaaattatttgggtgtcacatcgaacgtttgaccggatatcagaatagtttttcggacacgaatgaaaaaactaattttataactcgtctggaaatcgcgagatgaatcttttgagcctaattaatctgtcattagcaaatgtgggttactataacacttatggctaatcatgaactaattagactcaaaagattcgtctcgcgatttccctcctaagtgtacaattatttttttaatttatctatatttaatactctatgtatgcgttcaaaaattcgatgtgatgtttttggaaactaaacagggcctaaggctgtgtttagttccctttaaactttcaacaaatccgtcacatcaaatgtttagacacatacatggagcattaaatgtggacggaaaaaaaataattgcacagttttcatgtaaattgcaagatgaatcttttgagcctaattacgctatgatttaacaatgtagtgctacagtaaacatttgctaatgacggattaattaggttaatagattcgtctcacagtttatatgcgaaatctgtaatttgttttgttattagactacgtttaatacttcaaatgtgtgtccgtatacgcaaaaatttttacacctaaactactaaacacagccatagttgatattgcaacgtaggccctgtttagctcgcgaaaagaaaatttttggatgtcacattggatgtttgaccagatatcggaaggggtttttggacacgaatgaaaaaactaatttcataacccacttagaaaccacgatacgaatttattaagcttaattaatttatcattagtacatgtgggttactgtagctcttatggctaatcatggattaattaggctcaaaagattcgtctcgcgattttcatgcaaactgtgcaattagtttttccttttatccatgtatatgtccaaagattcgatgttacgtttttgggaaaaaaaattagaaagccgtgctcaaaactaaaacacgttaaaagaccatcacgtaaaatcagatcaggaggattcttaaatttaattatctcatttctcctaatcttctcctgatttccatgcaaactgtgcaattagttttttcttttatccatgtatatgtccaaagattcgatgttacgtttttgggaaaaaaaatttggaaagccgtactcaaaactaaaacacgttaaaagaccatcacgtaaaatcagatcaggaggattcttaaatttaattatctcatttctcctaatcttctcctgataccttcttcgcttccttcctgtaagcacaagaagctagaaagggacgaagggttttgcaaggtgttcctagggtcggaccgtcggactgcctctcgattctttcatgcatttttcaagtaaatatatttaaagtttatagtagttactccagtacttaattgatcataagctaataacctacatcgtttggaacactatcttagatcttccaagttagtacattgaacttgaacccatgaatttcagatggaataattaatgtcaaaagtccttaagaaaaaaaagtttagcctgaaaatcaaaatcctagtgtaagttgtcacatccaaacagatactgaaaatcaaaaaaaaaaaacaagttgaatcatacagtattcaaagacgatttacttatggaattttccattatcatctagaaaagcttatcgaaaacagacactatgggccttgctttagggtttaaccactgaacagcactatcacgaattccactacgtactctcttgcagcgaccaaggaatcttgtcgttttgtgatgttcaaaaaccgaggaaaaggggttatctcatccctggaagaatctcacagagtcatgtgcaactgtgctcttgggtcttgacgacgcagctacagtctactcctatactccctccattcaaaaaaacaaaccctggtttccgtgtccaatgtttgaccgtccgttttatttaaaaaaattatgaaaaaaattaaaaagacaagtcacgtataaaatattaatcatgttttatcatctaacaataataaaaatataaattatataaaaaaatcatataaggcggatagtcaaagatagacattaaaactcagagtttaacttttttttcacggagggagtacgtagtataccatgtcagcaggctcaaactccacccaaaagaaaatgaatgcactgtgttgagtgctgggtgatactactacagtagttctttattactgtacagaactacgggtactggagtaaaagatgaggccaaacacacagtgtcatcttgtgaaaaagttactactatgacatatacacccttcgtccgaacgtataaacatttttgaatttcaatataggcccagtttagcttttaaaataaaatttttcacactatcatatcgaatatttggatacatgaataaaatattaaatgtagaaaaaaaccaattacacagattatgtgtaaattgcgagacgaatctttaagcctaatcgcgccatgttttaacaatgtggtattacaataaacatttgttaacgacagattaattaggcttaatattttaactcgtagttccttggtgggtctataatttgttttgttattagagtacgtttaatacttcaaatgtgtgtccgtatattcgatgtgataaccaaacccaaaaattttcccgaactaaacaaggccgcacagttttcgagatgctattttgacttacagtatctataaaagtaagatattttaaatgaaaagagttacattacatattatgatagtttgttgaatgataaatctaataacatcaattttacatgattgatgtttttcttttttatttgctattaatagccaaagtaaaaaaatgtttgattcgacactattttgaaagtgcttatattttgggaccgatggagtaggatagagctagctacgcatatactccatctgttccgaaatataataatctaaatcggatgggagattttcttatactacgaatctagacatataatttatctagattcgtaattatagaaaatatcatagatttatggatctggacagataacctatacagattcgtagttatagaaaatatcatagatttttatattttaggacgaatgtagtatgatgcaactctttactgtgcatgtatatagctttcaatatgggttttgtgatcagcccttacactttttttctataattttctaattcgtttgtagtcttaattttgtactcttcatttgtacacctaccccacggtcccaccttgacctctccgcctaacccctctcgcttctcccccaggccccagcgtcgtcgatcagcaagcatttgctgttgcgccgttgaggacctctttgcctcctctcctcttatccggccaccgccaccaccactgcctctccaccacattggtcctctcttcagcacggctccgccgtggatttcatcgccatgacacgagacccccgccctccgcccatgcacggcggtggtggctgggagagaaaaaatagaatggacgaagaagagaaggagaattgtcactaacatgtggacctcacctttttttaattttttttaatttgtcacttacatgtgggacacacttatattttcaattcctttgatgactaggctaccctcacaatagaagaaaagagatgcaaaacgaagagtaaagaaaagaagagaatatataacgattatagccgtgcatgtagtaggaagaggaaagaaagtagtacatcgcatttatacatttacaatctatgtggttgtagtaatactttttaaaggtattatatttgctcacagttccggcccgtttgatacccgataaagcaaatcttggtttcggttcccttgcgatgggcctgggcgagggggaacatgttaagtatccgcctgggatcatgttttcttaggtctattctagatgtacaatttcatttcggtagtcattttccattttagttggaaaatgcagttggatgtttaggggactataagtgaccaagggggtggtaactcatatcacagaggaaaactttgcatagagttcattacgattaatgggtggctccgagatttcttgtgagcacaggcctaacttattctttgagagtggagcctatcaaagtactcttgagagtaagatccttgactcctcttcattctccacaggggtctctgccaatttggaagcagggcaatgatggataagatcattttaaattccttttttcatcattttgatatagggggatgggggataaagtgggcaaaacatactcacatttttcaactgaaaagactttttcgtctcgacaaagaaagaatcatcttgaaaacgcttctaacctcttcgtagggacgtcacgacacttggaccaaatcgacttgtcacgtcagtagaaagcgctttccataccacataaagagttaatttgtaatagtttttaaagttggaggagatgttatacccggttttatagctgagggatacaaattgtccaaagacaagagataagagggacaaaatagactaattccaaagaaaaatggactctttaattaatgtaggccataaaagtccactgtactcatccctcgattgcaaaaccaaccgagtatagagtatcccttactatcaaaatttagtcccttagcagttggggtggtgattttgtctttcgtggctttagaaggcgacagtacggacgagccatgggcccttcacgttctattaatcctattaagccacaagttacaacttcttttccggaaaccaatctctaaagaactccagggttaagcgtgcttggcctgaagcaatttgggatgggtgactgaccggaaagaatgtcagggtgcgcacgagtgaggacaaagtgtgtagaaaagtctatgacctatgaaagctaccagatataagcgggcccggcctcgatgcgcacgagtgaggacaaagtgtgcagaaaagacttgtgttggtctgtgagggcagtctatgacctatgaaagctaccagatgtaagcgagcccggcctcggtgcgcacgagtgaggacaacaaagtgtgtgagggcagtctatgacctatgaaagctaccagatgtaagcgagcccggcctcggtgcgcacgagtgaggacaacaaagtgtgtagaaaagacttttgttggtatgtgagggcagtctatgacctatgaaagctaccagatttaagcgggcccggcctgggagaggtgggagggcagtctatgacctatgaaagctaccagatttaagcgggcccggcctgggagaggcggtctcccagagatggccagagggcagcgccggcggtagtgaggcgatttttttgttttttattggatttttacaagcgggctggatgattttcaccgtcgttggtctgcaggcggtccttccctccgcccgtaaaaattgcttttggccgcatgcaaaagtgatttttctagtagtggtggatggaactctactcaattcatagttataaggggtgtgtaaactgaactatttccagttttgtatccaaaggacgcgcatgcaaagaggcccaaaaaattagacccaacaataactcattaacgtggaacaatggttgccttttctttgcgtgtggtggggtggggtctttgtgtgaccagaagaggcgaataggaaaataaaatgggaaaattgacctagtggcgacaattttttttaaaaaaacccgacctctacatccaactataaattttgcctattaaacagagaactaaggctacgttcgtttccagggttcctaacttcccctctcatttttcacgcgcacgctttttaaactgttaaacggtgcgttttctgaaaaaaaaattctatacgaaagttgtttaaaaaattatattgatccattttttttaaaaaaagctaatacttaattaatcacgtgctaatggaccgctctattttctgtgaggaaggaattaattcccattctaatgaaacgaacacagtctaagcccttaaataactgatccgaaattcgctcctataaaaatttgaacttagagaactttgtggtgctactcaggtggcgacatggatggccagagaccgccggcgccgggccggatgatgtgccgcccgcccgcccggctggctagttcttgatcacttcgtccactgcatggtcaacgcgacgcagggcacgaagctgaaggcgatgtcacgacgccagagagctagcccttgcttcctccgtaccaaagtgtaagtaatttttaaggttgatataagtattaagaaagtagataagaataattaaaaaaaatatgtgattggttgagaatataaaattgataaaatataatagttgtaattggttgacagaagaaggtcggtggagaaataacttttatttagaacaagataccgtgtaaaaaatagctatatttttggaactgaggttgtacatgtacctgcaatcaaggttattaggatcgggatactaggtagtatcgttttgctcaaagtaatatcgtatcgtaggatcgtatcgtagtatcgggatactatgagattttctttttttaagtttaattaatatttatattaattatatatagccattctatataaaaaaatatagtaatgatatatgtcatgcaaatagagacatttatcaagagaaactatgttggttttgatatatttaactgattttcatataaatttgagcatatttatttacattattttcaaaccatgttattttaaataatattttgtagtatcatagggatcgtagaatcgggatatcacttaagatttcgattttataggatggtgtagtaatgaatagtaggatcgagatactatgaaaattaggatactaagtgggatcggtatcatttcggcttggtaggatcgtattatcgtaagatactaggatacgaatcaggatactgacaaccttgcccgcaatccgcgttgctgacacccccgcttctcactcagagatggcaatggggcccgttcaccgttcacccgcggtgaattcacctattaggtgacggggatgggtaatatctattcaccatggtgaatgaaaattgtccaaagttatca

SEQ ID NO: 541 - DNA, 1300 bp, Oryza sativa
tctcgtgcgcgccgccgctgtccctccccctcggtcgacgcgccgccgagagcatcgccgggaccagccggtgtcgcgccgcccggcgcttgcagccgtcgccgcgccgccgggagctgccgtcgctgcgccatcgggagccgccgtcgccgatttgtgtttaattgctcaagcactgatttgatgtgtttctttaaccggggacggagtaaccacgggaaaaaattcaccgcgtggtgatcgggactggtgaaaatatagccccattgtggttgacggaggcggggacggtgaaattttatcaccgcggtgacggggacgccgaggtgacccccgacggtgaattcaccggtaccatctctactctcactgctagtacaaaatacaacacgacgcatgaatcgcggaaccgatcggacggcggatgcgctaggtgccgttgcactgtacctaggtctagaaagcgagaccggggagagaagctgccgccgccgccgccgccgccgcgctcatgctcgaggaggaacaggttgctaacgggcgacgacgacgacctgaacgccgtcgaacgtacgcggcggcggcatttgctcgatcgagttaagagagacatcagtggagactgaagagagacccggtcgcatacgtcatacgtctatgcttcctttttgaatgggctcatttgagaatcgaagcccatttctgtactcgacaatgttgggccaactatcttccggcctatgtggtataagttcactttaggtccctctatttgtcggtcagtccgattttcgtccttcaccacgaaaccggtacgacccatcccccaacttgtgaaaccgggcaaacgaggtccctcggcagtatggagggtggtttttgccgacgtggcatctacatggcgcctacgtggttcctttcactagttcttcgttccacgtggcaatgacgtggcgtttacgtggcaattttatctccaaaaaataataaaaatagtgggacccatatgtcagctacataaaaagtaatttaaaaaggtggggcccatgtggtcccacatgtcaccctccctcttctctctatcccccctctctcccccctatacactgccaggagagaaggttgaccgccggcaccgaggggccgacggagcaaagcggcccggcggctggcagtggacgaaccgatggtggcggcttgccggtgggcagcgggagaaatcggagctgagcagcggcggggcgaaatggagctgacagcgggcggtgggcagagcgacaagggcgaagaggccggtgag

SEQ ID NO: 542 - DNA, 605 bp, Oryza sativa
  unsure (1)..(605): unsure at all n locations
cgaattcgagctcggtacccattttgatgaaaacaaaaggaggagattgagtatatcaaaagccctcaaccaattacagatccgtttcgattttgataaaaacaaaaagaggaggttgagtgtatcaaaacgccttaaccaattttgggaaatcgagaaatattcaaccggatttgataggaatgatcagttctggtatcgtacggacatagaactgtcttccggaggttggatacgacagccgaccatgcgagctgagcctacagctccacttgtgggctacatcaaagataggcaagtagagaaagatagcggggtgggttgggactgaaaagtgtatagcaataaaaaatattttacccgttgcaacgcacgggcattttttctagttaggtggatgtatggacggcccatccaataatcctcacggtcgcatgcccccttgcgtccaaaaccgcgttgcctgtcagcgacgcctgtcttccttcgatagaagccagcaggtgtaaaggaagccaatctgtttccacagcaaagacctagaaacannnnnnnnnnnnnnnnnnnnnnnnnnnnnnnnnnnnnnnnnnnnnnnnnnnnnnnnn

SEQ ID NO: 543 - DNA, 2188 bp, Oryza sativa
aaaaacacgtattagatatgttggttcatgacccatccaacagaaacgaaccaccacccattcagttttccccatttttcggatctggagagaggtgatgggctgatggctgcggtgctcagaggagcagttgattggccacgatggcggcttggtggagccgctcagcgacggcagcaacggcagccccggcttggagcggcggcggccctggctaaaacgtcaaggcggtggccctggttcgaaggagcagctcagcggcggaggcggccgccaacttcgtggcttgagccggaggcgaggttccgcgcgattcgattcgatttgattttcttttgtgtgtgttcattgacggtaacaatgacggtagcgttttcttgcagcggcgtcaatggaagccagctccacgatgacgggtgaccgctgttctccgcccacggtctccaccgggatcccttcagacgccaccaccctcctcgccaacccttgccgacctactccacccaagccaccgtgacgccgctccaccggcttcactggcgttcagctctccaccgccggccccgtcactctgcgaccccctcgccatcttcgacacggtggccgcctcccgctccttaggatccccgagtcaccaccgcccttgatgtccgccttggccatggaccattgaggaggaccgaattctgcattggtcatttgtctttgttttaatctttcacatgctcattgtttttcagggatgaatacaatggatcattgtggtaggcctgctcctagactgttgtcttcatgatgcattcaacacctcgttccttgctccgatcttaattttaactttagtactgaattcgtctatgcaacgttcaggaaattggaacaagaccaggtgagcttctgtgtaccattattagattgaggccctaatgattgcgagtggtggtggtcatatacaatttcttttttggattgctacttatagtcctgcggcctggatgttgtttttgcgatgcattaatcacctaattttcatactcatatgaatttttatgtggccagacatgaatttgtgtgtgcagtattgttagaaatctgctcacatctaaattttcatttgttcagttatcaggagttggcgcccttgctgtagaacaacacctgcaacatgcacatactctgttgtttcttcgcatcggctgtttttgccaatgaggcggggatggcaaccttcacatctgccgctgcctgactacctaactgctatatctgcatgttttttttggaatacttagataattaactagtgaatgctctgaattttacttgatgcgagaacttgcgttggaggcatagcttgatggcacagcagttcacaatgctctgctttaaatgttcatgttctgaactttttgggttgagcagattagttaagagtggattgctccaaataggttagctgaattttgttctactgcaggaatgctctgaataaattttgtagacttgatatttggattaaacccgttattttcaagtttgtatatttctatgcctcattgatatgcttaaatatgacacccctcacttataactgttggctaacaataggcataataaagtgaggttcttatgaagcattttatttcttctttagataattgtatctcacttagagtcatttatgagtgtaaatcacttagatgatttaatctttttttgcaaatatccaggtggccatgggatgcctccctagatgatggccgtgggtgatggatatctgttgatggggaggcctagagaatctgcagcactttgtcagcttgattcgatatgtggcgccggagtcgtcctactcgcgggattcgggcaagggtcgacccacatcgttaggcctgatctacattgttggtgttgttgtaatcttttatttgtttttgtgtattctaccaatatatcgcattgtgtatgttgattagatagttgttgtaatactaaatcttgttcaaacatttctcggatgttcatacatcttttactcaagcagtctgggactaagaacaatcaatttactcatttactcaaggaaggtggatcaagaaaaacataaaataatttatttactaagataagactagggtaatttttgttgctaaatcaaaagtttatacttctaacttgagaataattt

SEQ ID NO: 544 - DNA, 483 bp, Oryza sativa
agagatagagcgtatcttcagaaacgatgacagtcgactcatctcaaagcacccaccctacttcagagacttcatctatcgtctcaggaacatggaaatcatctttgatgccctatcgcctcggcataagctactcatcgagtcacacatgtgctttatgacttctagctccagggtatcattcataattaaactctactgcaagtacgaaggtgccaatgaatctgatgaacccaagtgggcgactgcaatacaagatgctcgtagttcaagtgaatggcgctcaaccgtgtctcgagtgatcatctttaaggaccttattgttagagctgacaaagctgaatcaccatatggatcgacaaggtttgaagccttcaggcttgttagaaatgcagccatgcatgctgcagaatatcgattcgatgtaagtactggttatatatattactgtgcaattgatcgattagtgtttttattattatt

SEQ ID NO: 545 - DNA, 4124 bp, Oryza sativa
ctattcaaattatacaacaaaacgagtccaatatcgaatatattcggacaccgtgatatttaaaatttctggacccacatgtcatatagacacgtctcgtatatattcagtaaaattgtgctacaaataatattctcatataaaattaaatatccaataatttattatttcttctatgaagttttagcacaaaaattcatcaaacaccagatgaaaagaaccaaatgctgataacttgttcaattgtgcttacctggaatctcttgcattacattcacttgtttcttttgcattacgctctcttgctttgccttctgcatcatttgactccgtagccgactacaccaaaataaatggtaaagcagcaaaaacacaagatgattaatgcaactagctccagattgtgataaaagaagcatatgtacataagacacactagtcaaataaagtgtgaacttgttcagttggctgtcttaatgcccagtattaaattttgcttttcagcagagcaaacggtcatcagactgagctgtagtttttgacactgcaatcatcattttcttttatatcaagctgtgatgtttataattggtaattcgtaccaagactaacttaggaccaaatttattaaggtcatgtgctggcaaatcagtacaacgttcacgaaatgacaagctctactagttgaactgcacagaaaatagagaatgtaatgcaatttactgaagaggcaatgacaacgtattatagaagagtacaaaaggataacaccaagttagttactgcttgaatcatcgttaacaggaaaatagcatggcgttcagacaaatatgttcatgtctcgacacagcaaagcaatcgccgaagtactattagttagtcatttagctcataaagacatgctatgtttcaatacagccaatttgctagccatttaaccaacgtgttccctttatgttggaaaacaaacacaaagtagccagtgctaacctaaagaatataaccaaacagaagggacacatatcgaacctttggatgggattctttctcagatacgaggtgaagtggctggggaagaagtattcgccgtgaaagactctcttataggccttgcaacgggagggtccttgtacctcttgcactttctttatttcatcatcatcttcttcttcttcttccacctggatgtagagggtgggcagtgaccgcagcaccttatttgtcatgtccaactcaacgatccaaaacaggaactcatcatcgatcttttccatgagcaggaaggaaacgacacctggatcaaccaagctcaggtgagaaaaagtcggcacagcacgcggaagagcacaggtgtgacctacggaattagcacaaagatcccagaactcggcggcttccattgtaaaatccagttcccaggtcttttggtcgatgctgaccagagtccatgccgtgatggtgaaagcaggagggtatacatccttgtctgcggtggcgccaatggtgacgcagaccagcttgataaagaagccactgtcactactacctctaacacaaacacagcgaactgggtcggcgcagtaggactggctgaacaagcgggtgctgccatctctcaccggtttggggagcgggatgaagctgaattgatgtggctcgtccccagggttgaggacgtcgatgagcaggatgccctggtagtagtcgacccagcacaggaagcggtcgtggagggggagcacggcgtcggtcctccactcgccgaggttgaggccgagcatgctcatggcgcgacggacacgcaggggagtgatgctccactcctccgcttcccctgattgcacaacacagagctccacctccttgctcccactggatgtgaggtgcgccacagtgaagagcgaccggccgtcctcgccgtcgccgtcgccgtcgcggcacaggaggccgacgtctcggctgcacatgtagcgctgccgctgctggtggtacggctggtacaactcgtcctcctcctggtcggtgaagccgccgacgaagcaaggcggcagccgcgtgagcaacggctgcgaggagggggaggcggagtaaatgaagtagtcgagggggtagtgcccatcgacgttgaacccgggttcctcgaaggggacggcggcgacgaagaggatgcagccgcggtgggcggcgatgacgtcggggtagcggacctcggggaggtcggccggccactggggagggcagtggaggtagaggcgggagacggcgggcgggtcggcgacgcggagggaggcgcggacggggaagccggtgcaggtccggccgaccttggacgccgtgatgtcctcctcctcgtacttgtgcctcctccgccagctgcagcggacgtacgggtcgaggacaatccagtccgccgcccccgccggctccggcgatccccggccttcttccatgtcgccgcgccgcagttcggtgttcggttcggatcggatctagctagggttttacctcccactcccagatgtctcgccgccggctggagtgggattggaacaagggaaaggggaactgaatggggatatttcctcgggaacgggaaggaacgaaacggatcccctcctgttgaattttttttatttatacatttttttattaaaatatttacaaaaataattttttgtttcgaaaatttacaaatctaattgcctgccgcctttaaaaatcaccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattattttttaaatattttaataaaaaaaagtataaataaaaaaaattcctcctgactttggggggtggaaagttacggtgtcgctgcacttggtttcatccctgccgaccagttcatccaacggcacacatccatcttccctcctgcataccctattcatattgggctacccagttcggcctgcaactgtggccatcggcttgcccatcaggccacattgactttgttgcctgctaccacatgcgcgaatgcagattttctttatttttaattttatatttattaaaatattttgaaaaataattttctattcgaaaaatttatacagaactagtagcccatcgccccgacgattttatcgacgtggcagacgaccattagccctcgcctaacgaccggccaccgagagcaccgaaaatttacaggcggtcccattgccaccctcccagagggtggtttttggctctaggtgcccgcctataaaagggctaggagggcggcttggagtcagcaaaccggcatggcttcgccgcttcccttttgctctctctctctcgcccttccctccttttggattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttg

SEQ ID NO: 546 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnntcctcgccgctcccaactctctccagcaagctgcacccaccacatgtgtacatagtagcattcatcaccattcccctgataataacaagtctacgtgtcgcgtttttatgctgattcatccatgctgtgctttgggtacaactttggatataaactctccttattttctcctaggggcggagttgaatgaaatgaaggaggatgtcactggcttactttactttactttggattaagtttagactaatacaaggatctgaatttggactgaagggatgcacatatggtgaaaattgatgaactatatagttaaatagtttttggaccggatttatgaaccccccctccctctatgtagctctgcccttgctccctccggctgggaaagagaaaaacagaactctcttatacttgatctcacgtgaggtaaggagctccgtaaagggtagtgagtgccggttgatggtttctcggtgcgttggagcagaaggctggagagtggttgtgtcggcggtgatgacagcctcagtatggtctctgcgcaacaaggctcagcaagcaataatcgattctaacatcaaggtgggtaccgagctcgaattcgcc

SEQ ID NO: 547 - DNA, 965 bp, Oryza sativa
ctgccatcgcttgctgcaatggcgaacaccaaccctaatcctcaccgtttcctatgtgctgatcacgtggttcatcaaggaggagtcatgaggattccccgcgttgatctcatagctgctacaaagctcccaaaacaccataaacagtatgctttggccttgctggaacggttgattcctgagaacctctggaatgaccattaggtaactagtacgtaccccgctgcgttgctgcgggtttaatagatgacttaatacataaatttttttgactcaaacaatgatgaaatgggaaattaagtgccttctcaaaatcataattttagttacatctatattcagatctgagatacgtacgattatcctttacagtgtttatattgaaaccgtacatgcaagcttcggtataaatgtagctgtagtaagtagcaaaaaaggggttgcaagtagcaatatgtatactgcatacctgtacgctgctaacctggtcaattgatctattccattgtactgtatcatatcatgattcatagaaaaccaagcacacagataatacaaacttatggtcacgtagaattacttggagattatactcgcgcctttgatcaaactgagaacacaaaatgttttgacagtacatctctctagtaaaatccaaacatgatttcttggttggtggaagaggatcaatagtcatccacatatcgatgtgttcgagagggataggaaagcatgtggaagaattgggaatggaacagtaattaggatccgtggagggttgggatggaatgcaatgatggtgattaaagccatgaagcctccgtcagtcactcaaaaacatacgccagacaatggtttcattgtgcaggaagatggtcagatggggagatttacgtggagatagcaagaccgcaggaggtgtttctaggtctttgctgggaaacagattggctttccttacacct

SEQ ID NO: 548 - DNA, 583 bp, Oryza sativa
ggaatatgagaaagaatttcaatggacacagagatacagccggacccccgacagagctaacagggacagaggtgcacaacttagtgatgggaataaccaacgaatttggaaaaaagaggaaagttcgaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatga

SEQ ID NO: 549 - DNA, 43952 bp, Oryza sativa
  unsure (1)..(43952): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcatactactgatgtcaaaataaattcgtctgctgtcgtatcaatcttgtagccaaatgcttattggaaacaaatcacactagcggaagcaataacaagctttacagattttcaataaagaatctaaatcatcagttgaagttcaaatacactcaatggagtcttttgcaaattcgacaaacatactaacataatctcttcctaagaagtccaaagaatccactaataatcatatatgcactactacaaagcacaaacatggaagaacatgagctaaccacacaacgaattgaagtactgaaacgactagctactgtaataaagagtaacgcgtgggaatcagtactcactttgtctattacagctgactgcttgccatgataggcatgtggaaacctcaagcaagatatgtggaattctctcatttgcatgcaacctgttaccctgatgacgaaatagtcatccttcagcacctttgcgatcttcccaagcctccacgaattacgatccaaaacctcagttatgtcaccaagaacccatctgccttttctcataccaactggccgatgcgtcctaacatcatccttcttcactgcaggcatcccttcagcagcaaagtttagattgctatccctaaagttatgtagcgttgtaccttttagtttcatcatctctcactaagaacctgaccctgcttacaaaaggcagaccattaggaaagtaaaagtaagcacttgcactactgaaagaataacaaaacatgaatggataagaaaacaaagatgtcattttgtcaaagtatatataactgtatttctaggtaaagcatacaagtgggataaagacactgtcattgattaaatcactccaaagatctgctaaattttatttaaagaagaaatctaggagaccttacagtcaccgaataaaagaactaccctggaggtatagtgctgagtccaatcagattagtttgcaaggtaccccactaacttgtaacatcatttgttgaggccatagaacaacgacggaagcaacgcagcgctcattgaatcaggcaacacaatatagaacaaaaggtatgggtgcacagttctagcatcttgatgtgaaagtacgcaagtaaattgaccaaactccaacaaaatgcaccagattctcagttggggttgtgttaaacattcaagagttgacatgaactacaaaagtatttcattaagtatggttcgtggacaactggtacactatcagaagcaagatattgtcccttattcggagatgcgttcacaaaactacttaatgaacagagcaaatccagaatgaacaatatcagaatctggaccgacttctttttcccttccatttttagcaatcaaacggaatcggaccaacttctacagctcaaagttggaagctgaacaaagggggagcagatgactaaactgcaggactgtcacttatgcatcatttaagcttcacaagtccaggactccaggtacaatctatactataagagcttccagtttccatgctctgagcagccatggcttgtttccttagtacaaaaggaggcctaagaaaagcccctaaatcaactagacattctacctaagccgttaattaaccgtgtgaaaggattcactccctatgaccctatctactgcattttaaccaaaattacctagaccatgattcagacaaatcggctatccttctgaattctgattttgagccaagaactaggaacatcttatgatatccggaagtacattcatggaagaatccccagaaaatggtagtaacttttttcctaggaaaagtcaaacctcttctaatctttttttttctgaaactgaaaacctcttcttatctgtcagatggggtagaccaatcaaccaatctggatcagatggcacacaacttcacctaaaaagcatcccttgattccataacattgaaaagcccaatcaagatttcaaggagcaataatagtacagtacagcagctcagatcggaaccatgtactcaaagatctaatttggaccacactaaatatgcaaaaacaggagctttaacgtaagaatcaattaaaaaactagttggattgattgaatctgtgatcccaaaatttgtagcagcgaagtacaaatttcatctcagcccaatttcccttgtaaaatactaagcttcagagtggaaagaaatcagggcagattttgatccttttttgaaactaagggcagagttctagactatgaataacaaaacattaggatcttagtacacccaaaaactccttttttacctcagtttggtgaaaaaccaaatcagaaggcatcatcgagttggaatcacgaacaacagcagctcaagtcggaatcaccaacacaagaaactccaagatgggatttttaacgcgcaatctaggccaaaatgtaagagttggagtacaagaaatccaaagaaaccagcatcaaaccactcctcacctgcaacaagaagccaaccaacggataaactcgcctcgccgatccaagattctcaaaatgaaaacagttttcccctctccagattaaacaagcaactcctaaatcgggattaacccccaactcgtctgttcctccaatccaattcacgcaagaaacagaaagaaataaagaagctagcaaaaaatttcgccacctccaaacgccctaaaatagaaacccaacccaaaaattatgcgaaaaagaaaaaagaagatcagaaatttggtgcatcgaaggtgaccaacctcgagaggagatgggaggattaatccggcggccaggaagaaatcggagcgcctaattccgtgcctaaccgtaggagaaaacggtgtgctggctttgccctgtggattggctgtttctttcagttcttgctttcctgttccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgtagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagcaacctgtacacctgtgggtagacgtacgtttcttggcgaaagtagcgccgccgtcgttgcagccgccatcgccgcggagcagatcgatctactggcagcgttcggactgatggttgcagactcatttccattgacatcgtcgactaatgctgctgatccgtcgcatgtcacgccgccaccaagacccaccgctgctactgagcagattgatttgtttctgaatctaggaaagatggctcctactacgctgccgcacctctatccacgatgaagttcatcgcctctccgacgtataccacgtcgccgccaccgcctccgtagtcggatagacccacgatttcctagtcatcggatatcaaccatcatcagggccaagagaaccgaggtgactccagcgagcaccttcgtctcggcgagggaggccaccatggtggccgccctgggccgggacacggctatatatggaagtggacaccgtggtgtctatggcttccataggcattatcgtgacggttggagaggtgatcaccatggtgggcatggacaggaacacatcatctctcacattggtttcctcccgccgctgccgccaccacattatcctttgtcggagtttctgccgccgccgtacttcggcgcataccatgaaccaactatcggatacgcaccccacagcgaatactatggatcaatggtcagccatgcacacccaggtatgtgagataaggaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaaatatatattgatattcagttatacataccctatatgggacacaccataagtttggtgcattctttcttttatttatttatactgattttctttgttatatgtaggagaagtttggtgtatttttttttaaaaaaaattatactgactttctttgtgatatgcaggatttgcctctccagattaaacaagcaacttctagattgggattaagccccaactcatctgttcgtccaatccaattcacgcaagaaatctatacctacttaaaaaatacttaaggcttccgatcgtccgcttcgtccgtcgtcgtcgtttgagtctgagcccgtctttaaaaaaaatccccttgcagatcagccgattgctcccaacccctttgcccccaattcccaaaatacatgaatgacaaaatcactcaattgcaatcccaaatccaaaccaagaatccccacaaaatcaacatcccaaatcaaaaataaaatccaaaccctaaccctagccgtctcccggagcagccctcctcgtggtcgccatcgtcgccgtcgtcgtcaccgccttccaccgtgaattatcactggtaattgtaatttctgaaaaagattgatctgatggtatcatggtaatgctcatgcttctgctaaattgatttgtttgtttatcttttgttttgttttattttttaatttttttttgtcttttgtttgagagacaagaggaagtgaatacagtctgtgtgtcactccttggtctctctccccctgccttattcggtcgttcatatctccttatttttattttttggcagaaaaaaagagaaataagttaagttccatgaagatataattataccttttgggtgaggaaacccgggcaaatattcatggatttgttctcaaaagattatgagtaaccatttggctactttttttatagttatgaaaattgatatgaagacttgtggttgacctatcttagttcttgcaaggctcatatgttcaaggtattctatattaagatttgtaataaaatacataaaaaaatacacattacttgtgctagtctgctaatttcttacttcctccatcccaaatatagcaacgaaggactagatgtgatatattatagtacaacgaatctggatatatctgtccaaattcgaatatggatatatatatatatatatatatatatatatatatatatatatatatatgtatgtatgtccaaattcattgtattaggatgagtcacacccagtcataggttgctatattttgaaccgagagtacaaattagtactttctccatcctaaaaattttagtactaattagtactaaatatatcctaattactacttccttcatattcttataagttatatcaaatatgatattatttgatactatgttgctatatttcaggacggatagagtatttgatttattggaaaagccaaaaacaaaattataccaaatggccatagattttatccctttgcaagccaaagcgagctgagtttatccatgtcatgataactttgctgagttggagatgatgtgttctatacggtcttctacggttgcacgtgcatacacacttatttgtcgtattttaggacatacactagagcaaagcatatctttcgaatgttcgtgtgttttatcagatttagcatcaacagttatctacaagattttttttatataaaattacgtcttttacaatattaatttaaagaaaaatacttacagtgcatgcgtaagactaatcgatccaatggggtcatgcgctcatttatattgatattattttattgtacctgttttggtattagagtttacttattccaaatctagccaaatgtggggcctccgttctgataaagtaaatgtaatgcacctgggtgtttcctaacatcctgatcattggtagtataaattttacaatattattttttttttcaaaagaagattcaactccaataataaaattttagggttaatatgttagtataaatttcatgattttgaaatatatcattactattcaactatttgaaaccatgtcattataccccttcacttttttttttaattttcagtaccaaattgcagctgtcttcttattttatccccttcttccttcctagtctattttctataaatgtactgtaataaataaataaataaataatatatatatatatatatatcttcattaatgttcattgaattaaagatttggttttgttttctcattgaatttgaagatttcgttcagatttcggatttaataagttgaagatctttctgactcatctatataaagcggatgaaacaggctagcaaaagacacacaaaacacgatacctcttcccttccccacttctaacatggagaacgtttttactcaatctgcactactctgtgtgttgtttcttagtagttcaatagttggaggttgctctcctacaatggaagaagaggtacttctcttgagctatatatattgttataattcaaattcgattttattcaactgaaacatagaagtaatagctagtctatattgatttgttccccttttcccaaacaattaaccaggtccaaaagaattggcgaacattgatggcccctctacttcatgtgaatttctcttcatcggatcatatatcaactcaagctgacccagtatattatgtgagtgtcatatactccttccgtccaaatataaaacatagttagaaatttgttccaaaataatgcaactcatatcttcttacctatcatcgatgaataaatcgataaatttctttcaatatcccatcaccgtacctactaatataactttcctattaatttggggcattttggttctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggtttcatttggatttacaatacggatgaagcatctgccgtgaataaagttatagctggatggaatgtaagttaaacttatctgcttgatttggaattgtaatttcaagcctacattagcttagctggttgatgctcaacaggttcatgagcttctcactgtcaatcgaagatgtgtcactaaacaagttactttgattaatcatttgctccatgtcttttagttttaacatttagttgtattgtacctcatacaggttgagcctgaatcgtacaatgattcacagacgcacttcagtacttggtttgtaagtttcttcataaacactgcagtttcctatccatcaatttttatttttattttttttgccataataaagattttgaatttattatgtcataactcattctccaattaatgccagattgaaggttctaatgtttgtcctgatatgcgttgtcctggattcgaaagtgtatttagctcagaaatcgttcctggaatggtgattagccctgtttccaccacctctggcaagaaacaatacattacagtcagagtatccaaggtttaattattgtctaattaataacagaacaatcttacattccttttttttatcccttcatatataaaatggaaatagtataatgaatctggacatacccatgtctagcacaacgaatctagatatacctatgtccggattcgttatactaggatatgtcacattccatgctggttgagatattttagcacggagggagtatgcgtcatgacactatattttgatgatttcaggatcaaaattccggtgattggcaaatctactatggctttaatggggatgccaagcttgcaggttactatccaagatctctgtttacaagcttgtcagataaaccagtgacaatattgtttggtggctatgccttgagaaaggatcaaaagccaagtcctccaatgggcagcgggaatgccccgtttaaaaacgccgcatcatttcgtagtatcaagttttttgatgccggtggcaacgcccatccaatcgattttcgtctcggatttatatcaaattgttacactatttctgttattgaaaatgatgggttcttttatgggggacctggcaatatttgctagtagtttgtaatcgagcttcaacttagtgtaatgaatatcctggggactgcacccacagagaaattgagcttcaatagagttcatcacaactgttgtgccactcttagttgataagtatttagcctcatcgtttgacgtattggaggaaaaaacgaaatggcatatttgcaaatgaaaaataatttgtgaataaaacttttatatacatgttcttaacgatctaagagtaaagactgaaaaataaactatggaatgaaaaaaaaaactcaaaatcagctccaaattccaaatttaagattaaaaaattaaattttggctgataagcataagtggaaagatcaagatacaagattctaatatactccctccatttcgaaaatataagcagataaggagaggaaagggaaaaagaaaaagaagccgaagaggaattacatatgcgtcatggttccttgcttttagtttcactttcacttttacccagggtatttacatactcactccgatttgataattcatgtcatatagacagcgacacattctccaaaacctatctttgaatataattttctattataatataaaaaccttaataagtactccctctattttatattataagttgtttaacttttttcttagtcaaacttcttagagtttgaccaagtttgtagaaaaatatactaatatttttaatataaaacaaatatattattaaaatatattcaatgttcaatttaatgaaactaatttggtgttatagatgttgctaatttttttataaatgtggtcaaacctaaagaactttaactaagaaaaattaaacgacttataatataaaacggagggagtatctaatttaatttgattttttaagtctcatctacacatgttgtcccagtgccttaaaattaatatttcaaaagttgctaattgtcaaagttataaaagtttgacatcacccttataaaagaatgataggaattataaaaacaaaaggagtatgtgacattatctttcggatactttcatcgtaagtgatccctcggagtggatactttcatcagaagtgatctctcaaaaagagagaagaggaggtgtacacttggcatggttgcataaggtaaaattcatatcttgccttttgcttggtcgagctagctagcccatgtcaagccagctcgtatcacaccgtagaaaattaaaccctactgtcacatagattatgagaaaatatatatagagagctatagaaatatagaatctagaaaataaataaaaaccatatttttttttatagattctcacaagctatttctcataatccatagtttcctaaacaataccaaaacatctaggtacttcaacgcgcaatatatatgcaaaggaaactactccttcgtgatgattaaaaaaaaatagggtcatcgaggccaatgtcatgggctcacggcgacattaggatggagtgccgccgcaaccttcttccggccctacgcaaggaggcaggtgccactgtcgccgtcgtccgccttaacctcgagaagcaatttcctccttctgcctctaccccgggaggctgccgtcatcatcgacttggatgccgggaggccaccatcaccatccacctcaacttcgtgaggccgtagccgtcgtctgcccccaggaggcacccaccactgcccccatctactaactccaaagagaacaccgccgtcggctgcttctagcatttcaggtgcctactactcctatgtatctttttagttcatatattggttacttaaggacagtggcggatccaagaagatataattagataaagctatagcttcccttcaaatgcatatatgataaaaaaaatttagtcgaggcttcgtagggctcccatggtcctattgcaagtactctatctggaatggtcggagccattgtattttttttgaacctggaacggtagcatgcatgacatgtgacttgtataagaacactagctatcaggtgctaatgaaatattttactctaaactttatgtcattcctatgcttgtgaatagcgacagacaatcaggtatgagatatgtgccattcacttggaaaaaaaatatatatgacattttacattcaaacatcaaacattatattgatcaaacaattaatatactagctgagctcgtttggccccttttcgaattactataatgtaaccatacattgctgatgagcatacctgtttttcatcgtaccgccaacaattacctgaattttgttcgatcggatagtaccagtaaattacttttactccatccatcaaatcagaaagatgacaaggaatctcatataggaagcgtacatgaacatatataagaccatgatcccaaataaaaataagccagggaaagaaatatttttatttgggatatttttacttatctttaaataaaaataagttggacatataaaaggttcaacgaaagaaatattgatttaaagataggtaaacatattcaatgtgcaacttatgtagaatctgaacattccaactaaatctagaagtacgacacagtcaaacgaacgaaagcttcacacaatacttagggtgtggtgtgtttgagagcagtggaaaggagaagattgagaagacaagtaaaacgagataagtcattagcatatgattagttgaatgttaattattttaaaccaaaaaatagattaatatgattttctaaagtaactttgctatagaatgttttttcaaataacacactattaaagttcaggaaatgtgcgcatgaaaaactacacaattttcttctttgttttggctaaagcagccatgcgtcaagcacggcgtggatgtggatcacaggatcgtgggaataattaactatttaccactcttacaaatggtcatagaggatttgtcactatacccacatatcatagatacatgaggacccatatgttatagacaacaagtggcaaatccttaattaccatatttagaagtagcaaatagttaaatggcccattctcttttttttttcatctccttcgatacatggaatgtgcttgctattgagagaatctgtttaatgagaagacgaaccacatcgccactgagccgtaccagagtatggacgctgtttgcgaggcacatccacacatcggcgctaatctccacagcgtccatcctagtttcgtgaatctaatctatgatttacaatttatttaactaaacaattattaattaccgtatataaaaaaatcaggagaatatcacagttccaaaatggagcttaaacattggcatccttaatatccatgcttccttctgaatcattctctaaattcgtaaatgccaccaaacaagatatagggcctttcggctagcactacaagatgccagcacggttcgagcctcacttctgggtctgttcggtggcactggctgcagcagctgcgcagcagcatcagctacagtggctgcagcagccagccaacagctgttgtaccctgtagggcttgtaggggagtagttttttctgtaggggctacagcagtttctacagtcgaacagctgggctgtgcagcacagcccaaacagctgtgaaaatgggctaccgaacaagccctctctcactacgagagatcagaaggagcgtgtttaacgttcaaaaacacacaagatctttcccatgtgtgataatgtcttaacaaattctgatcgagagcccctcctcacatatcaagtgttttttttgcacactctatcagcacttaagtattagtttcctatgatcacctacttgtatttcatacttttaaatagactagaaaaaatgtctatgcgttgcaacgggtaaagactattttaatcttattattgttatatgttttagttaagataaaatctcctgtgggaacttatttggttatatatattttttaagaaaatcgtgagctgcaattaggagtccgatcgtctcaacttagcatgcaagttttttaaagagaattattgtacgattccttttatatttactaaagcaaacgaacttaaaacctacatatttctaaaagcgaacaaacttaaaaaccgactcatgcccggatgagtaccaaaataccagcaaaaacatcttcaatttttataataacagagattagacctatgcattagtttccagatcacctatatgcatttcacatctttaaatatatcagacggccaactaaagagactagctttctcaaatgcacggttctttatgaagatatacaaggaaaccctacatgtaatgtgatttgaggctagctttctccaatgaacggttctttatgaaggtatacaaggacttaaccctatatgtaatgtgatttgatttcaaattatttttgtttaatagatattcatcaacaaataggaagaacatcatacttcatgggcataccagtgattgacttactgaaatcactatcatgtcataaactcatccagatggcacacacactgaaaatgtgacccaaacttctccaagggttgaatattaccatcagcattaatattatagtgatataaattgttttccgcggtccgatttgtaccatgatgaaagacataccacacaaatttaataaatgattctaaaatacgatgatagctaacacacattagttgtgtttcaatctggccccgtcgtgctaatttttttgtcgtgtttcaatctggccctgtcgtgctaactttttttgtcgtagcttctcctcttcctcctctaataataatttactaaacttttaaaaccgtaacgtatttaacatactaggacttaattaaagtaagtagagagataaagtaagaaactaacaaagtataagtagagggatcaaagtaggacattgagaaacaagttagaactcgagtatttgtagacttaactacttgaggttaaaatataatgttttcattttgttatcagcttgttatactgtatatattaatctaacattgattgtgcagtgcacaaataaaatctccctcaactgttaaatgggggctaatttatcttccttgatggttgtttagattaaattttcgatacattgatttggttatcattttatatggtggccacatagcgtttacatattattaccgtaagttaaaagatatccatgtagttattttaattaatctaaaagtagaccataccgctttcaaaagtgtttcttctcattaaaaaacttaaaaaaaacaaaagaatcaacagtgcattaatcctcttcccccttaaaaaaattattcatgcctcttaaaaactatgtcctaaaatatatctctaaaaaatataaaaacctaatacatcataaaaaatcattttagaaataaactaaatcatatttttatatctagatcccattgtaatgcatagccatttaactattaaattgtgaaccgcaacacacttgaatagtatacatagtgcactatgatcattggattcataacaattgttaatctctaatttatccataaaaaatatcattttatatcgttcaacattattaatctttatagcattctaaattatgtttagcaaaaatatgtttccagttgttaaaaaactagtcaaataccttatataaataaaatatcattaacaaagataatattgattatttattgatgtagaaacatagataatatatattacagagcgcacacacacatgagcagctgctagaaactcccccaaacagaccctttcgtatgagccctcaccggcggatcctgatccccttcatgcttccttaatggccccacctcctatacttccccctccccttctttggctcgcctccatctgcaacatcgggctcctccgcctcggtctctgcctagcggcgcagggggctcgccctcaaccagtcgctcgaccacaccgctgtggcaagcctggaagcagcagagggaggcgggtcttcgttgataacatggtaaggaggaggtggaggtggatgtggatggaaggagtatgggggaggaaactttgcccatgcaaaccctacattttttttacttgcaattggcatgttaactctacaacttttcttttattttttagagaattgctacgtaagccccatgtgtggaccaattactcacgataaaggcatgcaagcaccatataggacaaagcaccatcaaaactattgaaggaaacaaaatgaaccggttttattacttgaggaagtcacactatctataattggggatgcaaacttcggccaatagttttgggaggtaaaatatatttctttcattgatttttttcagccaattcggttaaaggcacccttattttatttattttctttttgttgtttttgcaaatctccttgtttttattttaattatggaaacatatatattacacctcaactatcttgtttatctataactagggatgaaaacggatcggatacggacggaaactagctttatcatattcgttttcatattttttttcggaatcggaatcggaatcgaaaactcggatacggaaatgaaatcgaatattatcgaatacagatacagagcgaatacgagacggaacgaatacggtagcggatatttaccggtatataaaaaacccctcaaattgagtttcttgatcaaggaagagatatcgcttattattttagttcaacatctccaacatttgtatcgtcaattttatagacggtcccacaaccctatgtgagaatcgattttcatggctattcctcttagagatccatatgcaaatatgattatcattttctattcccaagaccttttactagatgtataacttacttaccattgtataaattggagatgttatttattttactttacatcttcaaaacttgtaatgtttgttttatactttaaatgctttcaaatacaaatgttataaactacaaagtggtagatcccgttgagctctataactttgatatggaacacatctccatcagatgtcgtttgaattgtagatatgagattttataaaaattaatatggtatattataatgaatatttagactcattaaatgacctcaaataataaaatagtcaataagaaaattgtaggtctcatcaagctctacaatgttgatataaagtttgtctccatctgattccgtatgaaaaagttatgtatatatacatgttttttctaaactttgctcaatgtctgcggatatccgaaaaaaaatccggatagtttccgaccgttttccgattccgacggatagtacccttactgtattcgttttcgtttccgagaaaaaaaaatccgaattcgtttccgaatccgagaatttccggatagttccgaccgaaactatccgaatccgaaaaatggtccggacggatggaaactatccgaaccactttcacccctatctataacaactttcaactcccatactatatattatttaacttgctatcactactttaaaaataatttttcatggcggccaaaataggttttcataagtagccagtggaaccgccagagaccaaaggccaatgataatacaatattttcattggtgttcgccaaccgccaacgccgatccattttcattggtggttttcgtaaggtagccacctacgaaaataaatttgcacaggcggctatattatatcgtccgcctgcgataatctagccagcactaaaaaaatgacggagcgacgtcgctccgtctgcctccattagcgccaagaatcccaaaatccgcagaaattattcccaaatcctcattccctaatttccatcacagttaacaaatccacaaatcatcacaatttatagtcatgaatttccattcacatgttttcaactgtatcaattcccatctccaaataaactaaccagataggatcgtcaattcatcatcgctcccggtcatcgtcgctgtcgctgagagacgaataccaaacactagttgagcaccgccaccgcacaacggatctgggagaggggagggggttggaggagccgcctggaaccttctcgaggaccagccgtcatcatcgttgccgtggcaaccatcgtcatcgtcgtggcagccgtcgtcggatccaccttccggccacgggtccgccgccaacgcccctccctgccgccggatccacctcctccaccgcaaccacccctctcctttgcctcctgcaggccgaatctgtcatcctccccgccgcccgcagcccaaccctccccgcaccgccgcagctccccttgccgccgccaccacccacgattgagggagagttgggaggggaagggagaggagaggtggtcggtgtatctcggaggtagggagaggtgggagagatgcggcggagaggaaatggacgacttggacgtagtctccacgtgatttatgcctcccacaatttttttatggtgatcgctcatagaccccgccagtaaaatcgatttttactagcggggtgctcataagacatttttattagcggggctaggtttttagtatctcctgtgatttttacaagtgaggttttttagatccattagtaaaaataaaacccttgtatcacgaaaataaatcgttttttaagtagtgtatgtatagctagctaattaaggagtcactttcctcgcttcttgctagctggggaccggtctgccattttctctggtcagtttttagatttttatttggcatttttaggagttttgcgtgaggtagattagggtttatcgtttaatattcttatggaggtagatttgtttagaatcttttgtctctcttacctatttgtcgattgccactacatttacgaggtcctcaatgaagatccatccatgaaagtttgtttgttggttgccgatgatccaattgacagaacagggtttaaggcctagaccatcaatttgtttggtgatgctgtcttataggtttgtcaaatgatcgaatatgggggtagatacttgttcaaatactcttccattcttctttatatatatcacgtcagttagttcatatatttagggatggaggtaatatcttttacgcatacccgaagtctcggtgaattgatgcgttatgtctgaacacgtctagctactcatgacttttacttgacttttactaggatgttactagggccctatttagatcccaccccaaaattttacgccctgtcacatcgaacgtttaaacacttgtataaagtattaaatataggcttaaaaaagttgcacatattacgactaatttgcgagacgaatcttttgagcctaattgcttcataatttgacaatgtggtgctacagcaaacatttgctaatgacggattaattaggcttaataaattcatctcgtggtttactgacggattctgtaattagttttttttactagtgcccgaacaccccatacaacaccctatataatatctgatgtgacacgccaaaactttacatcgctggatctaaaaccccctagatacggatcatctttgtgctggcaagtactttttttttcttataacaaagggcttgtttagttggtgaaatgaaaatttttggatgttacatcggacgtttgaccagatatcggaatggggttttggtcaagaatgaaaaaactaatttcataactcgtctagaaaccgcatgacgaattttttgagcctaattaaaccgtcattagcacatgtgggttactgagattcgtctcgcgatttacatgcaaagtgtgtaattagtttttctttttatctatatttaatgctctatacatgtgtccaaatatttgatgtgatgtttttgcgaaaagtttttgggggaactaaacagggtggagtttattttttttcactacatttggtggagttttttttttccgttataacaaatttgttcaaactagtgcggttttcaactatttggcacattttatttgacgctgatgggagtcgagagtcagcaaacaaaatgaaattaaaaaaaaaatccgtgtcctatctcatactcctacctttcttctagacttgatcaccgcatgctagccaactcaactacatacaagtcgactaccaagtcacccggtatttgaaacgtattccaagtagttgtgtatagtacgcatcgtgaaccttttagataaacccctaatgaaattggagtgccaagtgccaactttctgaccatcacgaggtgtacttaataaccataaaatttctccagttcttttcttgcaaaaataatcacctcctttttcatattttacttggcgcgcgcggggtatcatattctctggttaaataggactccctccgtttctaaatatttgacaccgttgactttttagcacttatttgaccattcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccgacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtgggcgaccttggcccgggtggatccagcaggctttggacggttgtgatcaagttgtggcggatctggctagggtttcgattttaggaatttttattttttttaacaaatttttcttttcacagtcaccctaattttcgcatgtggttgctacctgcatgtaaaaatttgattttcgcagacatctgagtgtaggcagtgctactacaaaacacctgataggttacggctcataggtgccggtttagaaatatggtacctatttacagtttcccacctctatcagacaaaaatccaagataaaaaccgacatatagtatatgtgttggtttttttatactataattgccagttctagataaaaaataatacctatactataattgccagttctcgcttgcgggacgagagattgttttagccaccttcccactcctgccattatccattcgcccgttctctctctcgcctacgccttcctctctttttcttctctcacctgtgccgtttcctctcctttagctctctgtcttcttttcgtctctccccagcttttcctctccaccggagcctctccctggcggctcgccttgccacggccgacgcccagtagctagcggccagcggattcatcggcgacggcaagggcggtggtacggatgccagatccggcaggcttgagcttgagggcctctggatctgccccccccctccccgtgcggcgccctctagtagatccgtggtggcgatggcggtgggctgtagcattccctcaacgtcgtcaagtgcacgggcgacgatttttgctgatttgtggatgtttttgtcgttgattttgtgtatgttcacgattttgtgatgacaatcgatcagtgtggcgatctaattttgatttggggatttggggcaacgggtagcaactcgatgcatcgacttgaatcgagccgatttttttttttttgcctagcgagcgcctcgaaggtgctggttgcgaaaccaacaccaatggctcggagtcatctgtgccgcgtctgttgtgtcggtgcccccatgtgtttttccaaccggcaccgatgacactttctgtagtagggcaggttatccacccgcctgcgaaaatcgattttgaccgcatggaaaaaatcgattccatagtagtgaactatactattagatatggtgcatctttgtgctggcaaggttgtttttcttatagcaaagctgtaatcttttccgatcctaagtataataattcactcttttatgtatttggcacctttcatccatttgacgctgatgggagtcaaagacagcaaacgaaataaataaaagctgagccctaccctaccttctcttcttcctctcggttccggcttcataatcatactcctcttcctctctctagccggctgcgtggcggtgggtaattcctattgagtattcgtgggtgggtttagtctctcttgtatgctatagcctacttctctattttaaaaaagggataattacattcttgcacctactttaaaaagcaattgtgttgaatctatcatgaaaagacatatatgcccatgcaaatttatcttacttatctgaaaactttgtggttttggccatgttttggtatcaagctttttggtagcattttgacaacaagggtttatatgatttgcatgaattctgaaatgcgaactttgagtattggcttccaatgagccaataaatctcccaatcacaattggtgatgcatttttttccaaatttcactagtactcctaattaaaaagaatatatcagatatactaaggctgtgttcgggaggaggggttgggaacccctcctctccggcacgcaaaacgaagctagtattattgcatgattaattaagtattaactaattttttttgaaatacggattaatatgattttttttaaaaacaactttcatatagaaagtttttgcataaattacaccgtttagtagtttgaaaagtgcgtgcgcagaaaacgagagagggggttgggaaaatgggggaaagaacacaacctaagcaatggttggtaactgtctaacaacaccagtactccctctgtcctataaaaaacgtttatgtccagattcattttattggaaaacgtcacatcatgtcctaggttagcactcaaagtttatcccgttcccatttttaacacttctatcaattctcatatcattttccgtccgctttgattgctattgactcaaacacgcacacgatataacatttctacccctcattgccatgcattctacgagtactttttaaggttgattccataaaaattgttttctttttgggaggaagtactaaagtacggaaccatgatcgagtaccaactaccaagtcactgagtatttgaaaggtattccaagttgtatcgtcaggaatctcttgaacaaacccctattgaaatccgaggcctaacaactctctcacgatcacgaggccaggcccataaaatctgcacggttcaattcgtttccttaaaaaaatcacctcctttttcgtattttcttctgactcaagtcaacagtagaaaactcttggcgcgcgaatatactacataattaacctcagacgtccgcctcgcaacgacaccttttcgccctgcagatgagatcgctcttcgtgtctcggtcctcgatcgcccaatcgaatccgctgcaacttcaagcagccactgcccactgatccactcgagcggatcatatcgtccggagctctagctagcctcattattgccgccgtcgaagtggctgaggcaaagagccaccgccgccggctgccggagcggctcgccggagaggaggaaggcgatcgagcgaggagagactgcagcagcagcgtcgacgactaaacgaggccaacacggacagggtgggtttcgtttcttggccttttatttttcttttattttttttggttttcaagatataatggggtttttcttggcttgatttgaggtggtcgccgttcttgagctgatttgtcaggatttttgactggtttgggaattgggatgtagggattcgagattttgtggttttcttaggagggtagtgcggctctgcccccttcctttggggtcttcttgggagggtagtgtagctctgcccctttcccgctgactggagttgcgtttggccgttgaagtagtctctttgtttttctgctttctttttgtttgtgtttttttcttccttcccatggcataagccggtttggctaattgcttgtataaacaaactcttatttcttttaatatattgacgtgcaattcttttgcgcgttcgtgaaaaaaaaagattttgtggttttgtggacaaagtttggatctttgtttctttcgtaatatttgttgctgcctcagattacccctttgttgataattggatttcatttaacttgttgtttctccatcctaaaatatagtaaaacacaaccatcactaacacgatagaccaataaaatttattgtgacccccttcccccctcctccccaacccaaaatcaccctaacaaatataatgcatgcatcaatgggttagaaatcacgagtgtaagagacacggtatctaggtacccaatgttatgcctttgggccatgttacacaagatgggccaggtggcctaaagcccatgcagtgtggtggatcaaaggtaaggtgtaaatcttattccatgtaaataggatttttagaaaccaaatttagaaaagggagaggtggttgttaattgcatatatgcatctgcgccttgtattttgaaacatgaaacaaagtagtgttctgtattttgtaattgaagatttccaaagatcatttcagcagtagtaatgcatgattttcaaaacttcttttcttcccggactgccatgtcaacaccgtcaaaaccacgtttacagatgcgacgttcgggtatttataacaatttttaataatagcacactaatagagttactcgctctgtccacaaataagtggtcctaatacaagatgtaacatattccagtaatacaaatttagacagactgtctagatttgtagtactaagatatgtcacatcatataataggtgtatttattttggaacggagaaatcaccaactaccagtagtaaaatttgctgacatacgagagggataggtgaggagagagaaatatcaatgttaagcttaatatcatcttttagcccatgataaaagtaagttttatagcatgaaggtgggaaaaaggaaggatggataatataagaaaaatatttaagcgactattgtctcaaccattataaggtacacccttcgtttcatatttgttttgactttttcttagtcaaactttttttaagtttgattaagtttgtaagaaaatatagtaacatcttcaacacaaaataaatatatttaatgttaaatgtagcaaaactaatttggtattgtggatgttactaaattttttacacacttagttaaacctaaataaatttgactaaaaaaagccaaacgatttatggatgatgtgtattgtctcaaagcctcgtggaggctcaaagtattgtgcatgcctttatcaaggcgatatatatttagaaatttttttcgtcaaattttgtttaaattccactgggttcgtctatgactgctcgattatatattacagttatctagaaaaccgtcagggccggagaggttttcgataacaaattacattcttaaaccataaacaaattcaccttaattcgtttgaacctaaggataaattggaacggttttagaaatggaagggtggataatgtccagtagaacagttgagggattctttttctacaagcgtgcggatagtttaggcataatatggatctgttcatttaattttctaattggactatgtttggcagcggcacaaggaaaaaaactcactcgttttcttcaatatgtatttttgcaaaatcttcggtgacatgaggaagggggagaataggggaaagagagaggaggctgacgtggccacgctgacatatggggttcacgtgggtcccacgctgacttagccaccacgtaggataaaatcggggtcaaaaccactgaataggggtgaaaacggtacggaaactttccggattgcatacttattttcgaaaacggaatctgtcggtcggaattttttcggaatttttcggaaacggaaacaaattcggaaatattttctcggaaacagaatcggaaatgataagggcggtttccgtcggaactcggaatcggtcggaaactttccgaaaattttctcgaaattttcaaatattttctcggaattaccagaaattttgtgactaaaataccctggattctttttttaagcactaaatagtgaataccatggtgtttggctggtattttttaaaaaaatatttgttatgcaaatctaaaattacataagaatattttttcctacattgggattattcaacaacattactcttttaaacatagataatttattcaattggatttatcagtttgaggggttttttattccgataaattttcgttaccgtattcgcgccggtttgttttcgctccgttttcggtttcgataatattcgattctgttttcgtatccggggtttccgattccgattcccaaaaaaatatgaaaacgaaaacgataaagatggtttccgtccgttttcgtaccgttttcacccctaccactgaaggacctattgtgaccggttttgattagttaagggacgtcagatatctggttttgtgattgggggacgattttgtaacttgatgacaagttgagggaccttcggtgtactttttccctaataggttgacaaatttctttcccctttgttcctgtcccaaatatagatggccaaaaggctagggacccgatggctcggcccaggaacggcatgacccgactggtgtggggcccgtgctagaccaacccgactgttgggccgtgcctgggcctctgcctcagcatggtccaatgatcaggtaggaaaaatagacttatttgagccatataaggcatgaccaaagagatgagcgatgcaaaatagacttattccatccatataaaacacagctcaaagagataaggaaggcaaaatagacttactccaaggaggagcacgggggatttcgtgcctccggaccggccagcacagcctgggtcttattgggccatgcctaagccattggtgtagttcgtgggcaggcccgacccggcccagtgtgtaggtcgggccgtgctggcccgactgatcttgggctcaggcctggtcgtgcccgggccagaccgggcggcccatttgaccatctatagacccaaactatatgagattcttatataccttttgtttttagatcgaagcaatggtttctatgggtttcttcctacagttaggattcgtaattcttctagaaatataatatggagtaattataattaccatggtaaaaattgtcacaaactatggggcattgattatgttcccttttttttttttacttttgtgttacctggaagatgtccatgcgtaaacacacaccactatatacgcaggcacatgctacaagagatagaatgttttgtaacagttgattcttttgttgttacaagttttttgtgccaaattaagtttcatagccatggacctcacacgtcatgctcttattcccctgggggctaaggcaagatggagtaaacaaattcttggccacatcttagcgaacattagcaaggtggtgtcacaatgtaaattcttattgaaattgcatatgtgtagtgcagccagtgcttctccgactgttttctttcttgaacatgcataaagctaaaacaactttatctcacaaaaaaagtgctaatctatataactaattgtatacaacagatggcttggtgtcaataatatttatgcgatgaagaatttggtggaactatattatgagagggaaatccagctgtttgtcctcgtcagcttcgcactccaagtgttcctctttttcactggcagccttcggcggcgcagcaccaacatattcctcagtgtttctatttggacagcttatttaggagcagattgggtagcagtttatgctcttggcaacctctcaggagtacaggagagcatcatatcaaggagaagtcagctgccactgtcttttttttgggcaccgtttttcctcatccatctcggtggtcaggacacaatcactgcttttgccatggaggacaatgacttgtggctgaggcatttcttgaatttggtcgtgcaagtagtcctcgccgtgtacgttttcttgaagtcagctagaaggcagagtgcggagcttatagtttcgggtgtgttcgtgttcatcgttggagttatcaagtatggagaaaggacatggtcactcaagtgtgggagctcaaaaagccttgagagctcacctgggcatcactacaagcaacggtttccggaactaagagactctgattgcgactatcgaaatatggtttccaatgctctatgttcaatgttcaatgtcctcaatgtctttgcagcgcgcaacttgttcggttatagcttcccaagtgttggtccagatgatactcaagtcgacgccaaaaaaatgttcaagttggtggagcttgagctcgccatgatgtacgatgacctctacacaaaggctcttgtgctgagaacaaggacaggcattatactccgatgcatctctcacgcatgctccttcgttgcttttgcactcttccttgcgagtgataaagatcggtacattggagttgatattgcaattacgtattcactgtttatcggaggctttttcctagatttttgtgcgatgtttattgtcataacatctccatggacttgggtctggttgaaggctgcacagaagagagactggctagccaacttgtcctggttcctcttttccagtgatattgggtggcccgagagaaggccactgtggtctagttccattggacagtacagcttactcagctgggactctggatcagaccaaccaacaagatcatgcaaccagaaagtgatggctctggtgagaagatcggcgaggttagtcggcgttggaaagaaaaaattgttttggatgagcaagctgctggacactaagttcctagaggtagatgagaagacgatggagtttgtggtggaggggatcaatcgcatccgcgacgaattctccgatgtcgcgtcccgggcatggccaaagcttggcccattcctcgaaaccataagagttcatttcaccgcggactttggtgctgccattgtcgtgattcactcattcacagaggagtacctgatgaatgctgctgctgcagcagaagaagaagaagaagaagcaggtcagggaggagaagcaaatgatatgatggaggtgtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccatgcgacgaaacgttgagggagatggtggacatgtggacgaggctcctcatctacaccgccggcaagtcccgggggccgatgcacgcggcggagctggcctgtggaggggagctcatcaccttcgtctggctgctcatggtcaaggccggcctcggggattccgaggcgaaaaggatcctcattgcaaattctgcttgcgccgacactaatacgaaggaagcctatgccttttatttcgcttcgtgacgtgtatctatgtaataaccatgagccgccggtcagaccgaccaaacacctacggtgtcagaccggctccgtgaaggaataacagttatttccaaattttagtaatgtttttctattttgaatatgatatatgtgttgaatttggatgttaacaccgtcattcctgtattcaaatctttggattcacaaatgtacattattcctgatttaattgaggcatgtagcttggcagtgaatgcccatgatgggcttgcaaaggcatctgccatttgtccagagatatagcacgatctaataactgactccctggacaagcttcccttgagatgtgcttctatgctctcccactaaaaaaaaagcatggatttcaaagaagacgagaggctaagattagaaggtgcttaaccgtctgaaaatcaattagaaagggtactttcgtccatggagagaattaatctcgcatctgatgttggctccttcggcgccggaggccaatacgctactacagctactcgatcattgcccagatcatgaatgcagaacagaagataactggaagaaaaattaacaacgaataggatcatcgatggtatagcttgatggagcattcaacctgatatatccatctcacagttcctactcttcgtctgaatgcggttgcacacttgcactggatggccatgaaagaaaaaggttctctaggacagccaattgacgcaaccccctaaaaagacgctccacgtcgcccacgcgcaggcagctcgtggcgaaccctagctgccagccgccccctcccctcctcatctcttcgtctcgccaccgcattggagtgcgccgctgggagaatcgggcggcaagcgaggatgacagtggcggggctaaacctcggtgacattccgcctccggcgtgggggaggaggcgcggagcttggaagctagaggacgacgacggcttatctggcgtgaggcagcggattcggcaccgccccaaccggatccggtccccacatagccagattcaacgtccctacttggatctggccggggagcaaccgaagtgggtggtggcgtgcggggacaatctgcggcgagaggttgtggacgacgtggtgaggctggaggccatggacagcacggcgggaggcagtggtcggtgcggcgaaaccggtggtgtcaacaacaacaggacgatgtgggcggtgccgatggtaacaagaggctggcacggtggcaccagcggctgcagggaagcagtgaaggagcgacagagctggcggctgcgcggggatggagccaacggcagtgggaagctggcacgagtggccagtagtggaggtgtcggcgacgctgggacaagagcggccagcaagcacgacatggaggctcgcacctgatgagtgcggcgtagaggcgacggggctagtaggagcggtgtggtggagaggccgcctgggcagcaaagacggcagcgatgtgaccaggtagctcgttgtggacgacacaggcaaccgggccaaggcagcgatgatgttagtgccatgaggtcggcgttgatgactgcagttagttcctctccaagcgtttgcccccttgcagatggccacgttgggtgggctagtgcgggggagaggggatccatccttctctctcaccctctctctctccaacctgtccacgtggatggatctggagtgcgtcggaggctgagatcctgctttgatggctagccgacagcgaggtgttggtgcagtggctgcgtgttgaagggatttggctggtggtggctgctgaacctaataggcactcaatgacgcgggagtgttgtccaatcccatcttttttttcatctctttttttttgggtttgtgtggaggttaccccttgtattgcatgaggggtggctcaccttctcttttctcacttatttcttctacctcatcattcaattctatatatgtgacattttcaggtgcaacacatcaagtattatagtacttgccctaacacgtaggtgctttgctaccatcctcactcctcatatgcctccctagggtgtgtttggtagtacaggtttccaaccgggaacaatacgcgcgaaaaatggagcagtccattagcgcgtggttaattaagtattagctaattttttttccaaaaatggattaatttattttataaacaactttcgtgtagaaactttttttaagaaaacaccgtttagtagtttgaaaagcgtgcgcgtggaaaacgagagagatgagttgggaaaaggaggtgccgaacacacccctagggggtccctccctgtgtgagcagccatcgacgcgacaaatgcctccatccattgtgtgaacaggccacgtgatgccacctcttcttcccagctctcaaagctataggggttctatctcacatgacctctcctctccatatcatggccttagggtgtgttcagttcgtgaaaagaaaattttttggtgtcacatcggatgtttgaccgggtgtcagaaggggtttttggatacgaatggaaaaactaatttcataactcggctagaaaccgcgagacgaaacttttgagcctaattaagccatcattagcatatgtgggttactataacatttatggctaatcatggactaagtaggctttaaagattcgtctcgcgatttccatgcaaactgtacagttagttttgtttttatctatatttaatgctccatcatgtgttcaaagattcgatgtgatgtttttgggaaagaaaatttgggaactaaactagtcgagtggatctggtggaatttgaccattggtagcttctcgtccttccggtagtagtgtaaaatagcaaaggggttctcgctggttagcctacttatccaccatcttcgttctcctccctttcatttcattctaggacttcgtccttgcgatattcattctcctgttttcctttagtttgcctataatacttgtgtagttatggatattgtgcatatcacaagttgcgataaattttgagggttcaatgaaattgagggtaaagcctgtacaatatatccatgttcctaattttgatacatgagcatgccatctttcatttttttaatataaactagccacatgtcttattcacgtgtttaaggattggcattgaataatattttttctctttttttacattgattagctatagttgccacacgatttaatgcccctcgaaagtacctctactttcttatagagacattttataaaatgcatcttcacttctagagataattcaccaaaaggtattttgaaaaatgcctccattgcattgtagaggcattttaaaaatgtttctatagtattaaaaagatgtctctacagtgcatttttgttgtagtgtttgctggatcgataaacaagcaattcgtgtggatcaaatagcagtgcccaattccatttaaatttttatgattgttgttttataggtgcctttctagtgaaccgaggttaatagttggtcagccatatattcttgatgtcatgttattacagcacagcagatacctgtaaacttttcattgtgatattttgcatatgaaatttacaataaatatccttgtaacttgtgaatttcacagagataatatatggctggaattctgattgtttgctaatgaaaattttttgacataaatgtagaaggtccctttattttttgccaaaaataaataaattgtttgcagatgtgatttgggtggaacaaatagataatttggtggagtgcacatacaacttgacaattcttacatgccaatctattgcagcaacctttcccgtctagattatattatgtgtagttttgacctcattaatttggcggtaaagttcatttttcatcctgaactataaaactcaaatgcttttcagtggttgtgtttgaaatggatgtggttttcctattttatactcttactgtgcatatttttatgcaaatatcacttacttagatccagagtcgtgaaacatacctgattgaagttcatactatatcaaattgatcaaaaccaccatgaattatgaaatagggagtagaggtgaaaaataattggtttcgtagtttagggtggaaaatagattccaagcaaagttaagggcaaaaaatagagtttacacttaatttggtttccatgtcctgttcttttgatggactggcctcatctttccgagaaatcaactcaaccacttaccaaatggtactgattttgtaaaggttactgaattgttagttgcactgaaattgttgtaagttttgttgatgttttcttaaacatgcatttcatcaaggataggaattacctgatgagtacttagtattgtaaccatatcgataagtagaattaactacagaaggaatagttgaacagaaatctctgaatttagatttacaaaatcgctacggtgctatgttacatttgtaatatctacaaatgttttcccaaaaaatgggagaagatagattgttagttattaatatgacagtgtaactcaatttagtataattattatggtatggcctgtgattgatgttttgttttcaagctttggttctatgcaaattttaatgttacggggtatgcttatgtgtcgcaaatgtagacttttatgttcaataaaactagtcatcttgttatgttagcttttttgtgttattgattttgatttaagttgcacatataaacaagcaccactgtcttttttttttacaaagttacagggtgttcatggtctatttgttgcccactggaatgttttcttaaaagagagaattcttagagacttcttgaatcatatcacttcaactgcaatatgatattccagcttcgattagtataaatgacaatcttgttcaacttcttacaactgtatatatggcgaagtattacacagatacggttacagtcaagagaaaaggaaggagaaaatctgggatatatataggggctggcagctatagaaagcccaaatcatatcagccatgcattatctcttatcacaggaagattgctggttattaatcctaactctacttcatacatagctttagattataaagatgtagggaacaacaaacaaagctactcaaatcagctaaagtactaatcaaactttcaaactttaatcagttgaaaaagaacgcatatgcttccttcaaatcagctgcagcaccagcagaatcagcagacgaaatggacgatatggtggacgtcagccggacccttctcctctcggattcgccgagcccttcccgggccatgagcagccaggcgaaggtgatgagctcccctccgctggccagctccgccgcgtgcaccttaccattggacctgccggcggcgaagatgaggaaccgcagccacattgctgccatctcctccactgcaccccagcttggttggacatcctcttctagtatcatcttgtacatttcctccattgttccttgccttgacacaccatccttattctgctgtataatgttgtatagctcatccagggtcatcttgcttccttgttgtgtcctagacagttcctctctcgatttcgcaaactcaaccacggtggcttcggagctggcattgagcggaagcatggaagggtggttgacaaagaggtacatcatgtagttggacagttttcggcacacctccaccatatcatctgcatctccccctccttcgtctcccgctgccgcggcttctactgcattcaaatatacttgagtgaatatgtgcatcaccacaatagcacatcccatatctgcgacaaaacagacccgtatctttttcagcaatgggccaagatgctgccattgttgttgctcggagacttcatcgctcaagctactaatcccctttacgacaaactccatcgtcttttcatcggcctccacatgctcagtgtccaacgtcttgctcagccagaacaaatcttcttttccaacaccgactaaactcgacaatcttctcactagagccaccactttctggttgtatgatcttggctggtctccaccagaaacccagttcagcaagttgtactgtccgatggaattcgaccaccgtggccttttctctggccagccaatatcactggaaaaaaggaaccaggacaagctagccagccggtcgcatttctgagccttcaaccacgcccaagtccatggagacattatgaagataaacactgcagaaagatcaaggaaaaagcctccgataaacagcgaataggtgatcgcaacatcaactccgttgtacctccgtttgtcacatgtaaggaacagtgcaaaagcaaggagggaacatgcgtgagaggtgcatcggagaatcatgcctatccttgttctcagcacaagagcctttgtgtagaggtcatcgtacatgattgcaagctcaagctccaccaccttgagcatttttttggttccctgtaccgtgtctcgagcaataacaactggggaattagattctggaccattaacaaatgggttacgcgctgcaaagacattgtggacatttagcattgaacatagagcatccaaaactaccttagaatagccatgatccgaatcgtttaattccggaaaccgtttcttgtagtgatctccagttgagctctcgagacttttaaaccttccatacttgagagacagtgtcctttctccatacttggtaactccggcaatgaacacaaggacacctgaaactagaagctctgcactgtgccttgctggcgatttccagaaaacatatgcagctaggactacttgcaccaccaagttcaagagatgcctcagccacaagttgttgtctgccattgaaaatgcggtgatgctgtcctgcccaccaagatggatgaggaggaatgatgcccaaaagaaagctagtggctgggttccccctgacatttgcctctgaatatcatcgtgtcgtgagaggtaaccaagagcataaactgctgtgaagtctgctcccaaataagctgtccagatagaaaccctgaggaacacattggtgttgcgcctccgaagactgccggtgaaaaagaggaacatttggagtgtgaagctgaggagcacaagcagctggatttcccgctgatgataaagtttcataaaatccttcattattataaatttaagagcacctgtgttggatattccagtaatcatttagtacaagttttaaaaagaagattacattttcgacgtactacaacccagaaacgtaaagaaaaagaagtcagagtaaattctttaaaattctaggtatatattatgatctaaattgcataaatccagaagttttggcacgtggcatataacactggatatattatagtcctacagtttcatataaccgcactgtttattaattttacttgctactattgtgtcaaaacaaaaacaaaaaaaaaatgcttaacttaatggctatcaaactttttatacaatagatcaaataattcttcatatatttcagaattaatttagaacccacaaatatggtcaatcaaataacaatttattaacagcatgattttatgaaactataaaaccatagcaccaagaataatcatatgctccgtgctaaaattccatttttttttgcaaacagcaacaaatcgattcacaatattaaagctcgatgcatgtatgtacaacaagaaaatagtaaataccccggttgtttgtgacagtttttgcccagtgtaattaattagttatacctataatatatcctatctacaattccctccgtttcgttccgttccacgatataagacgttttttatctaaatatactagcatacatatgaatttatacacatctataaacatatatatggatccatatatgaatctataaaatcccaaaacgtcctataatgtgaaaaagagaaaaatacatctatttaaaaatatagcaatcgaaagagatacaacctaatactacgaatctgaacagatatattggtaccatgattgtattcccatctaatcctagatttactatattttgcaactaagagaatactattctaaactcatttctctctctctcctatgtcggccggctttgctgccatggaaaggaaggaggagaccgacctctgcacgaccggcgtctcccgccaggaaccccagccaccggacgacggatcagccgtacgtcgccgtgtccaggaggtagcagatcgagtggaggagggacacgggaggaaggatcggatcgagtggacgacagagagacttgttgttgacgaggaagtgatcagatcgtcagggacgaggaaaactctgtgaaagaccgtagctaggctttgccgattttttctcaagtcaattctactatggagtttggaccacatgacactcacagcctagctaccacggaaaccccaaaatcctactcactccctaggatttttttttaaagaaacatggtagtacacttgtccctataaacacacgtacactttattcatatttataacaattaatgtattgaagttggttgatacgaagaagagaacgcggaaaaattaaataaaagatagttgtgattgattgagataatagtatagatactagagagtctatatttttacaataaaatttaaaagtatggagagtatcaagcatatatcacaagtactagatggagagcggtaagaggccagccggttgcttccctggccacgtgatataatgatataacgtacggtaaccttttcagtttttggaaaccacggtaatcctcacgataacagcatggttcacgataaccacacagtttctgcacatgataaccaccttactgtgggttaaaggtaatctcaccaagacggtttggcgaatcctgatactcaccaggaaattctattgtgtagtgtcatccaattgtgcaaccatggtgatagtataggtggtttcaaagtgaggttgtttttttaataaagatgcagtacccaccatgagttggtacggttattaatcattggctgtattagttttgcttttcatagggctgcatatgactagatactttaaaaaaagtacaatggcactccaaatactatagcgataagcattccacgttggattgcatgctgagctgaaaagagattagtgaagagagaaggcaaacaagtgactaagggtatgtttagcagagcttcaacttcgaagtttatcttcaagagctcgatttgaagtgaagttgtagagcagtttaaaccgagcttcaccttcttaatttattttatgagagcattctagtcagtttcactctagctccctttttaggtggagttgaaactgtttggttgggccttagctccagaagacatgtagttggagctagagctctgccaaacataccctaaatagtcgctcgctccatgcgcactccaagagcgttgtatagtagctttcctatcgcttgctcgtagccgatgccgacaacacccccatgtggtaatgtggggccgtataattagcgacatccaacgccagggagatcatggagaaacagcagcgcggccacctccagggactacgagggggaataggcaccagagaaagacggtggcgcgatatagagcgacggcgacatgtcagttaccatgacgacaagaaaaagaacagaaaggagttgatatagaaaaaataactagtgaaaaaaaggtagggaaatttctgaccataccgatattgttttcataaagaaaagtaagatattgtttttagctttatgtaaaatttggtttttttaatttatgtatgaattatattgaagtcatcactaaaatgttagttagatttataaatataaaaagttcccaaccatagtgataccattttcataaaattttagttattaatatcgtttccaacaattttcatcctaaaaaatccaatcagagaaaggaataggagctcccaatggcagtggtagtgtcctggtcagcaacagcggcggcattccgggctccgcgacacatagttcactgttagcttttttggctcccagggctcccttagagcaagtttaataatatagtccaactactagctccaaaaattaaggcaccatctatagctaacctaataattcactcatataatagttagttgttagttgtatatatattgcatcattaatacttattcacatatatctcttatattgtttattggaacccatgctttagttggctataaatttatagcccattttttctctctcgtcttctctctcctccatataaacacaaatatgatgtgacaaatcgtacatcccgcttacatcattctattatactcggttttatggcagcaattctaaaggaaagggtaggtagagggagaagatgctggaatcttaacatttcagctgatgtcgtggcagatgagcgaattggactctcaactttatcgcaaccagcaaaaccaattaattttacagaaaaactagaaaacgggattctgttcaacgggataacctagccttcacaacataagcatacatgtagcggcttgccggcttacatggagagatcaaccaaactctatacaaaaggcaagggcccacatgcatgtactatccttttttcttgtccatccatgcagctagcttatgggccaacgtgcatgtgcgtacatgctcgacattttactcctgcatgtacggtgcccacatgactttggcagagaggtcgatcagttctatgcggtagttaatcatcaataatgaatacacttattagatcactagtacagaaatataatccctcatacctaatatgtattataactgaaaaaatatagtgcaaaaaatggttccttggatccaatacctacatatatcgtaactgatatctcacaagtatcatcactagtacccatgtatcatcaccaatacctgataggtatcatcactagtacctacgtatcatcactgatacctcataggtattatcactagtaccagacaggtatcgtcattggtacccatgtatcatcaccgatacctaacatgtatcatcaattggcacctatatgtatcttcaccgatacctcacaagtatcatcaccagtacctacatgtatcatcaccggtacctacatgtattatcttcgatactgggtatcgaccaacccagattgttccaactgatatcataggtaccatcgagatacttggtacctagatcaacatgattcccatatgtaccagatctagtactgggtatcgggtatttgggtatcaagtacctggtacctagatcggtctgatacctataggtaccatacctagtgctggtatcaaggtacatgaggtatcatatacctgataccacctgagtatcgggtactaggtgtacctgaattgatgttgaacgatacctgttggtattgggcctggtatcagatactagttttagtatcaggtatcaactcacatgccacgtcacatgcatgcatgcagctagcaacacagccacgtcacatgtatgcatgtagctagaaacacagccatgagtaatcagtagaatgctacgtgagaggaagcaggtgggggggggggctagcgacgcggaacggaagggtatcccgttcccacgggatcctacggtctagctatcctcttaattttatgttatttgagaccattcaacaactttattttgttaacgtacaatagagttagttgttggctcaaggctgagagcaggagcatggcggtggcgcacagtatgagggatggctcttggaggataaggaaggagaggatcattgtaaaagcattataggtgttaaaaaattacaaagatgagggtttttttttcttttcttaagggaaaaaagaagtttgaattaccccaaactattacagttgctcgaattacctccttaaactcaaatactagatatttaacaccccaaattctttgaaccggatgaattaccctctcattcaatctgaagcggttttttacaacatggcgtacacatggcagtccaatcagcaaaacaataattaaaaaattgtgtggtcccaactgtccaatatttctctcttctccagctcaactctagcaggcagacatggtgaggagggcgctaccgttgctgcccctattcctctcttccctctcttaccagtatctcagcaggcgaggctggctccagcgaggcaagcggcatccactgccacccctcttcctctctttccccagatcgacctcgggaggtgatgcggactccgggtatcgacctaaggaggcaataaggaatccggcgaggcgggcctcgaccacctattgacgaaaaatctgcgctcagtcgatggtgccagaactgtgttggcgcgaactaagtcaacgaacacaacagactgggagattagcttagctccagtgaaggtccaaaggttgatgagatgtgggcgtgtcaatcagtttgatcctgcaactgacaagatatacaaatagcatatcaatgagccgatcggctgacaagccgatggaataattccagccgatgtcgatagggttttgaacaatcgactaatggtaatgtaattaaaccataataatatccagtagaaatcaatcggctaacaatgatatgatagaataatcaccgatccgaaggttaaaacatacatcggctgaatatccgatgtcatcaaatccacaagattagacaatgaaacatttgttgtgatcggctaaatccaacatgtatgcaatccttgtaagccgatgcaacgtccagatacctcattggctgaaactctgatgaaacccttattggcaatcaagaagcgggctagagattatgattctaagcacgacttagtagatcaaacttaactgatgctgcactaagtatgaaaagaaacataatatctagacaatcaagcctttgactgattttcagggtggtagataccttagctaatctaatatggtaagcgatttagccgataccaatataaaccctaaagcgaatgtcagccgatacaagtaaatcgagctaccaaactagattatctaagatgtatgatagataggtgcttagattgacaatatcagagtgtcgaaaccctagccccgccgatgcaaatagccatgacaagtataaactcgtcgaaaaattagaaaagtaaaaaggtggcgatgcgccgaagttgtattgatcgtggagatagtttacaaaaaaaaacctcgggtgtacatatttatacccatgggtagatactagtcgttgttggataagaaagaaacttttctaaagatagaaggaaaacataaagtctttatgggacactaaacacactttcctaaagataaaagaaaactaacaaactcttcctaattaatagataatttgacatgccgcatcctctttgaattcagtcacttctggataagcttcccttaatatattaatttccttaaccgaatcctccaagaatccgactgctagcgacttgataactcccattggccgattccagaactctgaagccgatactgattttaggtcgataatgtcttcagggcttaccaaatttcactgttaacaccaccgcagccctctttcccaggatcgacctcaggaggcaatgcaggcttcggcgaggtagggcctcagacgccaccaacgcccctttttttcggcaccgacgagctgagcactggcacatggtcctcgcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 550 - DNA, 5217 bp, Oryza sativa
  unsure (1)..(5217): unsure at all n locations
nnnnnnnnnnnnnnnnnnnnnnnnnnnnnnnnnnnnnnnnnnnnnnnnnnnnnnnnnnnttccttgcctcccggcataggaagagatcgccctcggatttccgccggtcggggttggcgcagtcggtgagcggcgtgcaggggaggaattgctccaatgcggtcgttggtcgaaatgagtgagttcacaatcctactattcccaagaattcctaagcttagcaaccataatttcataaaagcaagagaaaaaaaaattcaacttatcgaacaatggcacgatgatgtagtgttcttgcaagcatgatgtgaaaatatcaagattttttttatggaccagtgcaagcatgatgtgaaaatatcaagaagtgagcaagaaagggaaaaaaaaagggtgagtaaatttttgatgtaaaagttgtagtgagaggttgataacaacctctaggtttactgtcatgaagttgctactgctgaaaaagatggctatatgcctacatcataaggagatagctttgcttgccttgcttgctgaacgccatcatatgatgcttggagtgctctgcaatcccactactgttgtagttgattgatagcaaactagcttttagattccaagagcattgcaaatctacttttccttcatccagtttgagtatattgccatgtacatggcaggtgagccagtgcggtgtcgaagtggcatcggatcgtgtcgaacattgtagtcctgtttttagtgcttatctttccaaccttttaacttgaaagggtctatgcatgtatctgtattaagattggcactaggtcgaaagatttccatgttctcctttttgcggcaaaaattgggcaaccttgatcagttagtgagtgctgttttattttaacaaggtagtaactgatgttatcctttttgttatgcagcttttcctgaggcaactgaaacaatgatgtagatgctgatgctaactacattagaaggtcacttttggtgtatccaggcatttggggggagatgtggatcactgcaaagatcaaacctccaccgagcacacacatcttcacatcttttccgtcgacaacttgcagagtcgacttatcacgcggccatcccagaactcggtagtattcataatcgcgacggcttgctggagcttgtatatgtgcccccactactttcatgtgtttaaatccctttttgtccttttggatgaggcgttctggctaacttaagaaatgatataggtttgcatttgcagtgccattcttccatggtttcactgtctgaatgcttccattgtgccctatgttcagtctcaaacttgttcagaaatcacaatcttggctgaaatgtgttgaaatctgtaaattcgatggctgtcgaatttctgtagttctcatggttactggagccagaaagagaatacacgttacccacaatttgcacaaaatgccacatgtatattctactgaacttatctctaattccaggtaggctttgtgggattaggatgggattcttgttaggatatttatgtggtcgatttcagtgtgttcttaaatggaaaaatcctgcttggtggaagaaatggataagtaacctcttctgaaaaactttgcccaaggttgaaactcttatgaggtcagtgaaagcaacacacaagtgctaataacattgaggctaagtctccttttccttttccttgttcagggcatcaaattcttcatcctgatcttcccccatcacccatgtcattatcacacatccctcaccacagaaaaaaaggacaataaaaattatataaagaaagatgcattgcatgcttgctttgtggtgtgaaagtagtagagatccattggcgtttggtaagggggacatcatgcatgccacatgcttgatgaaactgatctggagattagaatttgcttggaaatgatccacttggagaataagataagtgggtttgggtcaataggagctcaggaccgtgcaagaaggaaaaggggataataggtcctatcatttgaccctcttctcattttaaaagacctctcatttcacatggctaacctctcgtctcattttaaaagcatgtataattaatttgatacacagttatgtattttgagaaattttccacgaattacacccttcctgtttattggtgtacgtttacacgccatactatttccacagatttttcaagtcatgtcattcttaaattacacgcttttattattactagtagcatgtccatgtgttagaaccaatcatgtccatataattagggatatactataagggtgattgatgaatattagatccagtggttatgcaagcgaagacgcactgagcacggtgggagaaggggatggaaagaggacgactttgcttttacagtaatagtgaaatttgatatagacttgtttgttttttaaaaaaattacatgaattataatacctccctattattggagatctaaaaacaaaattaaaccagaccaaccgattcgtagaaagagaatagtacgcgactaaactgatccgtacaaagggaatagcgtgcgcctctagattgatcctcaaaaagagacggcccaatcacgggttactcgatcatgtggttctaaggggttgtactctgcctaaggacagtccttgcaaaaaaattggtccctctccattgctgccaaccataggagggaggatgcattgaattgaattgaagggaaagaagaagggtgggagggccatccatggccatggaatggagaggaggggaacatttgccacaacctttgctgctgcagggcagaaatcctagggaatgtggaccatgcaaaatatatgaaccatatcagttgccgatctgaaaagatctttgcacaagggaacagggaaatgtaggccactagatatccaccgcacggcatgagctcttgacagagtgagtttgttctttgacgtctactcccaccggcataaaaataaatcgtgctgggcatcaataggaatttaaaattgtaatattgacgcggttgattttataagaaatatgttttgactatacgctttaataataataataataataataataataataatttattttattgtgatttgtttttttaacaaagtttactttaagtatgattttattgtttatattttcacaaaaaattaaataagatgaatgataaatgtatgtcaaaatttagaggcatcatgtattagggcattcccaacccaatgactaggatggtgtccatagcattaaataagctgtcacttagaatgaaaaatgatgtggcaattgaataaatgaggaaaaagaaggaaatcatatcttgcatgagacatagtttctacgcaacatccaagacatcatctgagataagtaacattaaatttaagtatggaatattggtgtttgcattggaagagtagtgtctagtactagtttcttaatgatgtggagtttatggaaaccatgtttagtgtcttgggttgggaatgtccttataaaatagagggaatgctacttccttggaggcgaatctgtacggaattttcatacatcaaccccctataaatatattgatgtcatggttttagaatttttaacttcgagacatgtcaaaacgacatcagtatatttttgagaacaggagtagaagaccacaagagacctgctacaaatctgcagctcattttgcaacttaagtgcgcatgtagatatctcatgtaaatagccatgattttttaagaaaaatatcgataacatagattataatgttataagccactccactaacatgcactactaagttcaatctgcgcactgaaaaacaaatttgggcatgattggtatggtacaattcaagtattcataaccagatttgggcttaacattttgcaatatggtacatgcctattgtataaatgttgtttgcatttgaattgtaaaaatatagctccaattattgttgcttgattcccttggtttaggggtttaggcccttttagggagtaaacaaaggagctggtgagggaaaatagagataagaaatccaaagaataaaattaaaataattggtctgttttgatcataggtagactttgtcttggtgaacttggcaatcttattgggctcaccggtggttgccctggcccaagaggatctaaatcggcctagtcgaaggaggcactccatgaacctatttaaattggggacatttaagtatttaccacttttaagatgtgttaattaaggaacttttttaggcacataagtagtaactttgtatacttgggtgtttgtaattatgaaaactatactttaaatcccagtaggtggatctatacactataaatttaccatggtaccttaaaaaagggctttccttatttgaaagtgtattattaaataaacaaaagaataatacgatattaacgacatttgaaagtgtattatctaagtactagttacattaacgacatgtcatattcataacaaacatacggtggcatgctttggctgcataactgttacacataacttagttttgaaatgtactaatttcgagacaagtagaaatacaagttgcggagatgtggtttgcaaaagtaatagatgtaatatatatagtcttctctatagctactagaaattacatcgatagcagcataatcaattatttttcaattacaaacttagctaaccatcaaagatagatgattctcaacgaaaggcaggtagaattagctaaaacagagaggttatggatttttaaaaagttacttatgtgcctatatgcattctgttggttttttatatatctgtattttatcttgtcacctaagtatccctaagaaaatagaaaggttatgtttgtttccgttggttctcaggtaagatttgttcgtctaatccctaagatagagggattgaagagtattgagaaggaataatttcacatcacaatacgtgtggattaaattcccttcaaatccccctcgatttctctatgggagggattaaacaaacaagacaatatgattttgaaatacagtggtaaactggtaattaacatctcataccgacgatggcaaaagtacatcacaaattttgacaatttgactctttgcaaaaactatttttacaaatgaaccggtgtctaaacttattttaaatctgaccctttttgctcaatg

SEQ ID NO: 551 - DNA, 19639 bp, Oryza sativa
cgttgagcaaaatggtcagatttgaaataagttttggcaacggttcatttgtaaaaatagtttttgcaaagggtcaaattgtcaaaatttataaaagtacatagtatcaaagtcaaaactataagcctgtttagattggtgtcattttaaaccataccatctcttttgataaaattgatagatacatggatgcatttagtttgttactaaaatactggtaatgactaaagatttttaacaacaacatatttagcctatcctacaaaaatttgataatattattaacgtaccgaaattgtgaaaatgttcattttgatagttacatgaatagaccctacgtgaaacttctagaataaaatatgaaccacactatgaagctgtcaaagtttcagcctgattagacaaagtttgacctttcaaaatgatcaacctactgtacaagagacaagaccatacgtgcaatgcgtccatgtatctaaattaccctatttgctgtggactactccctccgtctcataatattaggattttgaatttttatttatagagtttgaccactcgtcttattaaaaaaatttcataatataagggattttgagtttttacctatagagtttgaccactcgtcttattcaaaaaatttatgaaaatataaaaaataaaaagttgtgcttcaaatactttggataataaagtaagtcaaaaaaaaataaataataattctaaaattttttgaataagacgagcggtcaaacagtgcaaacaaaaactcaaaatcctatattatggtacggagggagttctatagttacctgcctagaacacactgtctagaccatcaatgtaccagatacatccccaatcttagagacaaaagtagctagatttgtacaattaattaagtgaactactactttgcactactccagcagaataattagcaaaattctatcttccaatcaacttcgcttcagatgcgaaaaggcgacagcctttaagcctcattcaactattcaagccacttgacattctcataacagcacatacccatctgatgtgacattatgcaataaataaatttataattttatcatcaatactgtttcagatagcaatatctgtaccaaattgctatatgattctaagtccagcccagacttgggttgacccaacatgtgccgtccatccacggatttagccactaatccgcgcaatccaacggcccatatttcgtctcatatctggccagcaattgcagcaaataatttcatcctccctctgttttatattatataagtagcttgatttttctactaagtatatttttaagtttaattagatttataaaaagtatagcgatattttcgacagaaaacaaatctattattcaaatatattaattgttggttttaatggtattaattcttgaaatttgacttaaaaaaatcaaaacgaactattctaattaaatgggtttagttaattagtacttccttcatctcattttgattatcctacaagaattttgagttattctcaaattgatcatatctaagcagtgtgtctattcgcttactaggagcaattgctatggttgcatgtctattcggttatttgtacttgatcaaacttcttttaagtttgactttaaaagaatcaaaacgattaacactaattacaagggtttaattgagtactattagattaacactaattacatgggttgcctctaattattaatcactcgcgcctcatcctgcggagaagagcgaacacttctccttctctctcttcttcttccctcatccccgcgcggcctcccgcctccgcctctgctcgcgagccacccatttcccggcgacagcggcctccctccgccgccgccggcgatctgacactggcgcccgcgccaccggccgagaaaggtagttccttttccagtcctgggtaacgatccaaaggcggtttctttttttatcttctcttgtggatgataagttcgaatttttccctttcatccatggcctcctgcgatttatgatctgttgcgagacaaatcgacacgggtgtttgtgggtttggtgtgttggattcgactgtttcttggcctgaatcatctcaggagaaggaattgaatttgtggtggtggcatttgttgtggtgttctttttaggggaattgaagtgtcataatcgatttgcaggagcaggatggaaggggagatggatactgtggtgggttcatcatccaagccatgcgggccgctgacggattaccgcattccggattacatcctgaggccggatgcgcagcgggtgcttcttgatcatgcgcccccgtgccccgtgctggtgttcatcaattctggatctggtggtcagctcgggagcagcctgatcaaaacctaccgtgaacttctcggtgaagcgcaggtatatcgtctgcgtgtttggaaatgtgatttcctttcttgccttgtggcgtcaggaaaggaatgtggcttttgttatatcagttgttgatggctgctgtgttcttttcaggttttcgatgtctccgaagaggctccggataaagtgttgcaccgtttgaatgtcaaccttgagaagctcaagatggatggagacattcttgctgttcaaatttggagaactctcagaataattgtgagtgatgatgctttgaggttatattatgcagatttgcagagtaggaagtctctttggctttccatttccatttctgttgacttaaaagaggtttcaattaggttgcaggtggcgatggtacggcaagctggctgcttggggtagtcagtgatctcaagctttcacaccctcctccaattgctactgtgcctctgggaaccggaaacaaccttccattttcatttggatgggtaagtggtcagaaattaatgtgtacttaacaaatcatcttcttgtgtcaattagtttttgaagggaggtggcaaaagtgatgtacttaaactagagtccattatgtataagttgttctgtgttaaatgatcttttaaatgattcttgcctgaactttaacctgttcctgatcatggtcttgtatacttttgctgaattaaacatcgcagggaaagaagaatccttgtactgaccaagagtcagtaaaatcattccttgggctagtgaggcatgcaaaagagatgaaaattgataggtaatgccataaagatatcactttactttaagctttgacttttgccttgatcctgctcataagggttaagcggctgattaacttatttaatatttgccataaacccccaaacttgcaatcaatcaatactgaactcttttaatgaaccttaagtagttgaataattacctcttcaaatctgtttgtccttcctcccagtctaaaacatgatttcccttttatacctcattcaaacacaacagaagactacaatgtaatgtgcacatgaatgtttcagctggcatatcatgttgaggatgcgagctacaaaggaaggtccatgtgatccaatcgcccccttagagttgcctcattcattacatgcatttcaccgtgtgtcaagtagtgattccctcaatatggtaagacaatctgtccagtttttctaagttactatgtttcttgttgacgaaaattgttatatgtcaagacccaagtggcattgaatttaattcatttcctcaattggtctttttttttccccttcaggaaggttaccacacattccgtggaggattttggaattactttagtatgggtaaggctttgtctgttcatggccacttccagttatggaccctaaacagtctgatggtttggtttctagtttaccgtggaacttgatgttgcatgctagtttgtgctatgaagatgcaggcacctgctggttccatgtacggcaagtactgtgggactcatgatcactactgtcgtagtttattatatttggaaaaaagatcccaagtttcttcaagaacctagagcatatattgattcaatgactcagaaattcaaattttcatacgtgatgatctttgcaggtatggatgcagaaatttcttacggatttcattctgaaaggaagaaaaatccagagaaattcaaaaaccagctgacaaatcaggtatattatattcttattattgtgcattgtgatgatttcttttgtactgtttcgctgtgctgcagattctgaattactcgtaagtttaaaattgttccaactgaactgcctctttatttggcaggcagagacttgagacgtacaattgaccttatttagattctctatgtgctcaacacccatttcttatgtcttcctgtgggatcttactatacagaacttttatgagctatgagaagtgaggaagtgtcgaatgggaccaatacccattgcatgttactggaattcttaactgtagttgttacaaaatattgcacttacatctctagttctgtcaaattgattcctaaatatgtaatccttgatagctaatatacctgtaaatatgtgaaatttacttctatattgatttagataaatgtccctctagtcaatttcaatctggctgaatgacttaactttgccaggtgttaatccatttaatctatacagggtacatatgctaaggttggacttaaacaaggatggttttgtgcttctttaagtcatccatcttcaaggtagcttgttgatttatcattaacatatttcatggtatacctgttgtgctagttgtatacttgtattgtgttatctttgcagtcaaggtgtctctaatttaatattataccacctaactcctataaatatctgtgagtaatgtggagagagaagttatagggagtatacccactccagcatttttgggggtgttcaatgtacattgcatttacaaactacaccaatcaattcatttgtgcccttttttgttccttcatattagcaccatccttgcagtttatagattcagtccacaaaatttattgtcaaagcttaaacctgtacttggcaatgttaaatttgaaatttggtgtaatcaatttgtgtgcgttcaagttgtttccttcttttcgttttggttgtaaggttgagtgcttcatttccaggaatattgctcaacttgcaagtgtgaaaatcatgaaaagagccggtagccactggcaagaacttaacattcaccacaggtaaacattgttcattccttttgttgtactatgaattattttttcccccgtgtactgttatttgagcctactagtatgatatgatacaagaaagcttctcatttgcacttggaatattttgcttatactgtttcttttttgggatacgcaaaaggcttgcgtatcttttctattaagattggaagcagtatacattactttgaaagctgtaaaaagaactgaatcgaaaagaaaagaaaacagaagagaagaaaaactcggatatactgtttcagttttgcttccttgcaagttacaatatgttccttggatttcttgcttgcacatgttggcaacatttctgatttatgttctgcttgttgatggaggatgctaccataatctatgagcaaagttgtgacctgtgtactactgcctcttgcagcattcgatcaatcgtctgtctcaacctgcctagtttctctggaggtctgaatccttggggcacacctggcacaaggaaagtagaagaggtgagtttacatgcactacgcttgtcattcaacacgtgaatttcgcattgtagctattcacagattatttactggaaatcttcagaggaactaataatcaaacctctgtcttgaaaaaacaaaatctacagagggagctgacggcaccttttgtcgatgatagacttattgaggttgttggattccgtgatgcctggcacggacttgtcttgctggccccaaatggacatggtacccgccttgcgcaggtatgaagtatatgtaaaagtgcttccattttgtccatttgacatcccagaactgaaaaccacttcttccccattgtgccgtagtcataattttctacgtcaagaactagaactagtatagtcctctccattcaagcttatgtggacatccttcaaaatcaggcccaaaggatccgtttcgagttccacaaaggcgcagcagagcacaccttcatgaggatcgatggggagccatggaagcagcccctcccaaaagatgacgacaccgttgttgtggagatctcccaccttggtcaggtcaccatgcttgccaacgagccctgcaagtcgaagagcgtccatgacgaccaatcctcccacgcacaacacagcggccatggcaacaacgacgacgacaaggacagcatggaggacgaagatgagtgggaggatggcaggaggaagtttggtgccgcagatacattcaagatccctgacgaggttgacattgctcacctcagctgaactcagaattggtatcttttctaggttgcattcttgatgttcataatcttcttcagtaaagtgatttttgtcttcgattccttcaacattataagagtggaatttagtaattcgttcactgcaaaatttggaatgtatagaccataggtttggaacatctatagtagaacccaagttggtaacatttctgatttcttgtttattgttcagcagaaatttgtgttattttgggaagaaaataaagttattaaactgttgatatttatttttctagattgtatatttgtgtaccatttgaaatgtgttcaaattcaaatgtggtgagaagataatgactcatgcttatgtttatatccccccccccccggttccaatgtataaggcctatatttttttacacgatattcagtaacatactttgacaatccatttatttcatgttatgtttttaacaaatatgaagttactatcacatgaaagtacattgaaatgtgaatttagtgatataacacgcataatacttagcatatatatggtttatattattattagtaaaaaaattactgagtttaattttccataaaaagatgacgccctataatttgggatggagggagtaagttataagccaaaatttaaattttagaactcaattttgaattttgttttttgttttttcattgtagtttattttacactatctgcttttaattgctaataacatatataaagaaactttactcagaaatgattttttttatttgatattaagcgattcgaatattaatcatacgagtaagagaaacaagaatttttttgggaaatattattattttaatgaaaaatcgcaaaaatggtggtcatcgaagatttttcactaaaataggggcctgtcgaactgcggtagtttttattgttctttgctagttgtagtttttatttgtttcttaaaatatttggattaatgaggtattgtttatatacaaattctttattattttcattgccatttttggtttcatggctttgccgcaacttcgtgctcctttattctcctatccctacttgcgttttagcttcagttactcttccgccatcatacgtcgggttgaccatgtcgatctacaaagtgaatccacacatccttgggttctcctgaggaataaatcaaattatagaatgggatatgtattgcattatggaaacgcgagcaaaaatgaaaataaaaaattaagcaatgacatacaactaagttgttgtctatgttgggacagacggaatatcaccttccaaatgtctcttgtgaaaaggatgtagcaatttggcagcgatctctacaaccgcattttggatgctcaaaccattcaggtagacataatggattggatctccagtgtaagtttgactacacttggcgctcatactccatcaatgcttgaataattgtgtggtcatctcaggttgtgttatccttgcaccaatggaagttactctcgccgtatcgatccactttacgaagccacatttcgaaagcccactgtgggcccagtcgaattcccgtggttaaattggttctgtcaacctcccgccgttcgagagcacccgcctgttgctacacggccgttcgatagggtcctgtcgaactaccgcacttcgataggcccctattttgaaaaagagtaaattgcacccacggtgtatcaacttggcaggtgggtgcaatttggtgcaagaactagagaaacgagcgttctagtgcatcaacttcgcaggtatgtgcagtttagctaaaaaaactttataagtgattgcataaatgcaacaacttgcaagatatgtacgattttgatacaataagttaagaagttatgcgacaacttaattatttggagcacttttttatgcatattcaatttttaagttcttattttgataatatactagcgtggatttgtatataagcatatttatatttttattctaataactaataactaaaagtcaattaaactagatgtagaaattattatatttcggttgagatttaggaatgtgaagaaaacaaaaattcttaaaggtaattggttataaattggatatgcagtataattcttaaagataaaattcaatattacaaggtaatatccgtatgattgctatgtaatggcatattgatatcgtgagaaaaactcacctagcatatgcttagcttagttgatgcaccaaaatactaaattgtcaagttcttttactaaaatgcacctacttgtgaagtgttgcattcgtacgtttaattctcaagttcttgcactatatcgcactcacctaccaagttgttgtactgtgggtgcaatttactctttgaaaaatctccaacggccaccatttttgcgattttccattaagatagtaatatttcaaaaaaattcagccaaacaatgagggtgacaatttccagaaaatctgggccattcatttgggccacgtcagctagcggcgtggggagaaaaccgcgggcaggtttgagctttggcccgccgtttcgccggcgtaaccagcggcgccgcccaccgcaccgcgccgcctacaagtacggcaaccgcggccccttcctctcccttcacttcaccgagaaatgcgaagagcttagcggcggcggcgatgagcgtgaggttggcgggtcgcgtgggcggcgctcgggtggctccatcgccggcgccggcgccggcagggaaaacgcgagacggaggcgccgccacgacgtggaacgcgaaggatagggcggcggctgcggcggggggctcgctgtcgtcgaggcaggcgatgagggcggcgaatgcggcggaggaggaggaggatgatcggaggaggaggaggaagagggaggaggagtcgctgcgggcgttcatgttcatctccttctggggcccaaactcctgaggccacatccatttccatgtccattttcttgggctttgcttgtgatttttgttttcttgatttctttcttcctgccttcctcgatctccatggatcaaagacgtgaatatttttgccaacggaaaaagcatgtgatgtgaaggtttttagttttttcatctccagttcttgcctgaaaatatgatgtgtttcattgacaaattttgcgaaactcagaacctgagtttgatgtgcttgaactgtggcgcgcttttaacttttcaaacgacaaaagaagtttcaaggatcttttattcgaaatcatagatcgactaatggctgtatccaatgtttcaaggatctacctttcttcagaaactgcagcacaagtgcatatgcacaagcagaagcagaactgaacattcttcagggctctccagactccactagcttggccagcatgcatacatacatttcaccaaaaattctagtaggatttacatacatttcaccaaaagctgtggtaggatttacaggaacagaagtccaaaaaatgcggattgtggcttgccagaacaactatgctgctttgaaactgagtttgctcagcttgaagccttgaagtgcagcatgttataacctgacaataaaatatatgtagtattgatcagtaaaatgtaagatcagggaatagcagtcaacacatcacatttgcgagttgcgactaaagattgccttgttttaaatactaaatctcggattatttttgcagccaatctttcaagaatctaccttctgcttgaactggacaagtgcatatgcagaactgtctgaacattcttcagatctctgcactaatctggccaacagcccaacatatatacatgtaattaaacaaaattcccaggatctacataaacacagtctaaaactaatcctggtcttcctggccacaaccaagctctgtagtttttaatcgcagaggcaagaaaaggaaaattgatcttcagaaactgcatatgcagaaataactgaaactaagcattcttcaggttttgcactagcttggtccccagcagacgagatgcatcaccttctcgtccttctccgccctcctcctcaacctcctcgccttctcctccgccaccgacttcgccgccggcgccacctcggccggcgatccaccgccggaggagggaggtggcggccgcccggcgtgcggcggccggcggcgcgtcgtggccggctgctccgcccgcacggcggcctgcaccgccctggcgcacagcctgctcacgtaggccaggctcatcccgctctgtatctgggagattgattgctgatcagatattcagagatttatgctgcttgctcacctcgccaaatctatcttctcctgcttccactgcatctgaaagactgaaacttttttagtttctgatctgaaaggctgaatcttcttttttcctgtgttttttgagctgaaacactgaaacttttttggtttttgatctgaaaggctgaatattttttgttttttgagtgtttgatctgaaaggctgaatctttttttttcctgtgttttttgagctgaaagattagaggggaggagtagaagatcgagcagcaaaatgatcagaggacttactgaatttttattctgagatggattcaccactccaatgtgtaatgtttttggatggtgatacaaaaaaaaaatctctgaattgaaggtcatggtgatttatgcagtcgatcgcatcctgcaacttgctggacaagaatatgtataaatggaagaaatgcttattgctcaagaaatcattaaacgagataatcagtgctatgtttcctattaaataaagggactagctatatttatggcgtcatatttttcacaaaatatagtcggcatgtgtttacattgtaagtcactaaattacatatgtaattttagtgtatttacaatgtaagccccaaaattatatatgtaagtcttaaaattacatatgtaaatcctaaaattacatatgtaaatagtgtattagtgaggtgtaactattatgtaaatttatataaatatataatttacaacaacaacaaagtttaaaaagcatatcagtatgcatctacgccgtgtcagaaccaatacagcaaagcgtgtgtgctgatgccccgtgagcacgaatcttcatgccaatcctaaggttgaaaattcgactgcgtttgtggaaaaaatctatcgccataattatggccgatccattaaataaatgcattttactactttgaaagactgaaacgagacggagcagccgataaaattcttttggataatgaggtggtataaacaagaggctttaatttggatacttactttgtagtaagtggcaaaatattttttttttaatatgcaaaagtattgctatctttatattaagagtaagtggcaaaatattgtagtagaaacttaaatgttactctcttcgtttcataatgtaagtcattctaacatttctcacatttatattgatattaatgaatctagacataaatatatatatatatatatagattcattaacatcaatataaatatagaaaaatactagaatgacttacattgtaaaacggaggaagtatttattactatctcctaacaaaacaaatttttctttcaaatgccgttccaccattctcatttcgacccaagcagagatcacagtttaaatatgccaaaaaaaaaaaacagcagtagttttggagatttaacgcttctctcatctcagcaaggatatatactaaattaaaattcacgacatgagaggaatatttttttttgtttcctttcaatttgcgactcaatttatcatcatcatcatcatcatcgtggaacatttacagacacgaatcacttaatcagcatcttgatgcttgcaaagccagcttcagattcccaagtaatcaaaagttcaaaactacctacgaaatcaagcagcaaaagaagcaggatagtatcaatctaaatgacaatcttagctagggccccagcagcagctgaggtacatcaccctcctcatcccctcctcctccggcctctccgccgccatcgccgccgccggcgaggaggcgccggcgccgccatgcacctgcagcatcagggtgtccatggcggcgccgtgcagcgaccggagcgcgtagttccagcggcagaggcccgactggtccttgagcccctccaccgcgcccacgctcatcgccgccgtccaccacgccttcgccgccaccggcgccgccgcgctcgccattgctaatttgcaatgcctctctgaatcaacctctcgaacttgatctatagctgttgatgcttcgacgattcgatgaagcagtagtagctgaggagatgatcgagatggaattggattgagaagtgcaagaagagtggagtttatatagagttttcgtgggcgaaacaggaggcggggaggcgatggtttttgccgtttttctgaagaaactggaggctggagatatctgcttatgtcactcatctcatctgctaaatttggcgctatgcttctgtttttttgtttgtttttcaggtgcacaaatcataaacagggcataccaattttaaatttcagtatttgattgattgtataattattttctgagttttttttctccccttacgtttttttctatagagaacggcatttttcgccccttttgtcactgaaacacttcaccggattatttactccacgtctttaaaaatatattttctcaaaaaaaaagtttcttataccgtattgcttaaatctattgttataagttattttgctaatgctgaaaatgtaagccttacactatattttgttttcttcgagttagacaacatctggacaataaatcgtagaaatattttgtatccttttccatttttaccagttaactccgtattgtactgtcaccctagagtctggactgctaaaaggactcacggatcagacataaatcgcctgttatgctaatgaaatgattggtccacgagacagagccaccgaccgacacttggttaactgcagccgtccaaaattagttttactaatctatgttgttggacttaaaccacatgctgtcaaacactaaagattccatggccggcgccgcgtgggtgccatcctgccctgctttcatcctgcacaacggtcacaggttcagagtaggaatgtgcaatgctttctagatttgggtataagagatttatcaaatcttataagtatattataggtaaggaggcagtaatacttcttcagttttataataaagatattgggcactattcacttttgatcaacacgcgttcctccttgtctgaccccttcccttccatcttcagcgactttccggtcgtcagtgaggtgggagggggtccaactctcatccactagtagggttagttttagattttatcgggttcatcttgttttcaggttaatcctttagtttcccttttcatgatcagctcgaggtcgtcgtcaagccatcgatgaacctcttccttcggacctctttgggcgatgttggtggtggtcttcgctactattgttattctccaacaagacctaaaggtgagcttaaataagaggcttgttagctcaaacaaggcatatgggaatgagtcagttcaactcctgcgtcagccacctgttccttctccggcgaccctcctgctctagcgacggtcttcttcctcgactacgacgatggtttaaaagggcaactgaagtgtatctctacttgtctaggttgctttaacctccatccttcggaggtcccatttgggttcgcaactgggtttcatcttttgccgcttgccatggtttttctgctcctatcgttgttatctgagttctggctgttgcagttgcaagagatgcaaagtcaaggacctgattgctttttcttctcgttgttgaatcctttgcatttttcagaacttatgtgtaatttgctcattctcaagggacctctctgtaaaactggatgtattcccactttgcttatatactatatgctgatttgctgaggtagtatctcagtttatgttttaaaatcagtttatgtttttttttaaaaaaaaatactattcacttttaaatttttaagtacttcaaatactggaaatgataccatgttcttaaagtgggtatgcccaaaatataaatataaaacttttcttcactttgatctaacaatataagggcagttaatggtcaaatttcacatggagaagttaaaattgtcagttattaagaatctgagtgagtaatgaactataagaaatcgcctgatatgatgcatgcatcctggaaacttggtgcatgttggctttcttaattagttcccagccacatggttggaataaccatgaccctttttttaatcaatgattcagactcctggattggattaattgagtggataaggagcaaagttgtgggagactggcaggcctgtatgtagctatgataaaaccagtggctgcaggccatggtttccaggataccaggggcaatttgttggttgcatgattaatgcgcgtccgtttctaacacaaacggtttaattaccttcaattgctgttctttacagattgtttggctttgtttgcatccagagaagtcattgtggtggttacaaatatgcttcaacattttccacattgtctttgccaaatttgtgtatttgccgtctgcttgactgcaaaagctgaccagaagaatgcaggccatccacaatcaggttaatgaaaactgtatctctgtaattaaacatgactagaaacatatttcagaactattttttctataaaagatcagcttctaattccgagtaaagatgttcatcgatgttacaaaatgtttttaagagtggcaaagagaaaaatgccaaaaagatttcaaccaatgcacaacaagtttgattctacatttgagttttcaagcacgctgtgctacgccgagaggccgtgcttccttccttccaagcattttacagtatactacttcgtttaacaaggcacacaagctaccttggcttctttgaagaacagctatgctcacatatctgcgacagaccaaaggtaggcctcttgctccgttgcttgcttctcgttcttcagcttaaacatatccttctcaaatcctgtgaaatcacgggaatgctttgtaagtgataagagaccagactacaagatgcaaaacaaacttctaatggacacaatctgatgcctgaaccactaatattggccagaaagttgcacaagttgtccaaattcatgtatagtaccaatctaccagagaacatagtgaaactgcgaggacatgatggaccaagaaaagagaacgtgaacatgtttcaagtttctattcccttgcgcagccttcccccctattataaaaccaggtccacccaatcgtttgcagacacaaccctctggttttgaatattagggtagagaaaaatatatcttgcttgaaattggataatggacattctgctgggtctattcaataagataaaaaaagagaccgtaacaaacagcttcactgttaatccgcattatttcaacagttttttatcaggttgtcactgcagttgttgacttatccattgtgtgatactccctccattccaaattgatctacatatagtttttttttagattattcctaattgatcatcatatttgtgttcattcattaaatctattcgttatttgtgcattggagtaaatggacattgatgcatgcatctatgcacataagtatttataacccacatgcaatatcttgatttactattggctaggaaatagtggggatggtacatgcatcgagtttgttgctagagtaaatatagtatgagtgagttattagtttttcttggtcttggtgtacctatgaaatatgtagatcaatttggaatggagggagtaaacggtaagctaatctttttgtcattccaagcaacatgatgttaaataacaagaaaagaaaattgggaatgaatttggaaagcacataccattgctgcgatccactccgtcccaatgacgaccaggctttatgccgtagcggtttggaggaggatctacaccacgcttcagccagctgtgactaggtatattttggggaacaatgaagccagattctttcatcttttcatcatctcccaagtcctccagaaggaggtctgtatcattcctctgcaacatatgtacacataaatcagcaattagccaggtgaaggtgttcaagggttcaactgaaccactcaaaatcaaaagtggcagctaccttgacaagatgagccataggatcaccccaccggattctgttttttagcatggtgtcgagctcaggatcatccctacatgcaaaacaagttcaaattataaatatttgcaatgaatgtttccacaccttcacagttgacaaagaaataaacatatttaataaacacacacacacacacacacacacacacacagagatacagtgaggagagggagggagattttcaactcaacatcactagtttgttcaaggcaattaagcaagaacaacgctatcgagtaggcaaaatctgaatattaaggcaacaaaacttgtattaaataccttgtccgtgcaaatggcttactcttttcagattcaagctcctgtaatctagcctcagcttctcgcttctgcaccaaccctttaccccattctatatgtatttcctgcaaccatgtagaacatcagtcattagctacaaatggcagcacccaatacagagatcatatgttgaaaagagtccaaaggagtcatgaagaaggaataattcaatcatcatttgatgcaatctgttccatgctacttctgcaaaaagtgatctgattctgataaaaataatcatatatttctcccaagtccaactattatctttcatggatttgtctggacaagcttgcagtatgaatcaaatgcccatagagaacaccccccccccccacccccacccccaaaaaaaaaaaaaaaaacttcccattttctatggtaatcttttaaccctgctgataacaaaattgtaaagacaaatttaaatagagcattcttttggatagaagacagtgacaaccagtgagaaagtttaatggcagtaataaggcattctttgctgtaatgtttattagtacttggtggtagctgttgatatttcttagctcctgtatctttagggaccccacacgttgtaaatcttctattctgacagctccatggtaaaacttgtgcatagaacatagcgacaaaaggaacaaatgttgtttcttatccaaaaaaaaatgcatatgaggtgctcgaaaatgtaggaaacaacaggtcccttagagaataatttctatagttttgcaacaaaattctcccgatcaaagcaatgtctgggtaaataatttgcacaaaacatgtccgctaatctatatctgttgattctgttcaacccgaagcatatttgaacttccatgagccatagaacatttaaacagaaaacaattgaattctcataattcaaaagcatttatttacctttggtttcgtgtcttcctttgccttcctcatatcttcttcacttattcgttttcctggaaagcatcagaaagtgctgttagcacaaaaagtagcatgggtatataagtaaataactgaaaaaacagcagaaataagctgtgtgtagtgcataccttgtttatctcggaatactgcttttgcccctttcccaatcactgagggatcctgtgcagcaaacctatccagatgaaacataaacattattacaaatctgaccaaaaggagtaagcatctttgctgcaagatgtgaagtactactcacttgagcctctcatcctccttaatcttcctgatgtcctctttaacttcctctgctgtcatcaacccagctttcctcacctccttcggagccacttccttcctacccttccttggaggtgaaatgtccccatcacccaaagcctgccttttcagtggtggcaatttgtccttgggttcatgagagtcgtgccgcgtccgtctgcgtgggggagagaggtcttcgggctcttctgaatcatgtctcgtgcgcctccgtggtggcgagaggtctttgggttcctcagaatcatgcctcacgcgcctccatggtggcaagaggtctttgggttcttcagaatcatgccgccccttccggcgtggtggagagaggtcctgtggctcctctgagtcatgcctggtacgccttcgtggtggtgaaatgtcctgggattccttggagtcatggcgagagagcctgcgtggaggagaggggtctcgttgctgcctagacttccgcggtggtgacaaatcatcatgccccccagctacctcactaccctttggtgacggcgtgtcttgccgccttcgcctctgcctcggcggcgacagatccttacccgcagcatctctcgggtccggcgagggcgtatcctgccgctgcctccgccgcggaggagacagatccttccttccagcacccccgcgctccggtgagggcgtgtcatttctgcggcggcgaccggttaaaccaccatcggagtcctcgggggcggccacggtgacccacccgcttccgtcctcagcgatagcattgtacggccgcgccgcgcgaatcgcctccaggcggcgcatccgcttgacctcgatgtcctcgtccaccaacggtctctcatcccctgcaaccaaccaatcacaattccaatcaaatccagcacgctgcacgccagatcgaagaacaagaccaaaccacggggggaaatcaaagctagggtttgaaggctatcgcgtaccggacgacgcgggctcctcctcgatctggacgggcttgtgccacgtggggtcctcgtcgacgataagcacacctccgcccacggcggccgcgggcttgggcttcttcttcttcttcttcttggccttgccctgcgcgtcgtcggattggtacctcttgaggtactccttcatggacatggccgcgccggacgtcgaagcgtcctgctgcttcgtcgccatggccggcttctcgccgcctccgccgccgccgccgccggtgagggaaacctactggaagctacgaggtgaacaagggttagagaaggaatcggtcgcgcaccaaattc

SEQ ID NO: 552 - DNA, 4062 bp, Oryza sativa
ttctccgtgtcacccatgtcagtgactcaacgtcaccgagaatgtcacgggggaatgtcaccgaatcccaatccatttttgaaggagggaaccatatcctctgacatttacacagtaatgttacggtgtgacattccttcaatccacaccatccattataaatcaacggccgtagattatttgacatgcaatcaaccaaactaattagtagattgtgtagtgtccctagatcagatattgcattttcaagaggcaaacatcgttgaccgatggaagaatcgacatatgatgataattatgtttcacttacttgttagatgtagcgattagcacattatcctggaggaagtgaatccctgtgcatcaattttgtgctgccatcctccgtcaaaacggggcaattctgaatcttcaaagatgaagagactgctttagtgctaacaaaaaaaaatccttcccacctattaagtacatatacctacatgatctgctagttattttgattagttagatgccaattagtctgtggccgttgatttagaatggatggtgtggatcgaaggaatgtcacgcggtgacattgctgtgtaatgtcagaggatacggttccttgaagaagagggagcggttttttagaaggagagcaactatgtttgtttttaaagtagttaataagatatttttacccttttttcatggttaaactcctacaaagtttgaccaaatctatggagaaattaagcaacacttataacatcaaattagtttcattaaacttaacatttaatatattttcatagtatatttgtttggtattaaaaacgctgctatgttttcttataaagttgcttaacttaaataaatttgactatggaaaaacatcaaagcatattgtaatataaaactgagggcgaggaaataaatatttaatggcttgtctgattcttggtagagatggaactgggtttgtggactgttatattcttctttttttttaaaaaaaaagaagaatgtgggctaggtgagtgggaattatcaaaatttggaaaaagatcctcccaaataaaattaataagtccttgaaaaaacagaacataaagaaaaaaaatagggagtgtttgtttcactacttctcaaatctttggtattagtaggatagctaatgaaatgaactgcttaagtattgtgttttaccttttttgcaagggaggaatttatcattctttttacaattggactaacttgttaaaaaatcatgtaaaattcatgaattcggatggaacacctaagtatttttcaaaataaatctactctacataatatagggcatgtttgacacaactccagctctcagccaaacagtttcagcttcacctaaaatgagagcggagttgggtggagtgctctcacaaaatgaactagagatgtgtagctaggtttagggcctgtttggcacagctccaactccaactccacctctcttggagctgaagcccagccaaacagttttagctccacctaatataagagtggagctgggtggtgcgctatcacaaaatgaattaaagaggtggagctagatttagacagcttcatataactccactcagattcaacccctgaagctaaatttaggagttgaagctctaccaaacagacccaactcctaaagttaaatttaggagttggagctctatcaaacgggttattcagaagttgcgcctggagtggagttgtggagcagtctaaacccagctccacatctctagtttcattttgtgatagcactccgcctagctccactcccattttatgtagagttgaaactgtttggcttggctccagctcaactccaagagatgtggagctagaactggagttgtgccaagcatgcctttagccttgattagaacatattgacacttttagcttttaaaaagtttgtccaaaataatatgtatttcaatggaagttaccataatatataccacaaggaatgctcactgaaatttatttttcaaaaaaataaaataaaaaacttcaaaccgagtagctagtgtctgtttatcccaactcatgttacctactactcaaatcctaggactaacaaatatttgcgcaggtgtaactctgttttttaaaagaggccacggcagcggcgccggtggcggcaaacgtggagagaaaggaagtgatggacgcctaacaataccacgaacaagagaaggagatgcagaaggatatgggagcgatggtggtggctggttgtcatcggaggtacgacgaggcccggcacaatgccctctagctacagtcgaggatctcaccgacaagaactacatgtgagttctgagggatggctggggcagaagaagaaggcaaagtttgttgttttttttttctcttggagttcagcgataattgcaatccattatttgcttttgtttcaccaggttgtggtataatgcttcattgtattttttttattggatattccacgtattgttttctttgtgttgcaataagtagttttcaagtgttgcatctatagttaaaactgtttaacccgatcgatgaaacatttctcaagagtaacgaaacattttttattttcaagatacacataactgatacatttttgttgaaacattttttattggttagagaaacagtactctacatgcgcggcaacaccatgcgatatttgtagcgctctccaaagaatttactacataagaatttcataaaaagaaaacacctataaaattcaaaatctatacaacaaataccctgaaattaacctgccccgaccaaattctaaagctcccccctccccgaattaattaattaattaaaaacctgtcccttgaaattaattggtttaattaattcttgcattacctaattacacaacctacccattaattctctctctctcgcgtaactcgtaaacggtaatagtatatgtaagagctagacgttgtggcttctgcggtttcctcctcctccggcgccggcgccggcgacgtcgtgggcggtgacgtagctgccccagaaccagtgccggctccagacgtggttcatctcctcgatgggcacccccttcgtctccggcaggaagagcgcgacgaaggtggtcatgaccagcatccacccggcgaagaagtagaagaggccgaacttgaggtggcacagcatggtgaggaacgcctgcccgatgacgaacgtcagcatcatgttgacgcacaccgcgatgctctgccccgccgacctgatctccagcgcgaacacctcgctcggcaccagccaccccaggggcccccacgaccacgcgaacccggccacgtacatgcagatgaacagcacgagcaagatggcgtacgaccgcgacatctcgccgacgcccgcgacgccgaactggagcgcgatcagcgtcccgaccaccacctgggagatgaacatctgcgtgccgccctggaggaacagcacgcggcggccgaggcggtccacggagatgatcgagacgacggtggcgaacatgttgacgaggcccgtgatcacggcggacatgagcgacgcgtcgccggcgaagccgatggtgaggaagagcaccggcgcgtagaacatgatcacgttgatgccggtgagctgttggaagcacgggatgaggatggcgatggtgagctgcgggcggtacttgcgatggaggatgttccgccatgggtgctcgatcgaggcggcttcttcgcttgccgctaccatgtcgtcgtactcgtcgtggacgtcgtccgtgccgcggatcttgacgaggacgcgcttggcgtcgccggcgtagccgcgggcgatgagggagtttggggtgtccgggaggacgagcgcgccgagcgtgatgatgagcgcgggcacgccggcgaggccgaggccgatgcgccacccccacccgccctcaatgctcgacgtcgcgtagttgatgaggttggcggagaggatgccgatggtggtcatgagctgaaagccgatgttgagcatcccgcggaggttcgccggcgccatctccgacag

SEQ ID NO: 553 - DNA, 14911 bp, Oryza sativa
  unsure (1)..(14911): unsure at all n locations
ggaccacttccggccgaacacccgggtgacccacgccgccacgaacgacgtcgccagcgccgccaggtacagcgacgaggtgaagagcgtcagcagctggctgtcgaacttgcagtactggttggtgtccttgctcgccttcgcctgcgcgtacaccgacgggaagaactcgctgaggaaggagtccatggaggtgacgccgccggagatgccgatgtcgtagccgaagatgaggccgccggaggaggcgacgaggcaggtgaagaacacgaacgcggtcatcttccccgggtacgtcttgccacccaccgtctggaccatcgcgccgcccgccattgccgccgccgatcagctcagctcagctcaagctcagccaagctccggcgaggagggaggaggaggaagagtaggagggggggtgtggggttcaattccttttatgggcagagaaagcagcgtcgcaatgctgtccaatggctgcactgatggatgagactgttctttctatttctgttcttgtagtttgtgtcctgacaagttgctaaatttaggagcatttgttcagagacagttctctcttggtttgttcttacagttggtttatttacccatcttttaccccctacccatgtgatgctgtgggttaagattgattaattgtaatgccagtcttatccttttcaatccatttttagacttttactatttctttcttggcctttccacaattactgcataattacaattatacctctccacaaatattttttcctagacaatattacccttccacgattctactaccgttatatgagatggtagtagaaatagatctaaacccttggatccattgagatcaacggtttagattattttctacttccagtaaaaagcaccggagtgaaggtttttttttttccaacgaggacgtctgtgctttttaattttaagtaattaaaaaaaatcaagtgacaaatagtgccccattttgcgattgtttcttgcaggtttacatcacaaaaatgcttttctgtttttgttttctgaagttatcaaatcttatttcagatattgaggaaacataattcagcgcctatatgccctaacaaatcgcaactttattatgagcaaagttgatgaaaggaggcatgtacaagagcccaagtgaagtggaagatgatgtttctgtacacaaactattctggataggatagctaatgttctgctcgtcagaaagatacacgagctgggcaattatcaaaaaccaaagccacccaaccagaaattggacatgaaagagcatatattcagcattacaaaatcacatacaaactcgaaaaacattctattccatctcagcttttactagtagaatcatatagacatggtcattggaagaattttctgacccgttggttgcggtttaatttcccacgaagccttttcatcagactcttcagggagaatgaaaggcaatgaaatctccttgatcatcagatcgccgcagaaggggcactcgctcgctacagcatcatccagctgggacctcaactgtcacaagaaacatgcatggcattagtacaagaaatgcagatctcgggatttcgtagtttggatgtgaccaaaccttgtcaattggtgtcgcactgataatagattcaccattcatgtttccgccattttcctttgctgctttcctgtccattaggctaagccgcttttggaggtccagtattttttcagcctacaggtaaatgaattcatccgtaactaattggtacaagagattgaactatcaaaataaggaaatgaacaattgaaatgttgcatagggacttacttgtgtttggctgctattacaacgagttacatgtgcgatcaaacaattcgcatgaaaggcatgtccacaaggaaacacataaaagggggccatgtgtccggtagatgtgtagcttcttcctacctggtgcagtcctccagcagtcaatattttgcgcttgcacacctgttaatgcacagtgaggagttaacaccatgatatagcagcgaagacagttagtacataagttcataaaaccatctgaatcaaaatggaaaaaataattttaagtgtacttgagaaaacaagcaataccaagaacacaaatattaaacaatatagcgtgggggtcatctttcctctttgttgcatatttgcatctttacttatttgaaacgaaaacaaggaaactcatgtaacaccatataaagaaaagaacaggcacaacattagttaaactacaccattttgggtatcgtgagcagtttcttaccccacattcctcctcacgatcaattacagtgtatctctgagcaagggcaccaatatcacttctgatgttgtctgccccacgagtagcatcatccatctcctgtttcagctgatcgatttggctgtcatagtccttgagagatttgcatatttcctcctgtttagacaatatttttcacttgtaatgcttgaaaaagaggtaatgccaaaaatggggactaggtattattaaacaacgaatttaatcaatcaaataacttttttgttaataagaaaattgcaagttgtggatcttcaacagagaaatggacattaggaggaattttctgtaaagcagctgactgcctgacttatatcttactttaaagtcatcgatcaatacgaagtctgggaaaaatggcaggatatcctcaatcttcaacaagttgttagtctctgataggaattctatagctttctttatgttctccctcttgactcccttctcttgctcaatgacatgctttgcaaccttaagccacagcttctttctaagttcttcatcatcttcaactttatctgcttctgcttttgcaagctctaagtccacctagcaaggaccaaattgagtaaaggaataagaaagcctcataaaaataagaacacttcaaaatcctacaccatcaatatgcgaaagcgcaagggatgcttattgaatggaattagtagactcttaaagaaatgatgagacttagtgaggaatgaggtttaccgttaatgcaagtgcaacagcttcttcatgcatggacatcatgctgtaaatacgaacacaagcacgcattctcttctcttgaagacatagacgcagagcatatttggggtcgtaaaagaactcagggccatttgtctgtcctttaccaaacttagtgtccaagaattgcaaaagctgagactcatcgtcctgcacatgaataaaccagagtacacatacaaaatcattagttatatgtgttgacaaatatacgcttgactggtatggcattgacaacctcataagaaccaccagaaacatgaatgatgaattgagtgcaaagtaagcaattactgctattacagtttaatgtttccaacacataaaaaagaaacatacacaacaaaattaattacatgatatttttcctactttgtaagaatataaagtgtaatttcacacacagcaagagcaacaaataatgcactactggaagagctaccttcttggcatacagtgagagcaacaaattatgcactccaggatcctcattgttcaaatcttttacacagaattccaagtacttgataacttcatgtgtttcattcctgcaagagttgaattcatcacatcatcctgattatggaaatcaagttggctacatagaattgcagtttgttccagagcttctgaacatagggagtttaggcattcttaggtttgattcgaattatcactatctgatatgggatttaagtgtaacagatctaaattcacttccaccagtagcaaaattcgtttcaatagtaacaatgtttttatatatagcattcagagttccctggtgtgataaaagacggtaaggctgtcaactgttaagatatcacataatattaaaggattcatatagtattatagcaataggggaataggaacgtataagaagccattagcatatcatacttggcatgtggttcgctcacataacgcatcattgccggtataagcttccctggattcaacttatttcttgccatcatccatgattcaacagtttcataagcatctaacatgattaaatctggagcaaatttatactgcacaaaaacaagttaaagagcaacggctagaattaaaaaatattaaatgtgtaattttgtgtaaaacagaaaatgtaaccttgttgtggtagaatcaataataaacttattttgagttctatactgcagcattcaaagaataaatgtaaagccattatgtaccacaaggtctactagaacattatgtcgctgaagaacttccaatgcctttcttgcttctccttgctgacaaagtaaatagaaaatgcataaggacttgacatctcagctaatgccaatgggttccaagtgcaaaaggtacctcatataataagtaaaaaacttgtattttcaagataactgaatgcaatgattttgaagcaattggcttcaaagaaagatgtgcaacgaactccagtaatattataaatgtttcctttccaactattctacaaagaagaatgatatagaaactacagttgctcaagagaacagatagaagggaaatttgatgttagactatggtaagaatgcaagatcatgctggcattgagcctgctcaaagcatagcctagcctgaaatatctggctggcacaagccccatcccagcacatgttacatgaactgttctataaaataatcaattagtttgtggcataaacaagctcttatcacccattataggccgataatcaaggtatgcatatctttgcttgctcaaacatattagcaaacataatgttaatactagctagcacttggcagattatactatttactattgttatgctcgacacaaattagtatttaacacctttagatgataaatgcctgacactgacctgaatgtaatgatgaaccacaatttcatgttgctcctttaaaccagcaaaataaaccagctcatccactctcccataactgcaaaaggtttcaaggtaccagttggggaacacatataatcagcaacacaacaaatggagagaacacaccgccatcttattcatgacaagtcaacagaattgcataaactaaataatgaaatattttatagtctatccattgatgcagtttgcagtcttgctgcatttccccttttaaataaatgagctattgaaggctcaaagatgatatccttcttaatagaacaaatcctactggttgtacacaaagccctgagtttaaagcaaatggacattaaatcaggtcctttgtttggcaaatgttcaacaattttaaatatagtattaatgtatggaatattaaaattatgcaggttctatccaaagatatgtaagttacctgtacaatacatatatgagaatttaaacaacctaaaataccagtgaagcatattgtgcaacaatggtaccacatacctttccaacagtctcattgttgttgcctcatctaatacatctttgctatcacttagaaaagcacggaattcatttactattgaacgatattccgagtctttagaatctgctacagcatttgacgtggctcctgtgccatcttccaacaggaggcgattaatctacaaatattgcaccaaatatactggataagcccccgcaataatcacaagtacaagtatactgaaaccaagactgaagaaagatttccaatagcaatggaacatatcttgtattacccagggccggtcctggggttttgggggcccagggcaaaaacttatatggaggcccctacatatatacataaactaatttatatatttatatagtctgataaacacataccatttaatattcgatgtgacaaaattatctatatataacattttaaaactccaatgagaaataaatagcagtagcgagcagagaagtcgaccggcggacgattgacacgagcgtggttactggcgagtcgcgatttgccaacttgctgttttcgtttgcgagacgccgagaagtcaccgagagcgcaggagcagcgtgacgtgatcgaggcggcatgacgtgagtggcgtgatgtgatcaaggcaaagcgacaggagtcaaatgaagattgcttcggcttcgttaaaacaggcctaacgatggactaaatttcattttctgtattaggctattcagctatctaacttaatatagatccatggcacgtggactagaattatacaatacatagtatatatactgtatgtgcatagggggcccctagattttgggggcctcgggtggccgcacggcctgaccccccctagggccggccctggtattacctttttctcaacaatacagaggactgtgtatctttgtattaagagcaggaaaaaaaggatacgtacaaacaatgaaaataggacaccagccttcttgtcatgaagactgttatattagtttagaaggttgaaaaacaaacaattggtaccttgtccaagtacagctcagtagcccaagttgagatcattgtaatctgcattctgtcatctttcgttaggttatcaagccttctcaacaagaaagtcctgagagcatcctgtcaagttgaggaagataattatttcataaataaaatcacaatattctcatgtatcatgtaaatagttacactagaatgaatcttagattgtaccaaagcatgacagaacatttcctctatgttttcacaatgttaacggcattatattatatttcaaattatcaatcttggaactagcaacacttgaactttgcatcagtgacaaagatcagggaaaaaaaaaacaattgaatacatcaataagcaaagatatctcagagaagctcttgacaatatcaaatggcagatgagtattttagaaagatagatcttacacaaacatgcaataatataccatattagaaagttcagactcctcacaaaaaaaaagaaaaaagaaaaaaagaagttcagactaaactacctgctcaccaacagatataaattttaagctgatctcctcaaatgataggatataattcatctgaaaccaagagaatatattttttagtatcaacgtgaacaggacaacaaaatctttttttttaaaaaaataaggaacagaattaaacagtgtgggtttaacctttgcatagaaggaagctgctatatagtactcttttgtattgaatgcagtatcagcctacaaaagagaagatatttatacaataacagaagtcattgatcatcacaaaacaaaaaaggtccagcttatcatagaggggaaaataataaaggagaaaaaagtagtgcatgggatcgaagtgcaaataaacatcacctgcactagatagacttggtccctctggaaggagttacgacaatgtgacagtgccgtagcatattctttcatgtccaggtatacttgccacatatcacgaccctcatcagatgatgaaatctaaatatatagcttcatcagcaacacaattctggactctgaaggcaattattacatcaaagcaagaatcagatagtctctaacctggaatatagaattttcatcgtatgcatagaaaagcccagttgatgcatcactacaaagtccaattattccttttgtaacttctggtgaactatcgactataagttcctccactatttgctggctgattctgttcactacctaaaaatcacaggttatgcttttgctttgtaaaggaatacataaaacaacagggaagacaaaatagtgacagaaagcaaaatgaatcacagtgaaaacagtatagattttttaaaaagaattgtaccttaatcttgtccctgatgagaagcagaaaatggaattcagacaatgcaaatgaccttggcttgataccagattctcccaattttgagtagtcaaaaaaacctttattttcgacaaagttctcatccccacttgtagagctgcaaaactaaatttagtttaacaaattactatagaaaatacagaaaaaagtaattatatggttattattatagaatgggagacaaactaataaaagaagtgctgcaagttatcccaaaggaaagaaaaaacagtgtcatattgagatcctaagagttcatggagccgaacttcataaaactgtaaaagtagttcttttatatataatcatcaaaatacacttaagtaagaaggtgcacacatgcagtgtgccagtgccaacacctggctcagtgagattggcatgcatgtctctaaagagaagctcaaacagctagcagagaattatcaagtttgaagtgcataaggtttgcaatatataaaaccctgaacattcattagatataatcttctaaggtactcatgtagtcctatagttctgttcatagataatatccagtgacatgattgacatcaagttcttgaaggcataacattgatcattaattcttgtatgactatcatcattctaccacactttatatttatattattagtaagatgacaatttgattatcttgatgagaaaactattattgtttttcctgaggccaaagtagctactttacatttccctaaagaacttatgtttaggagtgggggattacattacttgccacatttcttataaggtcaaaaggcacaccaaggctcagtctattagaaaaatatgcccactaagagaatgctagcagcttagcagttcaatgacatttggattagataacaaagaaaacataagttaataatccacttcagttacatgttacatgatggaatcaacttaaatccaaaaactacagttcacctgtgttgagctccaaaattcagttcaccatggtaaattccagctccagaaagccatccaaaatgcttagcccttctttgcttgataaagaaatgtaattcactggattccatgcaatggatacattgtcataagctcactaaaagaaagtattctagtgggtggcacaaactgtagttaccactgtatagtactgtataaatcacataaagttagggcaagtactataatgacccatatgttgcccctaagaatgccacattggattgagtgatgatgtgaaggaaagaagtgaggagagagatgatgagccacccctaaatcaagaggcaacctccacacaaatttcaagaaggatgtgagagtattagatatattggtatttgtgtactagaggtgatacattgtatggattgcctcttagtttatgagtgaataaaatagataaatttggaggtggtagtcacatctaccatagcacttgcccttatactcacctatttggaatatctcctgggagctccataaagtgtatcgcacgatcagaatagctagcaaaaacagtctgtgcaatatagttgttattagatattacatcaagagaaaatgagtaaacaaataaatcttgtagggctgaaattctggaaaccaagagaaaatcttctatagaaactgttggcatgcaatgctgctctctaaaatggcaaaaggcatcacaagctgttctaatcacgcatatctctctgtaagaaaagaggcatactgacttcgcgtagtatagcactttcgaggttactgagtcacgttattaaatcaagaaacaccgtccatgaggactttgatatccgaagtgaaaaatctgggtctttcttttcactaaattcgatctagattgctcccattacattctataatggtgtatgtctccgaaatttggagctgataaaattgagcaattgtacttacttctaatgaaccgatgcccgtgaatgagtacaaccgtgttggtgtgacagccatcacatagaaccttgtggcgttcccaaccacggcggtttccatctgcacaaccaaattcctccatcacgctcattccaaccaaataacaccaacacaacacaagtacagaaccgcagccctcgatggcctctggcaacaaactcgaacctgcaggcccttgatgccctcctgcagctcagagagcgtaaagagcgacttcacatacttctccttcttgtcggcctcgtctactgcaatctcgaagatctgcccatcctctgtccccaggatcacctccttggtcgacgctacagcaccgaaaccacaaacaactccacaatcaagaacaaatacacagcacggactgccggaatcgagacacaattcgatcgaggaacagtatatgcagtagtattagctcaccttcggtgatggtttggcggttccacgcgacggcattgacgaggacgttgcggaggcgggggagcagcttggggcgcggccacctggcgtggtggtagtacgtctcggcgccccccgggtggaccaccgtggcgacgcagtgcttcccgccggggtcgaggaagacgcggtgcacggagtgctcgccggagcggccggtcccgaggtcgagatctgcagcagcagaggagcgatcagcggaagcgcgaggcggccgcaaagatggcgcctccaagggcgaggaggggaggacgtgccatgggcgtcctcgaaggaaaagtcgtggcggacgagccatccgcggaaggtgccgaggacgatgacgtcgctgccggcagccatggaggtgaccacgccatggcccctcgccgcgtgccgctcgaggggatcgacggagaagagctgcccgccgggggggaaggcgacgtcggcggcgtccatggtcgtcggagtcgcagtcgcctcgccggccggccgccgcgagctcgtcggaggcgatgcgattgcggagaggagacggctcagcccgtgggctaaacggaggagaggttttacgagccacgccttcatgggccgtggcccaatttcagaagcccaatactctggcccattattgtaagagaattcaataaacaacgagtgcccaattccaataaataccatcaataaacgtgagttctatcaatgtcatcgtacgactttatcctaaaaatatcgttgttgttagagttttgtccctttccattaaatacattgttaatcctatagcacttaacagagggatggcaataaaaccctaacgacaatagtatttttggacaaagttgtttgtacaaatgatatatcctgactaatgaaaagtgaaacccaacatacaactaaaatataccatatctgatgaatattagtcattggattcactaaataaaaaaaagctataatcaattttggccatacgatgaaacttaagtagaaaaaaacatagggtgttctgaacccttctagcaggtaagaagaactacatacgatagaaatgtacaccactgaaaaaccgatcttttgctcgatcggcgaaaattacaaatatctcggttttcttaagaaccggtgctaaagaaggtatttagcatcggttaaaatgtctaacggcacattgctattgttagtaccgatactaaagattatttgtattctcggttcaatttttgtcggaccttgtattttgtgaaactagcattcaccgatggtattttttgacttggatgtttgtcaagtacatttcttgatttttctctcaatgtaaacgggccgaaatatagttcgaatttccggcccaatagggcggcccaaatcgacccgacacgaagcccagcaaaggcaagcattccaaagtggaagtggaaccctactccgccgccggcgccaccacttcttcccccccgacgacacgccggccgccggtcgccggaatcgattgcggcgcgctccccaagcagcagcagcaacgcgggaggagagccgggccgccgccggggagggagcaaggtggtaagctccatccccctgactgggtttcaccctggcagctacccaatgaggagttgcgcttcttctctctgggaatttctagagtggcttggaggaggcacgcggtggccggaggagctctgagccagcaccaccaccaccagcagcgtcacctggtgctcaggccacccgcgccgccgcccattggccttgccctcgagcgcttcttctccgttcatcccggcgctccgccaagagatccgccgccgccgcgaagcagagcagccagccaccgccgccgccgtcgatggacggaggtgagccgttctatgtcgtccgcaagggtgacgtcatcggcatctacaagagcctcagcgattgccaggctcaagtcagcaactcggtaaaggcgacgcctcctctttgactgctcattctagcattatgtttatgtgcattcaccatctctcctcacaaatacagaagtacaggaatcaaacacttgctctcctgtcgcatttcatttgctatgaatgtcacaccataagcagacatttgcacttcattgtagctcagctgtattccttgaacgaaaagatgggctactgctttatagtacgcattatgcagctttgttcatgcgtttcgcaggatactaaaattattgttgtggtagtgggtagagaagtaaagattaggagataagagtgatgagtgtcattgatgcaaaatttaaccttctcttgctggtaacacaacgacattaacgggtacctgtagtcaagagccatttcttatgtgaagtatatcttactaggtatgtgatccttctgtgacggtgtacaaaggctattctttgcgtaaagagacagaagaatacctcgctgcgcgcggtttaagaaatcctctttactccattaatgcagcagatgcaagagatgaattatttgatgacctagttccatgccctttccaggtaaagacgatgtatgtttgtgatttcagctttttttcagaaatatgcctctgcacttgccaatgttgcatagatatgttaacgtgtttcctattaaaggatcattctctgtgcccccatagtgtattgtgcaatgctaatttgttgatgtacagcaatttcagcctagacatttataatggatcttacctttccagttaccaagcaccacttccttaattatgttcgcattttctatatatttgtttgaccttattaccatttcactccatttcattatctgtttgaacttcaatcatgctacacattatattagaaagacatatatgatcatcatcagagtataatggcatgattaatatagtatacttaaatactgaatgccaaactgcccccaattctcagggtcttagtttttctcacatgtagtttctcataccttgaatgttgagttgatcattaagttatatccaccaaggttgttgcgttactatttgattctgtgtttgcccataacatactgtgtgccgctttttgtttcagcaacctgatggaactgggacttctactttaaaaaggccactagagatggtgagtatcgatcattttcaagctaagtgttaagatgtgtttgtgttaaaaagtgcccgctgtagaaaatgtgttgcctacatatcacattctctcaccaacaatcatttgctgaaggaaactggaccgtcaaagaaacagcccaaagtctccgaacaagaaccattacctaatagttctgtgagtatgaacaatggaatgtgctagctataaatgcttctgccttcttgcttggttatttgtcctagatattcagtactaacatttgtacttggggacttgtcttcactacaacgaaatgctgacttgttctcaccagtggacttcatcttatacagctctcttgtcttcttgaatttgatggtgcttctaaaggaaatcctgggaaagcaggtgctggagcagtaataaggcgactagatggaactgtggtatgtacacagtacacctacagtactatactggggtgctttcttaatcttcaattatcatgactaactggtgatgtgtttttactgtttgactggagattgctcaactacgggagggtttgggtattgcaaccaacaatgctgctgaataccgtgcattgatcctagggctaacatatgctgccaagaagggattcaagtatatacgtgctcaaggagattctaagcttgtttgtaaccaggtttgtgttttggttgaaccttcactacttctatttttcatgctttagcctagaatcatcaggagataactgaatgttgtactgcagtttgttgtgactatgcacagtctatcattctattcaaacattaaatttccaacaaatagaattttttaaaagcaaaatttttaatctgtgctttacttgatctgtcatgttcttcagttttcctcaccaaagaatttttttatcaaattatctgtgctgcatccatcaacataagtgcaagttgaggcatcagtacatattttgaatcaaggccttgattatcaatgcctcaatggataacaaactctgttggaactaatcactacagctcgttgaagagcttttctagcaggtggcagctctatcaattttaacgtttcttaacataagtaacatgttgactttctggagcaggtctcagatgtatggcgtgctaggcatgatactatggctgacttgtgcaaaagggttaaggaaattaagggaagatttcatacatttcaaatcaaccatgttttgagggtaggtgttccatatatttgctgtcttccacgcttgctgtattttattttatatcagctatcattccggtatggcatatgaattttggcaccacattacattatattgaattaactctttattttccattggaaattggcaactcccttatttgcccctctgaaactgcctctccaatgggcaatcatcacacttcttcatgtactattaaaatttttaaaaatcactannnnnnnnnnnnnnnnnnnnnnnnnnnnnnnnnnnnnnnnnnnnnnnnnnnnnn

SEQ ID NO: 554 - DNA, 13301 bp, Oryza sativa
aatcactgtaccactcacgtttgcttattattatgtaggaatttaacacggatgctgatgctcaagctaacttagccgttgaacttcctggtgagaaattgctttcagaattcactttgcatgctgttacagtgacttagtgttgcacctgatatcttcctttctacagttggcgaagttcaagagcaggcgaacttcctatgacctagtgattgcgatcgagagtaatttgtgcattgcaccaacttttatcggagtgaagctatgtggcaacattctatttccagttgattcagatggtcagacccaacgactcgaatgtggggcaagtttcaccaagtttacagttagccagcatgtttgctagcttgaactgcaatgctgacatggtaatttcagtgggaggagatagtctctaaatttctgtgtaatggcgtagggatgaatgattagaactggaggctagcaattatgctcgttcccagtagcaatactacagaactgttaactatttttgagccaatatgaggtgatgcagcgagtagatccgtgtaacgaggtacagattgagattggcagtataacaaaatacaaagggatactgcagctatttctgttgcctgttcaatttatgaattgaaaggagaaaataacacgggctatgttgtttgcagtgccaaaaaaaaagtaaataaagattgtcattgctaaggatttgaagatagctacaaaaaaagggtaacaaagttgtgtcgggagtggaacaaaattgtttgagtggactttattgtgaattaaaaggagaaattaacaggggcatttttgtttgcattgtgaaaaaagtaaataaaatggaaggattggaaaatagcttaggaaaaataaaatggtaaaaaaacattatgttgagagtgggatttgaacccacgccctttcggaccagaaccttaatctggcgccttagaccaactcggccatctcaacttgttagtacgttcgtgtataatatttatttaactctgtaactcttccttgcttattgttttgttgattcaggattccaggggaatccggtttgaatttcgcgaagtacagactttccagaccgtgtcgaaaacacaaaccacttgtttttcggtcaagttcaaaaattttcaaactgaattttttttttgacaatttatttggatttcaccagtttgtatgtttagtaacagattccatgaaatctgatggtatcgctcgtgagcagattttgatgatccggtaacagattcctgtcactactgtcgattgaataatacacaatccgaacaggaactcattctaaacagggcagaagaatatgcaatctatgaagcttcacatggctgcttaaggtaatgatctgaatcacctgatgcaggaacagccaccaaacggaaggtcactcaaatgcctaaattaactctgttcttttccatgtctttttccgactgttgcaaacgcagtttatgcagaagagactgcaagcaagctcacagtcacagatggggcaaaggtgaaagctgaaccaagcaaagaaaccaaccatgcacagtatatgaacaaaccgaacaagagcataatgcgattcatatatctgacacaaagcaaggatcttcagaaatcagtttcgagtggtacagaacagaccaccacctggtgttcataagagacacgagtcataagagactgtggcaccagattacatgagttaatacaaaggcctctctactgggagagcatggatcttgactaggagaaccatcagctcctgcaggtttatgcaccatcagattggaaggggttggcaatctcgtccgttccatcggttggcgatacaagcatcaccgctgtacccctacagacctgcaacaaacagtcgttggagctgaggtgtcaggatgatgaaaccagccaaaaagaaatcaaatggcagaaacaaactagtagtttgcaagaaaccaagctcttgattttgagattatttttgtttaatcactgttttgttgtaaatctgatcgaatcaacatttccagaaaaaaaaaaaactagtgcagatttcagcaaagtgcaaaataatcgtatagcatggaaataaaaactctcagagcttccttctcttaatgaaatgatacacacatctcgtgtattagagaaaagaactatcagaactacaatcggcaagcaatataaataatataggacaaagataagtcctggatattgaaatcaatacagtcctggatattgaaatcaatactgcaaagaaacttacaataagaccaagctgtctggttttccctgatagtttcaatggatcatcttgctctacaaaatgagaaagtatgtatgagagcttcactaaactttgcaggaaaagatttaataaggcatttgttatctacaactgtaccacacctacattagcaagtagtactccctccagtcatgattgtttgacaatgggaaaactaaaatttagtctatgtgtaattattatgctgtattccagcccaatcttctttgtacataacagtagattagcaccacataaacatacaagatgcatgaaggatggaaatttcttcttagttaagattccaaatacatagatttgtgatttatactcaaaactccaaaccaatggggatcaaacaaaacaatgcaatgtatcaacatatgcagcagtacctctttcaaattcaaccgcttcatcaagcaccaagtttagaagctggtcatagcccttcaaagtccctgtaactgcagatgtagaaataccaaagttatggcctgtgatgtggtattagtgtattataacaaactgcaggataacaaaaacgagttttctggaaattgaaacagttctactgtcattttttagtctattttcaatctttatcttaatatcaatgctaatggctaacctccttgcaactactataaacaatgtcaaaacttaagatattacataaggggccgctcatctgcttgacggagtttctatttcaatatacagttagcatatgatattttaccactctgtccgtaaaatgatactgaaaaaagaaaaaaaataaaggtgaaaagtcatcatatagttatcaggatagccaaccatgagagtgccttcactatctagatgaggttagctacaaacagaatacaaggtgtaattcaaaaatatgcaatcacagaatctggtatctgtgagcatacagattgaaagtaaaaaactggaagagaaggcggtaagcttctagtagggccaaatcctctccacatgcacatattggtgttgctgaaattctgaatgaatgcaagtggaatgctggtttatatgtggtatcatacagaacactggaatcaatgtttaagggattgagcggagctcatttccagacttattcattatgaaagaatattaaggaattaggaagtgtcaattgataaagttgctactcgttaattttaactgggtggcggatggcccttggacagcaggatccatcacaagaaatgctaaaagatgaccaatttgtgacaaaaccttaatttaccaaccaccatgcttgaaaactcacaattatgtgctataagcattcagaggacatgttaaaactagccacatggatgctgcgctcgacatctcagatcattactgtggactggagctgatgcgcacagtgaattttactgaaataattagtagcttcttccaaccccatcatttagccttcagcttataagcgtaagtgaaaatttgaattttaaaactattatagagttgattttggtgatttttcatcgtagtttcttttgttcagcatttgcttttaaatcaccaagaactcatatataaaagttttacccataaattatatttttaatcgctaattaaaccgtttcacttataatgaggctgttcgagctggctataccctactctacaattttgctgcagacctaggatttcctgcccctgccactgaggtttcttggcacaaaactatacccacatctacgagtattcaagaatccagacctaaactggtgatgaaaccaaccaaccttgcctgccgccggtgagcttgacctggacgcccttgtcgacgaacttggccaggtccagcaccgtctccttgcgccccgactgctccaccaagacacgaaaccggaatcaatcccaccaaaccaaaccaagaactagcacccgggatcgatccaatcgagcacccgaaaccccaggaggggagaagagggtttacaacttaccatcccggaccttagccgcggcctctggtcgcttcaaatctgcgaggcaaggagggaaactttgtcaaatttcgctgcaagatccgagacgacggatgggagaagacacggcgcccgccggcgacggcggcggcggcttaccggagttagggggtggtggcggcggtggcggatgcgggggttgatggtgttgtgtttttctctttttttttcttctttttttttctttttctcgcaatcactttatagaggtataaggaggacttttcttattgggccttcagcccattttagagatgaagcctaattgcttcaatgtgtatgatttgaagcccaattaatggggtgttcctactgcacgcgcacgcgccagaacgggaagccgcgcgtgttcctactaaccctagcgcttaccgtgtaaaaaaacgcagtacatttttttttcatgttcgcacctctttttttttctctgagcgcgttttttttcctccgtttctttccgatttttttttaatcttttgcacacctctttacaaatgtagaattggaaagttttttattttgacttgaaattttttaatttttgtattgaaagttttttaatttgagttgaaaattttcaaatttgagttaaaagttttcaaaattgacttgaaagttttcaaatcttgacttgaaagtttttaaattttgtattgaaagtttttaaatttgagttgaaagtttttatatttgagttaaaagttttcaaatctggcttgaaatttttcaaatctaggatgaaaagttttaaatttgggatgaaaagttgaaagtttttaaaatttaacttcaaaaacttttcaaatctagattgaaagttttcaaatctggattgaaagtttttagaatttgacttcacatatatatttcttttcaatttattacttaaaataatcttcggaaaaaagacaaatcttatcttaattattatcattacctagaactaaccgaatcagttttatacgtatagagaaaaaattccgaaaaaaataaacgcgcgtctcgccagcgcaagcgctgagaatggctgaggatgagacgtgtgggccggcgcgtgcgcgccaggggcgcgtgcgcgccaattaggatttgcgcaattaatgtgatgaacaactgaactatttttgctctagtgagaacaattgaatatacgatactaccctgtcccaaaatgttgcctagatttataatggaaagttaatatattttggagcgaagataataatattttttcctaataaaaagattatcttgttttattaaaggtagagataaagttaggtacgaaaaacaagaaagtgttgcgttttaattattactaagttgaaataatgatttatcatgtattttaaaataacttatatataaaatgttttcacatggaatatactgtttagcaatttgaaaagtatgataataaaaaccaacataaaaattactatatcttaatgggggcaaatggattttttatactaaaaatcaacgaaaatagaagaagggttgactctttcatgaactctatccaaaccatgacaatttttttaaagtttttttttgtcaactatgtttcaaatctaaagtagatattaaccaactaattgttttagctatgagttgtgtatatcaatgcattaggcctgtagttttgctaatcaactactagatgttagatgtgttttttaagctactaactccgtctcaaaatatgttacatttaatattaaaatttatcataaaatacaactaatagaattttctatgaaccgttccatctcaaccaatcacaatttttctgatttaattttttcacctactttttttttcaaccaaccataactatttctcaccctaacattaatgttttaaaaaagagagtaggtagttgtattttgagatagaggaagtgataaacaactttcagaacaaacttttatgtctgaaaaacacatggttgatatgcctagttttatagtcttaacttttaattttttggaccttaaaaatactcctacattcttatagaatatagagtttaaacatttttttaacaaaatgaaacaatcccaacttcctcatagctctagatccaaaataattttgagctaatgtcattttaaacacgaaagtagctcaaaataattcttgagaataattagagttttaaacacgacattagtataagtaaaaactatgaccctagtggctcaaaatcctggctccgcccctacatccaacttttattgaataaacaaaaaggaccttaagctgtggtttttgagttttagaatttaattttaaaggtaattagtttttttttgccgctactttttctccgtcctcaattgtacccggcccttagaagcataaaatttcttcataaaaaatattattcatctttatcacatatcttcgttttagagcgagtttaatagtgtagccaacttctttccctaaaaatttagatatcatctacaaccactttaatagcctctgtatagttttatataaacatatattgcaccattaatacttggcctactttttatacatacacaatatcttatcttaaagttcgtgttatagctgggctacaaatctgcagcactttttttctttctcctcttctctctcctccacatgtacttgtagctaaccgcctataaccttctattactcttacaagcgttgcggccataaattaaagagatctctaaattaaaagtatcttccaaaaagatccaaggaattaattaaatagttggtggattgaccattgtttttttatatattttttagctgctagattatcatgagcacgcttccaaactgtcaaatggtgtgattttgaaataataaatctttctatttttcaagtttatagcatttaatacgtaaattgagtatctttttccacaagccaaacggctaatcagccaaaccgcatatccaaaattctacccacaaatttaatattgatgttaaagtttcttttgatcgtaattagtttattttggtagtaattttaagtcgttaaaaatacatatacaaaaatctcgtccataactttttccaataataagcgctatatatatcctataatcagccaataaatgaaatgattacacttaatcctggattaattctcggaggagtatgaaatgcatctgcagtaaatgctactccgatctagcccccatcatttggcttattctagccagacattatatttgcaaacaaaaaataaaaaataatttatgaataaaactttcatatatgtgttcttgacgatttaaaagcaaagactaaaaaataaactaaaatgagaaaaccacaaaatcaactgaaaattcaaattttccatgataagcaaaatcaactaaggccgtgtttagttctctgcccaaaatttttttaaagtatacgacacacatttgaaatattaaacgtagactaataacaaaataaattacagattccgcctgtaaactgcgagacgaatcattagcaaatgtttattgtagtatcacattgtcaaatcatggcgcaattaggctcaaatgatttgactcgcaatttacatgtaaactgtacagttagtttttttttgtctgtatttaatgcttcatgtatgtgtccaaacatttgttgtgacatttttagaaaaaaaaaaaggaatctaaacacaccctgaaacgatgagcccgtaaggtagctagggtagccccagctagctagctatcaccagctgagcgaggcttgctctggaagctggaaggctgactgactgactattcagctacatatatacgagcatatataagctagctcgcgagctatcctttatcttcttcttcttcttcttctttaggagatctgctcatctgatcgaaatccagctcccctcgcgcgcaactagctaatcgccattgtttcctctcttcttctctcgatcgatttgctgccggccagcgagagagctagctagctagctgcatcggcgagcgatctccgcggccggccggcagatcgaccgtcagctagcgccgacggctgcagcgacgacgcggtcgaacgatcgatcgagcacattgtttcttgtcgtctcgttgacgatctccacagatcgatcgatcgagctaattaaggcgtaagatataataccaaatgtgagctcgatcgatctgagtgaatatatattgattcccccccccccccaagttaattaatttgcacttgcattattgttgcataaatactgtcatatactcatatgctcaactatgtatgcatatgctcgtatatattatattagagttaattggggtgtttttttttctcctagatgcatgtgtgagttcattcattatttggggttacctagctagatatatatgtatctataggagcatcgatgtgccatccagcatcagttctggtgtcctgatctattagttgagtacctgtggtaaattaattaatttacgtgtaattaatatatgcaaaactaacttctcaaactaacatccaaatatacaaatgatcgttagcacagctaattaattagtgtaaaaatgtaaatgtatatatacctgaaaatatatatttataatggtaatatatatgccattataaaccagacgccgaaatgtaattaagatatatacataatcaattgtttatcgctttattattagtttggttttctactgctagtcagaaaccccctaattaatttggaacaagttaagctagtagatcacaagatagggttgggatattgcatggcttgtcatttcatacacgaattcaatgatgaatatagtatgctatgtatcatatgtaccgcatgcaagcatataggaaatatatcgatatatatatatacaattaattattaacaactggatatctagtccatttgtaaacatttgaaaatggtagctggcagatcactccatttgatacaatatgatggcttgaacaatgttttatagctcaatcaacatgacatatatatgtcacatatttaagtttgggtctgcagctagtgtaaaataaaaacatattttcttgtacatacacaatgcatgctagctttgcatcatggtacatatattttatatattattcgatgcaatcatagttttattatgtatttttcggttttactagcaactaaagctagtgtccatggtactgaggggttgatttgtaaacattatgtagaagtacgcttcttaactccttttattagaacttatatttatattaaataatacaatccataggtttgaacatgtacttcaattaactcctttcattagaagttactcctgcatgaattgagttgcaatgatcttttttttaggaagagaggcacacttctcacatttctgtcactagaaatgaaggttaaaagacaaaagtttgcgaagacaattaaatttgtcatggtaacttggtaccataaatcccaccattcagcgtgagagtcaaatccaccattctgcatacctagcaaagtctaattaagccaaagatccttcaaaattaccacactacatcattacatcaaaggagtttttatgcacacatgagaagctcaaaatgagctgcatttcaactttccaacaagaagcttccaaacagtgcagctagggtttcctgcagttgtcttgcattaagccctcaaccatacattgatccatgtacttcacaagccacccgctttaatagttgcgtcctgcatttgcacctttctttgcttttcctcctccttttgaccaagatgaaatctagctagaaacaagtgtagtgtattagttcaattggaacatttggtagttcatttcgtgcccgtttgaaacaaatcatgcattgaatgaattatggcagtggattatctacttgcttatagggataaattgaatattttgataaataaagttaacaaaaatcttaaagcaagtagtctaagcaatacaaatagtagaatatattttttagaaagcgtattttagaggcgtggagcaaataatctgtggtaataattcggtgaaatagctaaaaagaatgggggcaaacatgttgcatttcttgttttccagatagaccaaatgattgacaccacacctccaataatcattttctgtgtttctttatcaaaataatgcatccaggtcccaacacatgtgggctatataatttcctggtttcagattaaaggtacaagctaccatgaattccaaataaatattgccaagggtcactttaaaaataagtgctcaattgtttcatcatcagcacaaaatcggcattaattccttttcccctttcttctatcctttcttaaacaagttatcttttgttacaatactattcttttgcaatgatctaaattgttacttgcaatgatatatgtgttttgttcttcagggatgaagaagaaaatagcatgctgcgcatattggtggcgactgactgccatctcggctacctagagaaggacgagatccgaagattcgactcatttgatacttttgaggagatctgctcattagcagttataaacaaggtatatcttatcaaaaaatgagaacaacgtgtagcctggctggtagagagctaccaggggcatgccattggccagagtttgatccccctcaaacccaggttttctcacaattttcttctctatcaatactggtgctaaatttctccttagtatcccaacatattcgaaaaatatcttatcgaaaattgatattaattcagtttttatttttgccaagttaaatatcatcttatgtttgtgatgatcaggtttatgagtcgtttgatttttttaaaatagtagaagaataactcctggtgtttggattaacgagaatgcacaccaccattatattcctatgacctaaaaatactgaaacaaatggaccacatcaagaaaactttgtacatagaatgcagagtttcagtttcataattaagctgaaaataacaaatgaaaagcttccatcttctaccttaaataatccgagttgtttgataattgatatgatggttggagatgcactgttaaatttgcaggttgatttcatccttcttggtgggaatttgttccacgagaacaaaccttcgatttctacgctggtgaagagcatggagatcataagaagctactgcctgaatgaccatcaggtgcagtttcaggtggtcagtgaccaggcagcctgtctgcagaacaggtgcagtaaattaaattatttgatcttttcatggctgaattaacttctcaactttgttactttatctcactaggctttagctaatcatcatctaattatatattaagaaggccaagccaattatttattcctggctactgaactattattcagaacttaacacattatgatgtcattcaggtttggtcgagtgaattttgaagacccaaatttcaacattggcttgcctgttttcaccgtacatgggactcatgatggcccagcaggagtggtatggataacacatagtaaatactatttggacaaattttgaaatctcacaaacacttatgcatttctgctcatgaaagtatatcctcaaggtcttaattctttgttcaacttataacgaatttggtttctctatttgtaggatggcctgtctgccactgacatcctttctgcttgcaattttgtgaactattttgggaaggttgatcctggcagttctgatgttgatcaaatatcagtttgtccagtatttataaaaaaagtaaatttattttgttctatacacaactccaagtaatcaacaattgtaagataataattctgtgacttgtgctacttgattcagggtgcaacttctgttgctctatatggacttggtaacattcgggatgagaaattgagcaggatgttacaggtatttataataataaaaaaagagcgcatgattacgatttgaagaattctcatgtgttgtgcacatggagatgttaacttgttgattatgaataatttcacatgtatgtgcatatatcgtttttcagacacattacaaaatacagtggatgaaagcagacagtgaagatgactggttcaatctttttgttttccatcagaaaaggtatgcaaagtggctcatgattataattattctttgttgtcttttttcacttgcgcttcctagcaacaatttgtctctctaatttcggcaggagaaagggaagctcaacaaatggcatcaatgaacagctcttgccaagttttcttgacttggtaatatggggccatgagcatgaatgcctaattgatcaccaggtaacacattttgagctactgcaaatttcttactaatgtttgtcaagtgttatttttatttttaatctagctaaactttgcaggaggtttctggaaaagattttcacattatccatccaggttcttcagttgctacctcactgagcaatgctgaagcaaagccaaagaatgttgttttgttggaaatcaaggttaacactactgcagaatggtgtattgatcatactattttatcattgtctaatcacttatatatgtttcccttgaatcagggaatgcaatacaagcaaactaatataccattaaaatcagttagacctttccaatatgccgaagtaagccattttcactctctacttacttcatgtttactttcaatgagatgattctcatcagtagcataccatataggttcaattaaaagatcaattgggtgttgagctcaataacgaagcagctctttatgagcatttggataacattgtaagttttgagcccatagtttttgttcgaaaaatacttctacacagtttcttgataaacatggccaggacattgatcattcaattggagttcaataatgatatgttaaatgggaaatatcctatgaaaacgagctaagtgttg

SEQ ID NO: 555 - DNA, 21559 bp, Oryza sativa
  unsure (1)..(21559): unsure at all n locations
agaaacaaaaatgacaaatttcagataaatagtgtcctgttaatattcattcaaaatttgtcttttttgttactcccaaataaagttgagtttgaacttaagatttggtgagaatgtatttcatatatacacatacctctagtaattgtttcatgaatttacaaaacttctaggtatgattttcatgagtttccaacatttagctcgttttcactgaatgtctgaatatgtcctcatgttaaatgggaaatatgttagaaattggatgtttgcgaattgtagttttcagcagtactattgaatacagagttatttcaggtgagcaatcttatcgataaaacagcaattagtggatcagagcccaaacttcccctagtcagagtaaaggtaaaatagggtgctcttcagaaaatattaccttcctttaaaatattgtataaattctttatgtcaaatttctgaaggtggactactctgggttttcgacaataactccacagcggtttggtcagaagtatgtcggaaaggtacctcaaccactaatatgaaatttactgatgcatacctcctttatcatatactttttttttattgaatcctttatcatatactttaactggtgtattctttacaggtcgcaaacccaaacgacattattctcttctcaagatcagctcaacagaatcgaacacgaggtacctgtttatgtttcatgaaaaatgggaatatacttcaggttaactgcactaaaataattaggaattaggaacaattttgatattaattgactggaaaaatgcatcttaatctttgttgagtaatgtgttgttcactctctctttatattgcagaacacactggtagttctgaagaatgtgaaccaaatgagctagatcagcaaagtattgaagaattaattgcagagagtaacttggtactaatttaacattctcctggtctaagtctagtagtgtatcatgttggtgtccttttaattcatggtggccaggtctattttgcttcagatatccattcctttagataattccaggttagtggaaacaaataaaaatacactggcgcatttaatccttcttttacagaatatgcagattcttgacaaaaatgacctagacagtgcactgcatgattttgtcaacaaggacgagaatatggcgtttcattcttgtctggacaaaaatattgatgcagcaaaagtaagatattaccatcatatagttccattcaggatatctcatatttgcaatgaaaaaactgtttgcttgggattgcagaaaaagttgacgtttgcaacaaaggatttgaaagctgaagaagatatagtacttcaactggatcagtgtatgcaggtacagaggaactctatttctgcatatactagatttgatttcagccaaaaataaagatagcgaaaaagggtgttgttaattcttactccataggagcgcatgaatgaagatcccctcctctccaagggaggatcagaaatcatgccgtgctctcagagcctgccaacgaacgcgctcagcgcgtttcaggaattgaagtgctcatcaaatgaggaacaagatactcatgaatcagatgaacttatcgaaatttctgtatgcattgttttcctctcttgttgcaaatatcgtcaaccagttgtaggcttgtagctcaattctagtatcattgccaaatgtcatcttgaactgcttttgctgttccatgatcaaggacaaggagcactctcaacaagcaagccagaagaggccagctcctgtcgatggaggctctcaatcttcaaggagaaaaacagacttgagttctttctaccgtaccgcaccgtcgaagaacaatgatgatggtggcaagaaaggcaaagctcctgtaagtaaaattctctgcagctttgcctctctgttgtcactattttgtagtagtcagcaacattcagatggatatattcagaactacattcaagttatctcctgtaactgctatgtacaggttatctgaagatattgctctctgtctagcagatagcaggcagatatggagccataagaagaagatgagattaggatgggaatgagatcaatggccaaaatggatagctgatgcaagccttcagctacattctattccttttgagaatttaattgaatctttatatatatctgaatctgtatgtattatccggttcatccaaggagactagactagtttgcaattactgaaacaaagaatgtgatgaccatcttgttagttgggttcctagctctagcaagcatctatggcaactcaccgagcaaacagcagaatgggcggcgccgccatggcctgtccacctggccgccggcgcgtgagatgcggcggcggcggcggccaaccggccatcttcctcctccctcgatctctgagtttccaccgcggagcggcactcccctcgccttggtttgattggactgagtggtgtagaacccagtgactcctagaagcgagctctggcggcgccgtggcttcacggcgcccagggggggggggggtctccggcgagcggttcggtctccggcgagttgccgccaccgggtgctaccgataagtgggcctcacgatcccactcgagcacgcgactggtttaattccgaagagaccctcgaactacacccgtattatcaatctactccacccgtgacaggatctcgaccgttcgatctcccctgtgcggctcagatcaaaacccgaggcgatggggaagagagattttgcaacgaaaccctccttttatcccgctcttaccaacgggtccccagaccgcagaaagacaaggagggcggcgagccggcgaccatggcgggccgccggccggccgaatgtacggaatgcgacggtgcgggagaccacggaagtcccggaggtggatgccggggagttcagtttagtcggaaagatcagatcctggcgggactgttcaatcgctctccaggtctctgtcttctttttgttcctcctgatttgtatggaattgggggatttatgaatttatccatacccaatcgtgtttccatcgtgtgtagtaagttaaaatcagtttattttaaccgcgacgattttttttaattatgtgatttcaccatgaattgcaactaaggattgcactgtccttgttattgccgtgttcttgggctcacctaattgtgaagaaaagcaattgcagacgggatttagttgttaaatttatattggagctgcttttatgcttgttatggttgatatcaatagtgagtgatcaagatctgaagaaggtcacgccattatatgctgcatataattgaattttgttaggttcagcaacaacagcaacaacatttgggcttgcacgcttctaaacacaataaataatgcatacactttttcttgtgcgacttgtatttatctatgtgaatgctcattagtttcttgatgttatatgtaaatctgaatggcaatagttagctagttctttttgtttctagacattattttggcctaaaattgttcactttgtgcttgtaattagttgcgttgatgtcccataatctgcattgtggtctgttccatgtcaaacttgttgtcacactgatacatatttcttaacaagttctggatgtgacatgtcagtagtttcttaaaaaactaccaaatttttttgtgggctggagtaatttgagtttcgacaatggagtggtgttcacaaaatttgcttgcagtgttcatgaggtgcagggtgatttttccggtacccaaatgttccaacattgtagaaaatttatgatgagctattgagttacttgtaaaactgttttctcaacaaaataaggtataaaatcattgtgttaccatgtccatataagacaacaaccaatcatgatgttgtagaaaacatgttatacgctgttctgagacataaattcatcagtacattttctcagctactcctgggccttcgtttctccgagattttccagcatatcaaatagcattggtgttcacaactgctataaaaaatctaggatattcccttcaggcttcagccatggtttctgtcattgtagtgcagtgaattttcaaatccaaaactcactctgggattgatgtggcatctacttacttttcttttgtaacttcactactactattagtagttgcagaatcgatcatcttcttcttggatctggtcttcttcttcttgggtctcttattctgttgttgagttccatcatcatttacagacatattgggcttcacagcagcagtaccaccagccatgtcttccacagtttgtttcaatccgtttttattggcatcacctaagctatgcttggatatcttttccaaactaccatcaatactctttttattcttggtttcaccagaaactttatcaatttccttctccaacagtttattgtacctgacgcgatcactgtcctggtctagggagttccctgggtgttctatcctatgcagttcttcatcttggctgtctactccactgttagtcaaaaactttttgttccgccgaggaaattcgatcttctttgaatgactttccccgtagatatcatcaatatcttcaatggcatcatctgttttgtcttgtaagccatcttcttccttgctagttgcagatttcacttgcttttcttctaaagatgtgtcttttgggtgtctactttctgctgttgtggtattcttagaactcttttcttctgctctagtgggtgtagcatcactggagcttgtgaccttttcgactacagcattgtcaggtcttgcatttgcgttgtttgattgaacatgagtgctcttactgccgacgctcttccgttccgttgtcttgtaatcctggaacctgaccttgatctcttcaagctcggcttccttctgctgcaggagctccatcagagctgccatctggtcaggatttgtgcctgcggctctctcttccatttgtctgatgtggctgtttttatctgtgagagttgcttccatttgactgacgcggctatttttctctgcgagaactgcttccagttctttctctctgttcttcagagttgtggctgtggcttctagtcctttgatcttcgttttcaggtctgtcttctgagtccttagggaagatgttgtggccttcagttcttccaacttcctcttcatctccttgttaaacgccttctctttctggaaggataatgtagcagtgttcatgcagttagctactcattcacgggataattgttgaattaaaacaaaaacagaagctggccaggccaaataatattttgctacgcacactcttaccatcaaaccatttttctggaacacagttcatacaaattagcaaatttctaaatagtaaatgaataaatgttcggaacactatattcttagttacatggactgtgggaagcacgaagaaaacataacctagttttttttaatagatggttgtcagtcacaaacaggtttcagtgtcgcaattacatattaattgggggtaattcaagtagtgtgtaatgcatagcgctctgatttacatacccttgaaaagaaatggtcttgtctggcgatactgggactaatttttcacagattatttataaggtctagcactgaacagaatgatgttcagtttagcattctcaatggtaagaattcaaaacagagcaccctaattgttacagttgacagactttatgcatcgggaagtaatgcatagttggctcgattcggttcatattatgcttcgagcccaaaattgtgttgctaatattgttcaatacataagtgtctgcattaaaattatgcatttcagtaatgtcacaaatataaaataagtgcacatttcagagtcagcaaatgtacttgctggtattgttaaaactccaactccaaaaggacgttcttgtgcagtgagaaatggtcttttaacaccaatatattgaatgctgtagttaagtttggtgatcatggtcaagatttgtgatttaaaggagatcatcctattagagagagagagaacaaagaatggttacggtttgttagtaagaacagcttgtcaggtcgtcaactgctttaaacttgtaaaactttactctttttaagatatttttaaaaatatatcatttacttaatttttaaaaatttggagtttggttgtgaggaagaataatttcctttgcaccttctagttattacaaataacaactgagatatgaccatctggtatatgcttctttgttcgcttaaacaagacacctcagaaactaacaggtttgcaagacattgtgcaatgcaggtacatggaaatagcagtaaagtgcatcatgatccatcaccgtacctggaggaggatccgcgtggagatgagctgccggtcgcgctcccggagaagaacagcaaacgcgcggcgctccctgaccttgtgcaggacgacgacgctgagcgcggcggcggccagcgccagcagcagcagaaggacataggcaaccttcttgctggcaccgaccatggcagagcccttcgccctgtacttgctcccatccatcaccttcaccttcaccttctcctctgcacgccgcaccagctgctcccgtttgcgccgccttctcgcagtgatccctttgcaggatcttggaggagctctaccttgtttggagcaaattgtgaaagaagctagagctggagctggagcttctttcttgggtttgggaacactatagggctttggagactaccttgtgcatggaggagggaacagagatgagcctttgaggtgatgcactcatttgctgatcgatgcacatgaccttgaagtacttctaggggagtttgaggaggaggggatcgagaaaattagaaagatacacgaaatgaggtgagctattagctcgtgattaattgaatattaactattttaaattttaaaaatggattaatatgatttttttaaagcaattttcctatagaaaatttttacaaaagaacacacggtttaatagttttggaagcgtgcgcgcggaaaacgatgtgttttctccctcaatgtcactagaactgtggcataaataaaaaaaaagatcatagccttaataaaaaaaataaaagatgttctgtccattgacttgcacttactgcagagtattagctacgggagggattactactgactgcatatggatggtctaatgatgcaccggatggtccagaatgagctaagccatctgaaggttcaaaatgtgcaagtaggaagtgccgttttttttagtttgtagaaattgattggaagtgtattgtcagtcaaaccggctatcttgcggtaatgtaacttcttcctccatccaatcttgtgaaaagtcaacattgatcataatattggcattaaatgagattcttcttctatgcttctcagatctccaggcaagatgaataaatctattcatggagcagcaggcagcaatgtgagtgctccaccatgaatatattagacctaggcaggatccatcaaagacgtgcggatttgttaaccatggctagctagtatagctagttccaaagtccaaagagttgccaagaagagaagaacacagctggttgctttaatagtttgctccctctggctctatataattcttgatgttttagtcttttagacatggttgaagtcaaataattataactttgactatcaataacttttaaaatatttagtttgtagacactagaacaagacatatagattactattaaaaaatactttgataaaattaaatatttactgttttttctgtattataatagaaaaaatcatagtcaaaaatatgttttggagaacttatcgttgtccgaaacgagtactagcttattaccatgtgactctgatgtgaaatttttactttttacaagatgacatggtgacttgagatgcagcatgtgcaggctccattttgcatgcatatggatactcagtagtaaactacagagcaacagtttaatggagtatgtcacaaatggccaacaatgacataagcacaactgcaatctgcaatggaaggtgagtatatgcatgcttgcacggccatctcttctaggtggctgagagcaagtataatagagggctataagaaagctgaatgctgaggtggatgagagaggagaggagagagatgagaagcgggttgtaagtttacagccggcttaggcacaagaaccaataaaatctgtgagacagacaggtggactatatatttatagtgaaaagttaaccactatataagtgagctgatagataggctataagtaagcagttggttttattattatccttgctctgatgggctgcatgttgattctgctgcgtcggtgaaatgaacccaagaacatggcaggcatcaatcaacattccttgcatcatgaactggctagttgagtcttgtgggtggctctatgcgaattcagggaaaatagtgtcccaaaggtcaagtctaatatttcttgatggattaaagatttgtaattgcaacgagtttcagagttcagttccaatttggtgggaaactggagaaaaaaacttgttaaatgttgatttccatgctttgttcatgtgtatctcactggacgctgctttgctgaaatgtactttacctgtatctatcacaggttcagaacctgtgattgtgaggcatcatgtgaataaaggagtgattttacaagttggaaatgcatccgccagttccctttttgttcttttctgcaattccaaacggaaacatccaaactctttttttcaaaaactttttatatatatttttttaaaaaaataaaccccatttcaaagtttgtaataattaatatcatgcgctaatggcttatcccgttttttaaaaatgtaagctaaattccaaattcgaactaagccttagatctgaaactgttccagttgcaaccactaactttatatttctatcttagcgaaatgaaagctgggtcttttgcacgttctgaagaaatataatcagattttattttaacgacggaaagaggggcgaagcacacagaaaaccaaacgtgtcaaaacaagttgcaactctgaagaaagcacaaagatacaaatccatcagcatcatgcaatgcacttgactcctccagctgaccctcccagtgttccaggaagaggctattttaacctgagttttttttcttaggaaatagtatttgagtcaatacttttgaccgatgactccatcagaaattcaattcagacacatgtcagttttcaattccttggctgccaagccaattcttcctttctgctgcatcatcaaccactacaaataacagacttcactacctggttttttcagtcacctgaactcctgaagcaggcaagcaatttgtcactctgttcttgacaagaacacaagaaaaaaagcagcagttttttctctgcagcaatggtgtacgaagcagctgtggccagtgcagcaagaagccatgaacatcaggtgaggaaggagaagaagctgaagcagattggatgcagcatcctctgggctttcaggaggatctacccaacagcctccagcgcctcagggaagaaatgattgaaggttatcatgctgtgacagttgcatcatgatgtaaatacatacataacaggtcaaaagacttttcttttcttttcatagatgacaatgttaacttttcgatactcgtttgaccattagtcttatttaaaaaaaattatgtaattatcatctattttgttgtgagttattttatcactaaaaatatctttatgtatttgcataaaatttttaaataagttgaatggttaaatgtgtaagcattgtgattgtagccacgaaagaatggaacatggtgtacaatgaattgttgttgtagtcatggatcttttgatacaacatccaggtgatgatgacatgatgtatcattcagaagcacttgattacagttcggacttgtgaatgatagtgcagcacaggaaatgaaccaccaacctaggccctgtttagtttccacgcaaaaacttttcactctgtcacatcgaatgtttggacacatgcatgaagtattaaatatagacaaaaaaactaattacacatattgtgtgtaaattgcgagatgaatcttttaaacctaattgctctatgatttgacaatgtggtgctacagcaaacacttgctagtgacggattaattaggcttaataaattcgtcccgcggtttatcggcggaatctgtagtttgttttgttattagtctatatttaatactttaaatgtgtatccatatatctgatgtgacacatcaaaactttttgcccctgaatctaaatacatacctactctgttgattgccaaaaaccagaggatcgtgcaacttcctgttgatattatgaggtgatgggtgtgcggtgctggatctagcaacgttgcctgaccctctcacaaaccacaacggctagtttccaacagttataacacaagaattactcccaaaatcctacaaatatagcaacctagtattgtctatgttcagatttctagtattaggatgtgtctaatcaaataatagatcggtgtatttttggacagagaggtaataatcaattctggcatacaacaaatgtagaatgaaactataaacaaacttttctctctctctcgttcatcttgcttggcctcctacgctctttgtcatccatacaataagcaaacttggtgacagctgattgtacatcactccaacaattcacgagagaattatgattgcgatccaaatagatcgaatttcttgtgctcaaggaaataagaatgaatcatgatccaatagctagagcaaggttgtttgttaccagtaactaggatgtgtctaacccaatactaagttgctatatttttagacaaaaaaagtaataatcaatttcaacatacaacaaaatataccaagaaactagaaacaaacctcatctctctcgttcatcttgcttggcctcctacgccctctgtcatccatacaagaagcaaacttgttgacaactgattatatatctctccaatgattcatgagagaatcatgattgcgatctgaatcgatcgagtttcttgtgctcatggaaattagaatgaatcactatcctacaactgatgaaaatttccccccaaaatttcttgctgcagaacgggaatcttagatccatgatggaagaaaaatctggcatcttctaatgcacgcacttatgcacaactaatcttctactttaagcggttcaatggttgaaccacacatggtttgtctgtttaagtattcattaccttttgtagcatttcaatctgagctcgcttgacggcggaactttctaagtgttgtggtccttcttgagggcattggtaaggcacccagttctctccttggtgggaacccctgagggaaaatagggttcagaacccttggacgagcgacagctatgctcttagcatcatatccttcttgaaggcgccatctagcggtcccgtttctcgcattctctgtctcaactctcaagcaaatggggtattttttgtaaggcggcgggtttgtatgagggacgagtggatcttcttctctctcttctctctcgccttctccctctgcaacccttctcgcgggtgtgtccaaaagatcgtgatttcagctgtttagaggcatgaggcaagagcaggtgggtcagtgacagtttcgtggtaggtttggtggcgttcggtcacgcatagtggtgtcacattcggtacccgtctattggtgtgtgtaggagatgtcagcatgtggtgatgtgtttttttcctttttcctgattataagcctcccaaggttatagtcttgcaattttttttgctatatcaatatgaaacattgcactatttttgtgatattcatttttaaataaaacaagcttggtcaaatggaggcggaggtgacatccgcaatggagctttagggaggcaccaacaccgaaggggagacttgtacaaggcgaagcttgaggagacgttgaaggtggcgatgcttgaagaggatcctcgtggtgcacggcacgacggcgttggcagcagcgcttcttgtgagtaggtatcactggctaggtttgggtagccatccaacctattacccacataaaaacccccttgaagacactaaggccctgtttgtttcagcttaagattattgtaatctagattattaaattagattactctaagctgaattataataatctgacataaaataagctacgagttatttgtttctctggattattagaggcatctaagggtagtgggtctttagccactcaacaatctaaaaaaagctcctctagaggagattattggattatagtaatctggcttatagattataataatgtagcataataatctacttgtttgtttcaacttactcctagtaatctagattataataattctaagctgaatcaaacagggcctaagtagggcacctgagttcaggaacatataagaaaggatggacctcatcaaactcaaagacacaaacaccatacatccatcaggatcagatgctttcgccccaagaaattgggtcgggaatggcaagttgggctgcagaagagcaaatgtcaagacgtcgcctcactaacatggtgggccccaacctcggtatctgatagctacgtccacgggatcgaggctaggggctaccgttggtagagtgggtaacataagtccattatatcacaaccatcataaaagagtaaaagtctcatatcccaaaccatgaaccactatctcatgtacttgtatattgtttcagtcccaatccaaatgtatatccaaacacaaccaaaggggttgtttggatgagggcaatgaaactgttttttttttcacttaaaaacaagatttgtttctatttagaagaacaacaattgttattatattagttctatcattaccatatatggatgagcaaaactaaattttggtttagccaatagcatgtttggctgatgaatgctacttgattgattaaacactcatcactttcctatttctagtacgacaattcatcatctttgcatgctaactatatgaattacccaggtttatatattgagacgtaggaagtatttatttattattactcctctgacttagagtcaggctgatcagaaacacaacgggaagttttcctggttagacgggctccactaatgcattgattacgcacccgcattacaaccatacgtgcaaaggacgatgaaagagttactttggatgtactactttgtaaatttaataatacctatagcacaacactactagaggatttaactttttccactcttcaccacacatccattttacccctctcacatgagtagcaaatcttttaccactccactcctctagagtggtaaaaagtaaatattcgaaacacttggtggtgcacatgatattcagctcttcctctcccctctctaagggatttaacgttttgacactctttatcatattggtttaatctctcacaacactcttccttaatgataaatctattgtcactcacgtattcatagtgatgattggcccttattcatatgcttatccgaacatcttattactaactaaaaaataatttgtggttaagccttttatacatgtgtcgttagcaatttaaaagaaaatattgtaaacaatctatgatgaaaaagccaaaaaaatcaattttaaaatttaacttaagaagcataagcataatcgaaacaatgagtattgatcaaagacaaattttgctatatgacacctaaaatttgtttaatttgttgaacaatataaaaaaatgtgtcatggctgagagacattattttgctagatgacactttcggcttaattagagagacctaagaaagacgagaatgctcctaggaccacatgcttcaaacatgacgttagagtaaaaaagttagatattatgcaactttaaatttaccatcaccccaagtgcatcactagcatacattatatttcatcttcactccaacctcagctcaaaagaccctaagaacattctcatcttttaaagaatttccctcttcaattgagtcgaaagtgtcctccagcaaataccagtttttacgatgcctatcaatcgtgacacatttttacagtatatcttagtaaattacacaaaatttaaatgtctaatacttcccccgtttcatattgtaagactttctagcattgcccacattcatatatatgtgtgtgttaatgaattcagacatatatatatgtgcctagattcataacgtctatatgaacgtgggcaatgttagaaaatcttataacctacaacggaggtagtagcaaattttgccaaacgaatgccccgttcgaatccactaaaaataatggattaacttttggattaaagtggcacgtttttcaaactgttaaacagtgcgttttatgtgagaactcaactaatcacacgttattaccacatcgttttacgtgaaacacttttagtttgcattcatcttcctttccgcgaactctcactccgcgacgaccgaccgaccgggtccgaccgcaccacctcgcgcgagcctcacccggtcgcaaccccgacccgacccgcaaacacacaatctgctttctccttccctccctcgcggcctctgccttctgtatatacgacgtaccaccaccaccacccccccacgcgagcccgcgagccccgccgggccgcgccaccgatctccggcgaccccccggccgccgccgccgccgttttcgccgccaccacccggagatcctcccgcgtgcctcccccctccccgccgcgtgctcccggcgcccactgccctggccccgaggtgggggctcccctgctccccgcaaaccctaaccctagccctagcccacccccggcgcgggggctgcctaggtgagtctcctgctccgtacgacgctccctgtggcctccttagggctcgtggctgtcccctagggccgcaattgaggtgtgcccttggagggggctgcccggcctctcgtggtgtgtgtttgtgtgtggtgaggtgaggtgggctggtggtgctactgctgttagccgtttaattgtgctgcatttgcgagtttgcgaatggagtgtggggggtacgtgtggtcagcttcgcgcgctcgctgtaactgaagcattcatggtttagcaacgctgtaaacggtttgagctctgatagcgcggaatgttcgcgggtctgcttaaaaaaagtgattttttagtgtgccttatatggcatgtggtctgtttgttagtgaaagaaagactttctagcttcgcggcacgttctgtcgttatgtgcgcgcttagttcgatcaggccataaggctgtcgaaccgtttgcgtgtgcgtgtttgattgggcaagtgtggttggacttggcatgctctattcttgactgggaaaatgctggcgctatgcatttattttgtctcctttttatttttggtaataaggattgcgttttccgtaaacttgatatgggaggacgccgtcacctttatgatatttagtttctactattgttttttgcatattgttgccttgttatcagcaacatggtttggttttacaggaaacaggttgcacattttgcggacttttgagaaggtcatgtccattgatgagtgatgacatggcaagctgagtagataatgcttgcagtgatgcctttgcatatcctgatcctgtgtggatactgagctgtgctctatgggaggaattgcagaatgtggtgtgaacattgatcagaaagcttcgccacgccgtgcggccatagagaaagctcaagaggagcttaggtacattgacggccatcttattatgagcctgtatatgctttctgtggattcctaatgttctgtacaaacttcaggcaagaatatgatgtccgtgaagaacgaagaagggagcttgaatttttagagaaggtatgttgcaatcggatccttatggtttggagtgtatgttgactttgcattagatcatttgtcctgatttattaatctgttattgcagggaggtaaccccttggatttcaaacttggacatgtagcatcacttagtgtccagtccacttctgttgcagatcatataaccgaacaaaatgtgataaggtgatactgattttcatggtttgtcatatgataacggtgctgccattattgtttgatacgatcctcttttctcacttgcactacagtgaagctaagggcagctttgcgtttgctgcctcaccccatggggattcagttgaaagtagtggcaagccaggaagttcatcatgccgtgatgccaacacagctgataatcttatgcttttggatggagataccagcaacacaggtggggagaaacttgtcaaatgtggtactaaacgaactaatgtatctcaacctgatgtgtccctgcgctgtgatggtcaaaacaatgtaaaagaggctgaagattctagtttgttccgccctggggcaaagaaccaggcgtatgctcgtcgcagatcgaaatcaagcagggagaatgccactgcgtctgttgggtctctaccagtttccccactatattctcaagggaaagatgcaaaagggataatacaagaaacaaaatcagaagatcatggtgcctcatctattggcaactcaaaaccagcaagtccagatcggaacaacacatcaaaggttgcttcattaggtgatcatgatgcgatggagatggacaacactaatgaaggaaaccaagcagcaactcatgaaacaacaaacttcaaagatggtgttgaaacaccggaaatctcaccaaacagtgtgaatggtaattcacagcttattggagatggtttggtagttactgcaactacttctgcagaatcccctgacacaagtccaaaagaagctgctttaatggcaacttcttcatttccatcttcatgcaatgaagtcttggaagaagcatgtgctgcggaagaagcaggtaatggatgctcagataaaaatttggttgttcatgcagatgatatggttagcaagagttctgttcctccctctgaggtagaaattgccagtttgaatgaaaatgaagcggatataccatgtgcagatgtgtctaagaccgttgatgaacatcctggaaaaagtgagaacttatcagggaaggtgtctgatgaagatttaggtgatgctataccttctgacaaggatggaaacaaagatggtcaaccagaaggtggtgacatgcccacagttgttgatggcgtttctaattctgttcaaccagaagtcagcaataccatttatgccaaagatgacgttgatgtccataacaagatggttgatgcacaaaaggatacagggaatcttgctacttctggtcttgacaaagtcgataaggaagcatgttctaatttgaaaaaaaataataaatgttctcctgattctaatattgctgataagttggattctgttaccgtggcgtctggtttgctcatgaaggacgtgcctagttctgtgtcattaatgaaccctgacaatgatgttaataaaactggtgaaaatattccaatgatggaaaagaaggaatgcgaagattctactgttgccaagaaggaacatgaagatactatccttagaagggcacgattaatagaggtacacttagaatatatacttttctgatactgcttttctgagaagaaagttaataaatacttctcaggtcaatatcaagaaagctggtgaacgatctctctgcaatatttctttggagaagaagccaaagagtcactgggaatttgtcctggaggagatggcttggatggcaaatgaatttatgcaggtattctctaaagtgatcttaataatcaattcttgttctcatgcaggctgcaagttttttatcttgtcgtgtaacatttcttttactgtatttacatattcaaagatattatgtaacatcacgttttctatttaaaggagcgcctgtggaaaagtgcagcagcttcccagatgtgccactggattgccttaagtggtcgagcaacatttgaggaagcaaacattcaaaggaaacagaaatcaattgctagaatcctagccaagagtatcatgaagttttggtgttcagctgagactttacgagctaccagtggtgaaatgcgtaaagagaagcaagcagaggagtcaattgggattggggaaacaaagctggctggaatcaatgcagaaaaagaacaggtcagcgaaatcaattttctaacattgttccttctttatattctcttacatgcaaccactttttcacttacgagacaatttaagatttcagatctttctagacaacttagaataaaatagggacattgtatttattatgttgcataagcattatttacaaacttatagcgactaacatatttgtgcttgatgtaatttacaaatctggacagtgtaacgaacctctggaacaagagaagcttcagtctcctattcaaagttacgcactaaagtttctgaaggacaactgtaatatatctgagtgtctgtcgttagctgaagcaccagctactcctgacaggctgaatgattttggcattttgaaagtgccagaccagctttcagaagtaacccatctgatgacaccatttaacatttcatctaatttgaaatgaattctctgaggagcatacacaaaaactgttgactgacactggttttatgattttttttcctaacttctaggcaaacctattttatggcgtagcccctggtgcgatgcaggcatacagagagtttgtggagggtccttttgtggctaataaggcaaggacatgctctctgtactctgatggctttataatagtaattcttttatgctatgcggtgcttttgttcggttttcaattatcggacagtatagaaaatcgttgttgttttcaactgtgggttgataaagttctggacaattgaacctattgttgttttcaagattttatttacctaatggctctatgataaattactaatgtattgggctagatctttatctgtggtgctagctggttgcctttatctttgtgtggagagattttcactagttttttctttggtgtgtatggggtgtgggcctaactccctctcctgtggcctttttttctctctcttagtgatatgaaacacaatctcttctgcgtgtttgagtttttatctctctctgttttttttttttactgaagtgagcatttgaccttttgcacaatcttgagtaagtgatatgaatcgtcacattgcatattattgtcctatgtccattactttggattgtttttccatcttttatttagaattttacttcatcgtcgtttgcctgtacttacaaaaattaatgtctaccgtccagaaaaccaataactctcgacagaagaatgattatgagccatctacaacaggctctgttgcaggtaatatatctattacaccactatttccttctatattatatattattacatgttttgagaaatatttacatgtacttaatgttcttatcatgcttttttggtttagatgcacataggggacatgcatatgaagatgatgatgtcgaggcatccacttatgtattgcatggtacatatgatgatggtttgccatcaaaatcgagtcacaaaaagaaacaccttatgcagcagaggatgaatggcacaaggcattacagtactggtgttgacatgccttatgatccatatgtggagagcaagccaggaaaccagccatttttatcaaatggaaaaagaccttcagatttctttaatattcctacaaaacgcatccggacagctgctagacaacgagttgtaagcccatatcctgctaatgcttctggagccactgcattcacaagtaaaacagatgcttctagtggagacacaaactcttgtcaagatgaccaaagttcattgcatggtggatcttttccaaggaagaatgtggatattgaatcgacagttgattttgatagacaattgtatgatggcagtgaggtatctactaagtcaaaaaagaagaaaaagtctaagcaccctggatacaagacacctcaaagtgtcgctgagtcttgctctttgattgctgggaaggttaagatctttatgtcaactctctctctatcttgtttacaatgttgtagagtaagttgattctgctgatgtttcagggcattgcctgtgatcctagacctcaggttgatttgattgctcaatatgagcaggtatttttttggctgttctgattgtagtatgtcaatgacatttgcaccttttgcagacaaaatcagcatggtgaatccattagtgttttaagtggttaaacatgtgtcccaacactctgatggtgtgtccacccttcagcttataagctgcagcaaaaaaaaaaaagaattttaaaacataattttggagtaaattttggggtttcttcatcatagtttatttttcagcatttgcttttaaatcactaaacacacatataaaagtttaacgttcaattttttttgttagtaataagccatacagcttataatcagcacaagtgaatagtggtctaaatgacaccacaaattttattcatcttaatgaatcattgggtttcgtatgttctaatttttgggttagcagcattgcagcttttagtgaagtattacctccttcctcaaataggactatgttttagaatatgtgcagctaagcctcgaaatcttagccttctaatgtatgcagaactatttgatatgtgaaaatggcagacctgtcatgaaatacttccatacctatatatgacaatgtttttgatgaatatatgattaaaaatattagttaccaaacatgtgcattggtcgttatttggtcgtaaataacaagtaaaaaagaacaggaggtgtacaaaccttctcccactcaaaaaattccaaccaccacatgcttttggaaagcaaaagcttgtcgtttcattaatatctgataaatgttttctcctttctataccagaaggattatttgaagaagagatcagaggtccatcaattcgattcaaatggaaatattggtattttctttctctacttcagattgcataatttatatctataataaatagttcttgctctatttaagaggacatgggaataatttttcacacttgtgacttgtcaacagtgataaatggtcagcatgctgccaagaagcctaaattgatgaaccaagcaccagatgtttcattagaagcacttacaccagttggcccaatggtatctcctgctgcttcacaaatgagtaatatggcaaatcctactaagnnnnnnnnnnnnnnnnnnnnnnnnnnnnnnnnnnnnnnnnnnnnnnnnnnnnnnn

SEQ ID NO: 556 - DNA, 1138 bp, Oryza sativa
actatgttttaaaatatgtgcagctaagccctcgaaatcttaaccttctaatgtatgcagacctatttatatgtgaaaatgcagaacctgtcatgaaatacttccatacctatatatgacaatgtttttgatgaatatatgattaaaaatattagttaccaaacatgtgcattggtcgttatttggtcgtaaataacaagtaaaaaagaacaggaggtgtacaaaccttctcccactcaaaaaattccaaccaccacatgcttttggaaagcaaaagcttgtcgtttcattaatatctgataaatgttttctcctttctataccagaaggattatttgaagaagagatcagaggtccatcaattcgattcaaatggaaatattggtattttctttctctacttcagattgcataatttatatctataataaatagttcttgctctatttaagaggacatgggaataatttttcacacttgtgacttgtcaacagtgataaatggtcagcatgctgccaagaagcctaaattgatgaaccaagcaccagatgtttcattagaagcacttacaccagttggcccaatggtatctcctgctgcttcacaaatgagtaatatggcaaatcctactaagattataaagatcattacaaaccgggatcgtgggagaaaaaataaagtgctcaaggtatatacctcttggcatggttgtatgttttctttgtatctgtttacaaacacacaaatttactatgttaagtctctcagacgcattacttttcataatctgtattttacttcgaatttctctgttgttaacactaaattatgctggttttatagaaacgtataattgctaatacaaacagtacttataaatcaccaaaacaaatgagtaaacctcacaatcatatactaccagtaaagctacacagccttaaagcagcagttttagagaactgcagttcattttgcataactttatccaattggttgggcttgctcgtcgatatcacaatcctaccattttatattaacaaggttccaagcaccggtggtaaccggtctgaagccagtgactggtactggaataaactggccaaaatgatttttgaatttaaattttatgaatttgtca

SEQ ID NO: 557 - DNA, 2494 bp, Oryza sativa
  unsure (1)..(2494): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaacaggcagtactatttccattatcctccatttgctctttccgaaattaattcctggtgagaatcaggatttcaaaatatttttttaaaaggatttcaaaatatctactatgagaaaatttaaacatcaagaatttttatttattaacataataaacatttaccatgaaaaatatattattccaatttccatcctctggcaattgcttgtgggggttcgaattaaagtcaagaggacacaaatgttaattaataagtaatatccacatagtttcttttgtatgtcttcatgagaacagaccttggtttcagaataaacaacttgatcatgcctttttttctctcttcctgcaggccatttagtgatatgcccgaagtgaccaacatcaaggtagaggagaacatccaatacaaatttcacacaccaactacattttatcctacctacaactggactggcaagccggagatataaattctcaccattttcaccaagctttgctgtgtcaataagctctcccatccatagcaagcactggggtggaagtaaacttgttgaattggtgtaagcataagctgtgcacgaacaggtcctactgcataacactgtgcactcctcaaagcttataccactgatgtacacgaacttatctggcaatttcatgccaggcaacagcaagaaatgctcatgatcaccacatcgcagctcctccttttagacagccttgtgaggagttaccggagacaggttcaaatccatcaaggcacttgcatgtatggacgcctgtcaagtcgcaatgaccatatgggccacatgagccatagcgaccgcaaccttgaacagataagatgtactgtactgcccacagtgagtgaccagggtcccagctcagaaactgcactttgccggagctgtccagtacaaagcgcacacttgttgaactgtacgatgtagagatcatcaggtatgagtaattcttatccctgataggagccaaatacaacaaaaagctttttgagtaaaggtccattccacgttgagcctgatccacgccaacagggattaaatccatgccgcacaaagagctgagggtatggcttcaagccactaccaagggagaagtcaccattggaagggtcatcggggctcttccaagaaatgaaagggctcaacggcaatatgatcatcacggagcaaccagattttcatgccaggtaggaaagtgtcagttgggcgatcaaagttctcccacatgatggttccatcgaatgaccggatgaccaggttccccgtgttaagcaacaccgtcgcggatgatctagtacctccaccagcaatgttcttgctgctgttcatcttccatagagtgccacctaatgaatcagacgcaactatctcgccctggtcggtcagtgacagcatcgcggacgattgattcatgatggggctgtttcgattggcaacccagacgacggtgcggttggggatgtttattgtaccaaatgccaacatacaaccttgcgcttttgaattttttttctcccttcaattaaaattccggcaggtcttatgtcgtggttctcctaaaaaaaacaaccttgtgcttgagttgctgctgcctaaggggaagaaaccttgccaggaactcatatgagcctccccagcaggaggaaatcaagcccaatcactccccctcaattctctgatcctgaaacaaaaaaaaaagtctcaatctctactgctcactatgcagcacgaatgaggcatacatacaagaatcaagaacggacgcatcggctagtcagagaaaaaggaaaaaaaatcgttaaaatttggttaggtgatgtgtagggaggaccaattagagataagcagagaaggagaaaacattgatgttcacactccacagccggacgaatctttttgtacaaaaaaaaataagggtaaagttatcccaaaaggaatcattgctgcacacacagaagtgagaggggggggggaccttggaggtcggagtggtcaggaatggtggtgcggtggtggccggcgacctgagggttgagccggcgaaaccacgcgaggtcggccgcacaacagcgccgacggcggcggtggtggttgcattgttcgaaatgcagaaggacgaaacggaaccgcggtaaggcacggccatggtagtgctcatccggtggcgcgcgcccggggtggggtggggtggaggacggcgccaccgccggagcagcagcacggtgacgaagacgacgaggcgtttcggccggcttgggtacggacaaatgttgggccgaccaaattgttgttgggctgagctgcctactatgccaaattagcagggctcgcgactgctatttg

SEQ ID NO: 558 - DNA, 3104 bp, Oryza sativa
agagaggttgttgcggaagaaatagcaacctaatggtagtcgagctgctacaaaggccagcggcgtgcgatgatggatcacggcgaccgaagcatggcagctcactcctccttccatttaaccttcaccactctaattcaatcatcgtcgctacctcgctcctccttcgtgagcttcattgctgctgcagctcgcctcatgcctagggagggcgacgaggcgatggaaaagcagtggtgcgcctgaggggagtgtcactgtcgacacagctccgtgcataacctcttagactgtggtagtggagacagaggagatctacaagttcgtgccccatcggtcccgtcctctgagattgccacagatccactgtataacaacctgtcctccaaaattaaaccgcactgcctaacccatctgatgagtggccccacttacacagcacaaactaatatggttgaagcgacaaactcttataaactcgttataccctgctaaactagcaacacggtactaaacatgtgcatacagctcttaagttgattctacccttgctaaacgcggtactaaagttgtgctactcgtcattgtatcaacaacaaatcaagaaaaactcttgattcagtaattcagaaaccaattgtttcttgtctttcaatggagggatcattttatagcgcaaaacgcatgcaggcagctgttgcagctactctcatccactcagaaaatgtcactctgatttaccacagcatgagcagacggttaccgggaatgcagattgcacgatgaaatgctccatatatatcctgatgctcagcattgggttgttgctaattaatctgatcctgctttttggaccaaacttgcataatctcatctgcaggagattccgttttggggttgggatggacagagatcccatctcatgtcagaggataagttcttcaggataagttggttggtgtgcgtgtgtgtctgcaggacagatcaccattcaccaaccaaaagggccagtggctagcagtagcagaagcaagcaacagatcgatgcctttctgacggaatcgagatctgctgacttggtactagtactactgaattcatcaggaattgatttttttttcctttcttttggtgtagaaacaatcttgctgtgtttgcagccttgcaggggtcacaacaaatgcattggattaagtgattatggaggagatttagttaaccttttgcgcaggagaaagacttataataacctatgtaaaacccagtacattatcgtgggagttccgtatgataatagtagaaatcacgtgtaatatagctagctagacaacgtaaggtaatagaatttgtattttttttaatcgatcattggaaaagagtataaaccacttgagttgatatggtttttgataatttaaatagtaaatagattgataatccaaaagtaaggtgatgtggctttacgagagaagaaaataaggggaataatttggactatgattaatcatctagaggatagaaacaattgagatttaatgagagaagatagaaaacattagctaggatgaagtatataaggatattgtagaaaatgatggagagatatacgttaaaatattatgtaaattatgtgcgatgatgatttaacatgttgtattttataactttaaaatataactaaatataaatgatatagcatgtttgtatgaggattaacatgtaataaaagctaatgaatgataacgtaacatctttgcatgttaatctttagaatgtaataggttgtaactctatagataatggcttcgttcggcaacactgtatgccgcatatgatagttgggtttcaactggttgtggcaaccatggcttccgaagaggcccaatatagatctaagggtctatttgggagggcttctagcagctacagcttatcctgtaatcagaaaacccccctttcaaacagtttaatttttcgtctagattctgagaagctgcaattatgtataatttagaaactaaactagagaccagaaactaaaaaaaactagctttcctaaattctcagaagctagctataaaccagctgttttttagaaatcttaagctcccctaagtacgtgaggatgcgatcgagcaagatgatacatccaactctttgcagcacccatctccacactaaggctacgttcatttgtgccgatggaacctcccctccggcagaaaaaacggagtagctcattagcgcagtgagtaattaactattagctaaaattaacttgataaatggcttaggaacttttctatagaactttatttttgcaaaaaaaacaccgtttagtagtttaaaaagcatgcgtacgaaaaatgagagataaaagtttaaaacattagatataatttattgaaagaaaaatactcctttctcttttttcattttaatatgtcattggttaattcatgaaagaaaatggaggagtacattagactttgagaagtgaatgtaatttaactagctagtttccttgtggcgaaacaaatccgctcggggtcaaatctagactcgcattatggctatttaatctttcaatggtaggtgatgtacccattaacaacgagatgcttatggtgatttcatcaatcttaatatatatcggctttatttgttgaaaatgctcataaggataaggtatacgagtgtacattcgtagaaatgatcgtattcgtattgtgagtgtatgcataactgtgtttatatcgtgcttttagaaataaagtatagtactccgatcccttcgtcctaaaagtggggatttgacaccatctaaaacgataaatatgaaaaatcatttctttagattccttgctttagacggtgtaaaatcatcaacttatgttgtctttttttttaatgaaggagggagtatactttagaagtactgtcatgggagctagcttgtgcggtgcaactccataattttattttaggtggtgaatctttttcgggcctgttcttgcgggcgggcccacctcgcagctgcgcaaagcaatccggcccacgccgccttcacgtggcctcccctgccgggcccacctcgtcgcgac

SEQ ID NO: 559 - DNA, 824 bp, Oryza sativa
cagcattgcagttcaagctagcaaacatgctggctaactgtaaacttggtgaaacttgccccacattcgagtcgttgggtctgaccatctgaatcaactggaaatagaatgttgccacatagcttcactccgataaaagttggtgcaatgcacaaattactctcgatcgcaatcactaggtcataggaagttcgcctgctcttgaacttcgccaactgtagaaaggaagatatcaggtgcaacactaagtcactgtaacagcatgcaaagtgaattctgaaagcaatttctcaccaggaagttcaacggctaagttagcttgagcatcagcatccgtgttaaattcctacataataataagcaaacgtgagtggtacagtgattgaagttctcgcttccagtagtttggagtgatttttaaaaattttaatagtacatgaagaagtgtgatgattgcccattggagaggcagtttcagaggggcaaataagggagttgccaatttccaatggaaaataaagagttaattcaatataatgtaatgtggtgccaaaattcatatgccataccggaatgatagctgatataaaataaaatacagcaagcgtggaagacagcaaatatatggaacacctaccctcaaaacatggttgatttgaaatgtatgaaatcttcccttaatttccttaacccttttgcacaagtcagccatagtatcatgcctagcacgccatacatctgagacctgctccagaaagtcaacatgttacttatgttaagaaacgttaaaattgatagagctgccacctgctagaaaagctctt

SEQ ID NO: 560 - DNA, 20684 bp, Oryza sativa
  unsure (1)..(20684): unsure at all n locations
ttcaacctgttgatgtaaagtatggtcaggtagaggcatgtcgagttcatgacatcattcttgatttcatcgcgtgcaaggccgctgaagagaattttgtcacctcattggatactgcagattttggccaagtttcggatcgcagggttcgtaggctaagtgtcatgaatatcagtgaagaccatgccaccatatcagcaagccaaatcgatctctctcatattcgatcacttactttatttgggcgtttcatgcaaactcctttggtggatttaccagctatacgtgtgttggatttagaagaatgtgaaaacatgggagacaaccatcctattcttgcgaatgtagaaacgctgctccatttgaagtacttgcgtattggaatgttgtgtccgataactgagctcccaagaaatattggagaactgcgtcatctagaaacactggacatgcgatttgcatgtcaagtcaaagaattgccatcaactattacaaggcttcaacgattggcccgcctatatgtccatcacaacactagactccctgatggggtaattggaaagattcagaacttggaagagctagaggagtttggtgtcgtctcctgcgagaaagggaaatctctgcaagaattcggtcagctacccaagctgaggacgctgaaagtaagatgcagtagtactacagatgatttggaaggaaggaagcgagccgaggacctctggaattatattggaactttgatatcttcatgcaatcttcatcatctttgtatcctccaccgacaggatgatccagatcatctcccaatgtcactggaatcatggtgcccccctagtgataattgtagcctccggaagctccacatcacacattactacatctctaagcttccaagttggatgggttcccttgcaaatctcaaggaattactactatatttctacagaatgaggcctgaagatgttgacatccttgaagcaatacctagcttggttttactcagagtaagaacactatacagcagcaatgggaggatcacgttccgtggcaacaaaggattcagatgtttgaaatatttctctctagatattgacctttgtgggacagagctggagtttgaagctggggcaatgccaaagattgagcatctcaagattaatttccctgtgcattcttggacggcgtctgtgaatggtgcttctgattttggtatccagcacctgtccaccctcaccgaagttgaggttggtcttggttgcttctttatacctgacaccagaaggatgtaccatccgacgacggaagatacggacgacagtccgatggaagatgacggcgaagctaacgttgtcaaatgttttgaaagtcgcatcaagtctgccgttgaggcacttcctaaccgtcccacatgcaaattcaacctgaacactgctattgtgccttgtccatcggtaagtttccagtcagaattgtagggataccacaaaaatatttggtgcccgtttaattaatggcaaaatttgttctaagacacttcagatttgtggtatttattttagggcactctaattttatagcatttgctctagaatactctagttactttttttttttcaaaagactactttaccttgaaccaccttctataattaaaatttgaacacactttagctgattctaaacattttgtaaaatttagaagttgtctgaaattacagaaatcaaaaatattttacaaaaatttgtttaaatttagacaatattatttaaagttttaaaactcttttggaaactttcaatgtatttgatttccgtaattaaattagggacaggtttttaatttgggtacttttaccatccttacaatggataatgagaggtatcactaattataataactttagagataccaaaattaggtacccccaagtgtgaaattttagtaccttacaagttatagagaaaatttcttatgtgcccctcaagttcttgctcaatctctactagtatgtcgggttttgctacatcctcagtacataccatttcgcttagttaactaccataaattaatcattttttttcaaaataaacataatgcccctcataaccataagcgataagtttgccccgcacaaaaataaatgcccctaaattccttagttttggaaaaaaaagaagaggtggaatgaatcaaatcaaaccatataaatatttactcatttttataattttctaaaaaaattaaaataatatatatattttcaaataatttcgatcaaactaaacttgaaaccaaagtttgatttttattttttttcaacagaaaaagaacaatggggaggtgcattaccctaatcaccattttttttgttattttatccaaaattgtaaaactaaaacttgaattctaaatgaatttaaaatttggttgaagttcaaccttatgagataagggtaacatggtcatgttgagaaaaaaaatggtggtaaactgagagacataaaaaaggatggaactcggaggatgggtgggggggggggggggtttattgagtggaaactgtaacaattttattatctcttgggcacatttggaaagaccggaaaaaaactgaaacattaagtgtacttatttttcaatcttttgcttatatatttttttcattcttcttccagtgttttgagtacaagaggaaacacccgagctttcctgtaggttcagttaaagcagttagggatgttcgtataagttcatcagcgattcaagataattccatggggcttcgccgccggcggccagcaaatcagccgtttcgattcggctgggcagggctgcagtattaagactctgcttggcatggcagggctgcaactctaaaatttacagcttcaatactccatcccatctttaagtacagccatggttttacacacccaactttaaccgtctgtcttatttaaaaaaaatttgaataaatttaaaaacataagtcacttgtaaagtactattcatgttttatcatctcataacaacaaaaatattaattataaaaagattcaaataaaacaaacgatcaaagttggacgtgaaaacttatggttatggttgcacttaaaatagaacggagagagtaatcgttaaggttcgggcacccctctccacagtagagctggagctgataatggctgtttggctataaagttttattgggacgacaaagactattcatgattgttttcacttgcatttctttcttggagctgtagaagttagcagctaacttcatgaatatggtttctgactacttgctgcaactaattatttacgtactaaaatttttagcagctataaatcttataaatagagggtcttttacagtacctcccactactatagtggtagtaaagtcgtagagatctaatctgaccgttgattataattgtgtgttagacatttaatccaatacccatattcgacttccaatttataattcatttgtgcagaacagatggctcgcgttaacctttgttgatcggcttctatcatcgctggctagctacccagcttgtggcatcgccagcgagagccagtagtacagaaccgggcatcccaattggcccatctgtgacggaggctatcggtccattacaaaggtacgcatatttatcgggccgcaaaaaaccctgtcacaataagccgagagaggatgtatcttagtcctctgggttaggcatgtcaccaatgaccctcatcggtgatgggccaaaacaaaacaccgtcactgatgagggtcatctgtgatgggcccagtgttacggcctgacaaagatgagtgtgaagcctatcaccgatgaccctcattctttgacggggtttggttgtgcttcgttacggataatccatagtataaatacccccagggtattcgaagaacagctatcctaattaacccagtgtatggtttacattttggaaaagagagcaagacgggagaatttttgctctttatttttctagaaaaaacaaaatgctcccaagataataataaattattactacaatttccgtgtaataactagctacatatacataacttttattttttttcataatttgcagatggacagaagatggatgtacaaaagtgatcgattgagcatagagtatggaaagggcattaccgattccatcaatgtcgtagagcaagagaaaaacatgacaaataatgaataaacaacttgtccatgctttgattgtaggaatgagaagatgtttaacgatagtgtcagaatacgcacacatctgatggtgatgtcatcacaacattgctcttcattaaaacaacctattccctatttctaaatacttgtcactttttttccttttttcaaatcacaaataacaaggaaacagttccagatgaagttttgggaaataaaaaagtgaccaaaattttgtacagtaatatctctgattgatcaaagtagatcaagataggcgtgaatatcaattattctctgcatgagcatatgatgtctgccatctcttttaaaaggagattggccctaacagattgtactggacataaatcaaaataaatcaactaaatataatacaacaacttgaggtcaagccactagctaattgacaaagctgctgccaaactttgtataatccaggcacattatgaccagtgacaactacaaactaaatatttgcaggtgacaaaccagagacccacaagagaaaacttattgctagtttctattatgacatgcacatgtgaattatcacttcaacaagttgcctaatagaaaatcgagacaaagatggaaaggacactttttatgattttagaaaaataaagcagctgcaattggtgtagtgtatcatcttctgtctgaatgcaaatagacaattccttttctcccttttgaaaggagtgctgcctatatcaactgaacataatcacactaccacattatcacactctcacttccttagctcgcatgtagcatagaatccagacacaggagagcaatggcggcaatgcatgtggatgcttccacaggggtgatgaacactctcctacccaagctctccaagcttcttgaagagtacacgaatatcaaaggcgctgcgcgcaaccaagcatgaagcctgtgctagagatgcttgcagatgcagatgatgggctcgatcctctgaagagggaatggcggcacaatgtgcgtgagctggccttcgacatggttcttccgcaaattgaagaagttgaaggcttgccctgagatcgctgatgcgatcgatgaactgatcaagaaatgtgcaatggagggaagcaagaggcacaaaaggtataattctgtcaatgtggcatccaattctagcacttttggtgttgatcctcgcatgctgatgctttatgatgaagttgataaacttgtgggagtcaatcgcgcaaagaaacatataattgattggtttaccaaggagaaaggtgagaaaaatctcaaggtactgacattcgcagattttggaagtcttcgcaagtctaatcttgccatcaaaatctactctcagctggaagaccaatttcagtgcacattttttttgtcattgtctcgaaatctctgtagagaaaagattttgagaatgattcatacaaacctagggatcacctataacacatcagatgacgaagggaaactcattgataggataagagactacctaaaagataaaaggtaaaccttgtaatttgtaacactgctatgtactctttactactacctctgtatttaatatgacagtatgaaactattgactttattcggtctttggtgtacaactttaaccactagttttctattagaataaaatgataatatttaacaaaattataacattgtaaaagtaattataagaagaaactattcatatgtttttaatgtttctaaatgaaatattttgagttattgatggtcaaaattttaaaagtttgaccaaataaagttgatagtgtcatatatttaaatatggtgggagtacttttctacatttcgttaaacagatcatgacatggactgcacacatttattgagcaattataattagttatctgaatatatatttacaatctactgccttttttctgttcacaaagagtgtaaatatgtgctagagactagtggcaatcctgtgcttaacttatgcttctttagtttcaaatcaagtggacttgagctagctgcaagcaaatacttttcatagaaatgatcaattgatcatctatattcaattaatttaatgctgatggcggctttatatgcttaaaagatattgatatctagctttgctaaaattctataataggtacttcattgtgattgatgatgtgagggacgcagaagcatggaaagctattgagcttgctttgttcaacaacacatgtggtagcagaattgttataacaacacgtaattccgcagttgcatcatgttgttcacatgatggtggttatgtctatcgaatggaacctcttagcctcaaaaactccaaaatgttgtttttcaaaagagcatttggttccgaggatttgccaaatcctcaattggaaaaagtatctgatgggatattacagaaatgcggcggccttccattggctattatgatcatgtctagcttgttagccgatcagaatgaagaagatgaatggaaaagggtgctaactgctattggttctgtacttgcaaaggacccagatgatgatatcatgaaaagtatattatctctcagttactatgatcttcctcaccatttaagagcttgtttattgtacctaagcatatttccagaagattacgagatcaacaaacaacgtttgataaatagatggatcgcggaaggattcattctcgaagaacaagggttaacttcatatgaagttggtgaacgctattttaactaccttatcaatagatgcttgatccaaccagttggttcaaagcatggtcaagcaaaggcatgccaagttcatggcatcattcttgatttcctcgcatgcaaggcttctgaagagaattttgttaccccattcaatgatgatgcagagcaagggcttgtttcagaaaacaaggtcagggttcgtaggcttcatgtgaataatcacaacaaaaaggaggttgccagattaacaggcccagttctctctcatgttcgatcgcttactcttttcggtgattttgggagaattcctatgtcagcattcacagctcttcgtgtgatggatcaagaagataattgggacctaggaggaaactggggcttaggaagcaaccatcacatggcgcatatcgaaatgatgttacatctgaggtacttgcgtctaaattcccctttattagattttgtgctcactgcaagaacaggagggttggagaatctagaaacactggacctactaggtgtgtcagttgtagaactgccttcagctatcacaaggcttcgccgattggcccggctttatatctctcacttagctagatttcctaaaggaacaattgcaaagttgcagagcttggaagagctaagcgagtttggtttcgtgtcgttccaccaacagtgggaatgcttgcaagaatttagtcagctaaccaagctgaggatgttgaaggtaaaatgggattttgattggtcttttgttcaagatgaggagggccttcagagttatatgcatgctttaatttcttcatgcaatgttcataatctatatatcggcaatatccacatttggccgggtccttacccactttcactggaatcttgttgccctactactacttgtagcctccagaagctgcacatcacatattgtttcatctgtaaggttccaaattggatgagctcacttggaaatctcaaggaattaaagctttatatctactgtctaagagcagaagatgttaagatacttggagcaataccaaccttgatttttctcaagctaaaaaccttttacggcaccgatgggaggatctttatccctggttataaaggattcagatgcttgaaatattttggcctggtcatgatatcttgtggaaccacaccagaatttgaagaaggatcaatgccaaaccttgaacatctcaagcttaggttctgtgttcatgagatggagtgcataaatggtgctaccaatttcggcatccggcacctctccaccctcaacaaggttgaggtccatatctatgggtgctcagttagtcacaaagactatgatccagaggctgatagggaagatagcaatgccaaaaatgctgctttcctcatcaaagccgccgttaaggcgcttccgaaccgtgtcacttgcagttttgaactagcaaaaacttatggaaacattggaactttccatgggcttatcaaaattgtaagtcacctgtaagaaatactaggacttgtcgtttgattcgtttcatcctctaagttgttactagtcctacatttctttctttcatcctgcaaattctatgtaatttgatatttaataccacatttaatatatgttatccctcacttgttactcccatgtttgggtcaattttcttatggtgtttgatgcagttgaatcgacataatggaatatcggttgagagactccttcaagaaatgcttaagtcgagggtgaagcaaatgattcaaaacaatatggcgcgggcacggggcctcttctagacagaaatggtaaattcaagaggtgagcgagagttctctcactgattccaccagtgcaatgtttcatgtcaatatgatcccacaatatcataaagaaaataactcatattcattcatttccatgtattggcacatcaaacaggatgagacgaaccaagacgaagaagtgaagaacacgttgggaatgaattgcagatggtgtgctatgaaaggtgcagtttgtgtgctagctgctagagagctggagtcagcgaatccactataaatttctacaactctattgaaatttcttggagtatctgttgaagtctttgtttgttgtggttgttagtgtacaatttggagctgctctgtgttggtttgagtcgaatggtgatttaaagtatgtacctatctgttaaacctggtgcttctataattcttcatataaataaagtgagttgggtttagtcccacatctgtaattgatgatagaggagcacgacttaaaaaggtgggggcaatcctcaccatcagactagtcttttggattgtgtaggttcaggatctaaagtcgtggcttcggttggacctgtggtggagcaggccttgacctgggtggcccatggttggtgggccgggctgcgcactctaacaagacctaaagttgtgacttcggttaggcctgtaacagagcaggccctatgtgacctgggtggcctatggttggtgggccaggttgcgcactctaacagttgttacttaggtaaaattttataccaactggtaaaaatattaaaataatagaataatgagaataaaattttataccaactggtaaaaatatttaaatattaaaataatagaataatgagaaaatatatagtgctgtttttatggaaaaggaaaaaaactgcatggcagcattaatatatgcatttgttgacatgtatgctgcttttacctggaggcaagaagcttaaatatgtctgtcttagcgttaaaggtatctagagatgccacagattgacattaaaaagtaacatgaatttctcttcgtttcctagaagaattgcctatatattatggtacaaattgttcttttattttgagaaacaggcttcaagcctaaagcaactaatcagtgcttaaggggttacagtcctcaactaacagagaagaaatacataaaggtggaactgaaaaccaggttgaacactcctcacttgtcaggcacattttggctaggctatgtaccaccttgtttgcagaccggcgaacccaaatgactttaaattcctggaacgcactacacctactcttgactgaggtatgtatgtatgtatgtctacatctcctccaggctccagctttggagcttccttggttcctctctatttcccaatcaattaatcagatcagccactgtttcactattgtttccttgatagtatgtctgtgtctcatatttcacttctgaacattatcttaaaaaagttcacttctgaaatctgaacattttcacattttcagtcgtacattatttgctcaagcaagatgaagagaaagacaatcgattgctattataacccggttgtttcaagggtgaactccactgaaaatcctagtccaatcattgcccaagatattgacccagttgatttgcaagctgctaatgaaaatgcggctacactaccatcactagaagctgaacaggggcaggaaattgtagctacagcatttgagagggacccagggaaacgggctcaaatatttgaacttcctgctgatcaacaagatgaagctcgaagattttatatatctgagggtccttttcgaccaatcttgcaagaacaagagtatcctttgaatgatgctaagcaccgtcgtcgatttcgcagcagttggtctaaacaattttgttggctggagtattcacgccacacagattgtgcttattgtttaacatgctttatcttttcaaagaagccaactgggaaggctggatcaaatgcatccacagtcaatgggtttcaaaattggaagaaagttaatgtaggaaaggagtgttcttttctaaaacacatgggggatgctagctcagctcataattattcagttgggtgctttaataatctcaaaaatagtatggctcaaattgacaaggtgatggttagacaaagtgacaaaatagttgcaatagcaagactaaggctgactactactattgattccattcggtaataacatgaattcatttcaatatttttttagaacagtgcatttataataaatctaagtatctaacgatttcttttgtttatatgataggtggctaacatttcaagggtgtccctttagaggccatgatgaacctttagattccataaatcgaggtaattttcttgaaatagaattccataaatcgaggtaattttcttgaaatagataagcttttggcatcatataataaggaggttaaagaagttgtgttggaaaatgctccaaaaaatgcaaagtatacctcatctgaagtccaaaaggaaattctaagcatagttgctcgaaaagtgcaaaaatcaattagagaagaaattggcactagcaagttttgcataatggctgatgaagctcgagatgaatctaagaaagagcagatggcgatagttctacggtttgtcaacaaagaagggcttataaaagagtgtttccttgatcttgttcatgttagtgacactcatgcgttgactcttaagaactcaatttgtgcggtcttgtctggtaataacttgaatgtgcaagatattagaagtcaaggttatgatggggcaagtaacatgcgaggggaatggaatggattgaaggctctaattctcaatgagtgcccatatgcatactacatccattgcttggctcatcagctccaattggctcttgtcgcagcatcaagggaagtacaagaggtacacaatttttttcagcatgcaaatttcataataaatgttgttagtgcttctccaaagcgcaacgatgagttgttagcaaaccaaaccacagaaattgctcgtgaaattgaattgggagagcttgatagatactggacgaggggcaaatcaggtgggctctctacaaaggccaggggacactagatggagttcccattataaatcgattcagagcttaaaaaaaatgtttggtgccacaatttcagtccttcgtagcattgcacataattgttcagttacaaagtattctaggggagatgctgcaggtgccctacgaatgattttcacgtttgattttgtgtttattcttctcatgatggaaaatattatgaagatcactgatgtcctatgccaaacactccaaaagaaagctattgatattttaaatgcattggattctgtttctaacacaaaagcattgcttgctgatttgcgaaatgagggttgggaacctcttgtccaggaggtcaaatctttttgtgagaagcatgagattgatattccgaatctgaataacaagtatgttcttctgcctaggttttaaatatgaatggcaatatgtgactgttatttttgtagatttttatttcttatttatgttcccaaatttgcaggtatgttgatgtgacaaaatctcaaaacaagaatgacaacactacagcttttcactattacaaagttgatgtgtttaatgttgcaattgatcaacaaatgattgagctagaagaccgattcggttctcaagctacagatctgttagccctgtgtgtttgcttggagtcaagacttgagtcatttgacatggcaaaggtatgcacccttgtagagaagtattatcctgctgatttctcaagtcaagaaagagctcaattggagtgccaactaccacattttcaacttgatgtctgcaaccatccagacttgagcatattgccatctcttgcagaaataacaagtggacttcttaagacagggaaaagttgttcctatccaatggtggatagattgttaagattaatcttgactcttccagtgtcaactgcaactacagagagctttttcagctatgaaaattgtgaagacacgtcttcgaaataaaatgggagacggctacccatcacatcacatccaagagttggtgcatctcaacaagagatccttcactagcatacccatgaagcagagtaccgtatgtagcactattaggcttgtggcccctcttgaccatagaatcaaagatctttctagcttccatggatcttccattcttgcagagatagtccatgagcatgttataagtgactacattcggttcaacaccatctctgcacatttttctgaaaatcccaatggcctctttgggctttcccgatgagcaatatccatgcaaaagactattgtacgtgatgcaatcaggcataacaccattcttgaccatcctagtaaggacctccctagccttttccattgcttgagccttggatagggtagcgacgattgagctgtaagtcacaacattaggcgacatcccctgatccagcatttcatcaaacaggcaataagctttgtccagttgaccctctcttcactctctctcttaattaatatagtgtcacataagctaaaagttatatatggcaatgtagttaatgccatagacaccatcctaggtggagggttgagactgcccttactccgatgttttatctggttgtgttttagttcacaccaaaattaaaagtttaattgaaattggaacaatgcgacggaaaaaattaaaagtttgtgtgtgtaggaaagttttgatgtgatggaaaagttaaaagtttgaagaaaaagttgggaactaaaccaggcctctctttttctcggccattctcaatttctcatctccttacatttcctttttatgggtatctcgaacaggatgggatggaatgatggaacagtgaagagtagcaagaggatgacgacaatgacagatcgatatcactgtgttgatgtttcaggatgttcagtcttattagtagttgggtttcttcttgttttgaagttttgatggacctctgatcttgggtcttcttgttgtagacacaaaaaaaaatttcctgttgacatacccgatatcttcatgataagatgttagcgctttgttcattctgcctggcctgggacgctgggtttgtctttgatgttaaggtttgctagcaggtaaagccagcgctgttacttgtaacacacatgattagcttaaaataaaactgggtgatgcgcatatcctctgctgaaacatgttgcaagcagtcccttactattcgccgcctcccagtcccagaatcgccggcatccaacacttgcatttgatgtttctgggacaacttttgcttagttcaacttttgccctaccagatctgacggtaacgtcagacagagtgtacatgaataccaatcaaaatgagctgaacatgttaatcgtatttttcagacagctaccatttcaaattcaagtaggccattcagattcacgggccaaaaccagaaagtcagcatccactggtttctcacgggtaaatttagtacatctcagaacgtggcgataattctaacgaaatatgaatctacatttgcaataatttacatcacttgcaacacctcccttagaaacggttcgggctgatctgattatatcgacaacataagactcgcataaacttggtaaacataacttaaatagaactagacactgcaaactgatgcatgctaaaacttgcgactaaaccccctatcttcagtgactacgagtagactgacatttacatctaccagatgctaacaccagactggacacaacaaaattgatgaccaaccaagagaaaagcatcctacacgatggacagaggtcctggagaaacgtttttgtcttccaatgtacatgatttcttgtgcactctttggttttgcgtagctggatgtaatcactttctacttgttgcgattctcggcttccctttaacctcagattcctattcaaaatgagggaacgtcagtgtaaatgcattgtgagacaaactcaggaaagaatctcaggatgataactgtaaacaactattacctgtggactgtgaagatagatggatgtctttgcagtggcagggttgtggttttcagccccacggctccagtcatagcagacctggttaacagtaaacatggttaactaaccaaactgtagtctttttcttcaaaacttggagcctcagttagaactatcacttagcatttttacagctcaacaagaacaagcatttcatttgaattcaaaatccaagggaatgcatttgacatacaggttaaacaggaccgggcatccatttgaactcaaagtctatctaatgaatggaaaacatcaggcacttctttcaccatgtttaggccctattgtttcagcttaagattattgtaatctagattattgagccagataactataagttggattataatgagccgacatagaataagctgttagctgtttgtttctctggattattagctgttagccacccaaaaatctaaaaaagcacctttagagtagattaccagattatagtaatatggcttatagattgtaatgatctatcataataagctatctgtttgtttcagcttactcctaataatccagattataataatcctaagttgaatcaaacagggcctcaatatgtgcattcaagatgtctagttcattgcagaactgtggcatgggaaacaataaaatacatctaaattcaacctggtcagaaaacatggttgcatatagtcacaaactaataaagtacaacaagatactcaagcatcacttgacttactgcataagcaaatatcgacccatcactgttgaaggtactgcaaggaataggaagagggcaccgactaaaagcctgtgtaaaaaaagtgacatgggaagtgaatgattatattctgtataaaataaagggatgcatgtgagaaattgactgcaacaaaacaaaattagcaaacacaaatgacctgccttgtactaagcacccatatgattgcaaattaggcagattgctcatgcaataagagaatccatgccatcgagtaaaaatatgagcattttcactaaaaaataattgcataacactaattacatggttgagcagatacaaacagatgattttttcttgaacactgttctgaatttacaaaagtaagttcatgagctttatcttggtttggtttccagatgtgtgcaagaatatttatgcagcacactaaaataacagataaagcaattatgactattaaaaatcactgaatactcaagggaacaaaaatacaagtgcaataaccagtacaaatggaacttcaaaagagccaacatcaaaccttcagtctttgtttgctatccttatcccagaaattaaatgcgccatctgatccagcagttgcaaacgtgtgatgaacctgtgccacgtgatagaaaatatgaaaccttaaatataactccgcaaactatgatttccagacttcaaaaaccagtaagtcggcaatgcttttctcaatgaaacatatcctagagatgtattcatcaatgaagcataccaatttaatgaaaaagatcctataactgaaaatatcataaccaaaagaagaaaaggtgttctatgatgtatgcataacattcaatagtcataatatggaattgttcgatggaatcgtaaataggacatttttggagtattttgagacatatctttatgagaattgcaacatctgcatgatcagattatatacggttgttagattaagtcttaacatttgacgttccttacttggaagtatcctacattccaacgtagaacttcaaccagtactttgtgaataactgcaaaaaaaatgtgttgccgtaggtgctaggccctgtggcaggttgacacctaacacctccaagttgggctacaggctgtctagtagttcagttgcctaggcatggtgctagtgctgagcaaagacagacaccaacaggcacactaatcaagatcatatgagagaactttggggtatgaaaccaatggtgccactcgtatatagtatatattgccagaattcattggtcaaaatatataaagttagaattgtgcaaaacatgtatactgttcaatggaaagagaattagaggtattttgtggaagaagaaactgtgtttttactgttctacaaatcaagtgatggttaagaaaaaaaatgcaccataactcagcataactctcccgcataagcatttccaataaaagcaaaagtgctatatggcattcatgtgtactccacagcaaggtaagaccattcagaaaaaatatcataaatatgctaaggtataggaaaacaagagacagacggagatcttactgggtgaaaattgagtgaattgacagagaaaatatcattcccttccctgtgacatttgaacgtgaaatttttgctttgctgtgagtcatcaatatgatgcacaccaactcttccttctatggaacccaccttgaaacaaaattagggtcagagtcagacacatggaaatatacctcttgtataatgtcagatagaaattattcttaggtaacgctgagcactctatccgaacaaggtcattgctgattatgggtaaaggtaaacattggttggttcaagcatatacaaaacctaccttgctagacatctctaggcagattataaatgggaagatgcacaactatagaaattgctaaacacaatttttcgtattgaaccttgtaccaatttttttggtgtcaaatatatactagctgaagacaataccattgggtgaataccaaccaagaaaaagaccataagtacataacaatgcattgctagaatagttatctatttaagcatttagaatagactagaaatttttacaaaaaaaagttgcattaccaaaaatccttgttgatccgggaatgcagcaagacacctagtctggtatttgagtggcgattggatgcgcttgaactccgtctaatgaccaaaacaggaaacaataaaaacactcagttcaatatgagaagttgcagatgaaaaacgagtgatccccattattcatttttaatggacatgtgcgatgttcacaaagaccaacctgaggattctgcaagttgaagacgaccagattacgatcagcagttcccacaatcataaggggataattcactgtaagtgcgtaacagcgctcaggaagttgctgaacatggacaggatttgattgccttgtgtcccaatacctataaatagcaaagtggtcagtattggattgactagaacagatcactgtaaccacaagaacagaggcctatgtgctgcgatgagattaagaaaaagttccctaaattttttggtaatgctcatacaacttatgtcacattaccaaagtttggctgtctatggtggcaaaccaaatatgggccaatataaaatgcatgcctaattgcctattaatcaaatagacagcttgaacttagatgcttgacctcaagcttcctaaatcaaatatcaatagcaattagggtctccccaacaatataagctaaaattaacaaatatttttaggaacgatcacaaggtgtatattttgaatccatagttactacttactagcgaataactatctgagtaaatagagtggttgatatgaattcgaattccatgtaaaaaggaataccgaggctgcaaggattggatttttcacaccttagagtcttatcccagcttccagagacaagaagattcatttgaggaatccaagcgatctccttgacaggtgcgtcatgcattgcaacagtctgagcctgcccaccagacaacagaggccacatttttacttgtttatcacagcctccagagaacacagtagttccatcatccttccaagctgaacagaggacctgatagaaaacaaatcaatgagcacactaaatactaggaaaatcaatactgtacattatgtgaatgtggtcttgagagaaatattgagatcatactggctggtcatgcgatatagatgcctttggttgactactcccaccaacaatctcccagcaccgcacctgcacaaaactcaaagtcaaacctggtaagaacacattgataaatgcatactgaaagtttacaggaaaaataaacttacctggttatcccaggaagttgccaccagaaggttgctctttgggctaaaactgaggctcgatacggagtcacctggattaggcagtacctgcatttacaatttaaacataataaataacttacaaagtaaatactagtatgatttattatttacagaatgtgaggaccaacacaagcacagatagaaaaggaggacaattgttgcataaagcatcacacctcaaatgacttgtttggattcatgtttggggcaagaccaagagtcgccatctccttctacctgatccttcaattcaaatttaacaaaatatcgtaagaaacaaaacaagagaaaccaactcaagctgttagcacattccaacttagaaacagcacaaagcatagagagacaatagcaatccgatctcccgcaaaagcaccacgcatgggcggatctaacatgggacatgggggttcagttgaacccccaaactttttgggaacaaattaacaaactgctactagtattaaggaatttctagaacagaagaagctagggttaacgcaaattcgatatagtgagagcgtgggtagagagagatgggaaggaggatgtgctaaccaggaccaggatgcggcggaagcgctcgctcgctcgcgggatggatgggatcggctcagccggccgcggcggtggcggcagaacgagcgccggcgccgcctttgctcgctcgagttcgagtcgcgggacggatggggatcggcgcaggccctccctacgatacgacctacggattttggttcacttcaaccatcggttcaataaaataatcaatttatactagtatattttatttatagagaattttggtttaatcaacacataaaatataatactatataattgttttgtttctaaaaccattgtagcaactaagcccaaacagtcaggtgcacatgcatggtaataatgggcgaaaatttgagggttgggtctaaaatgccatgtgcacactttttatactttttagcatgaaaaatatttaagggttaggtagggttttgaaagaacccacaagccatgtccatcggggtctcgattccagaccagcttagttttcctttggttctgcaaaaaaccatccgatttaaatgatttttctcaagtcaattacatctccatctccagactaagcaccagggtttgcaaaactgccggtaaccgcgtggttactgcgcttaccgcggggtacggtaaaaggaaaaccatggcaaccttcttaaattcaaataaatttaaaaaataatttgaaattttgataaattttacacggtttcatatggtttgccacgattaccgcgtggtaacctcggacccggtggtttaggaaccctgctaagcactggtccggtttttcttacaccacgggttcggttcgatttttacaactagactattgagatgccactggagagaataattctttgcaaatgccaattttgcatatgtagaaggacatgtcacattaccaacatggaggtggcaagaaaatgacccatttgcccttgtttgatcttagtgtacattgagtatgcggataatatacacctacaatacttgagcaactatatacaaacatatatgctagtagatccaatagatttattgtacttcaaaatattttcgttacaaatttatnnnnnnnnnnnnnnnnnnnnnnnnnnnnnnnnnnnnnnnnnnnnnnnnnnnn

SEQ ID NO: 561 - DNA, 2123 bp, Oryza sativa
atggcaaccttcttaaattcaaataaatttaaaaaataatttgaaattttgataaattttacacggtttcatatggtttgccacgattaccgcgtggtaacctcggacccggtggtttaggaaccctgctaagcactggtccggtttttcttacaccacgggttcggttcgatttttacaactagactattgagatgccactggagagaataattctttgcaaatgccaattttgcatatgtagaaggacatgtcacattaccaacatggaggtggcaagaaaatgacccatttgcccttgtttgatcttagtgtacattgagtatgcggataatatacacctacaatacttgagcaactatatacaaacatatatgctagtagatccaatagatttattgtacttcaaaatattttcgttacaaatttatcctctcatatcttgttcacattactaaaatttttgcacgagataagtccataaaataactgaacacatgaaaatctatttatattgtcgagggggcagtccctcggatagaggggagtggagacccctctccgggtgtgaagattcgactagggggttagtaggagagcagtgcgaggtatctgcgatcacggcaattttgcggcgcccatccaccccgtgaggagaagaaggcaagaggttatacaggtttagggcatccggaggtgtaataccctactcatgtgttggtattcgttatcttctctagatcagctaagtacaagagaggctttgcaagctacaaagcggaagtactgacctagcaaaaagcaacccttcatccgtatctagtctccttccttttatagtccaatgaggggctcacattattacaaatctttcctttggtcttgtctcatcaaccttcttcttgttgtcggctggtgtcataatgcagccctcaagaaacccttcaagtcttacggttcatattaccctaggctcctaggcttcgtctgagaatgttgggcgggcctccgccaatgtgctcaccacgtggtgcgtggtgggcctgacgaggcccgaccttcccgaaacagcgccacggttacttctctgcccctttggttgaatcaagtggcacgaggcatgtgcgacgcgtgtcctaggcgccaccgtccaaagtgacttagcgttggcgtcttgtccatgtcctttcaactcagactgcccagggatcccccaataaacctgtttcatttatggtggggcgtgctgccttacagttggctgtggagcacgtccaacttcccggaagtttctaaggtcacaccgtgctgcgcttaaagaaggttcattattccttgatgagcttctcgaaggcgttcttgatgaaagaatatcttgagattgtgcgtcttgtatcttctggcgcccctctaaggccctatttgattcagcttaggattattataatctaacttattaggagtaagctgaaacaaacaaatagattattataatctataagccagattgttataatctaataagctgctctaaaggagcttttttcagattattgagtggctaaagacccactacccctacatacttgagaaaaattacccacctatgccatcaaccaaacagatagctgagggtattatagactttagtctttcaaacccaataatccatgcctccaataatccagacaaacaaacaactcacaactttattttatatcagcttattataatccagcttatagcaatctggtttaataatctagattataataatcataagctgaaacaaacagggcctaagccgagggacgcgagctatacaaggtccaaggtgagcccaaggcctgaggcaaggctaggccaaagcacaccttggatcacgcttttatgcttagcaagcctcatcaccattcttccttgtgcaacgtgtgacttgtacgcgctaaggcaagcccagggcccagagctaggctgggcccgaggcagatcttagctcatcttcttaagatatagctcttgcatgtttctatgcctctcttgccgaggatcatagaacctgcaaggggcccagggccgagcccaaggctaaccttaaactatactcttaaggcacgttgggg

SEQ ID NO: 562 - DNA, 8393 bp, Oryza sativa
  unsure (1)..(8393): unsure at all n locations
tgcttgtgacccaagccaggctgcaagccacttatcccttctttctataaatttaaggccaaaagctcaaacctcgtgcttccacgtcatcatcaaattgtgaaccattggatgaatgcattagatcgcttctcagacgttggatggaatgcagcatagagcctaacccatcagtcaccgggcgaagtcttcgcctcctcagtgccaaatgtagcccatataaacacattggcccatctctacacacatctacatgtatccaggtcgtcaatctgtataaaatagctttatggctgaatgctccttcagttgacatgtgctacctaaattatctacaaattttggatagggctgctaaaaaaaatttcttcaaaaaagctatttgtttcttttgtttcttcttgagattatacctcctatctaacaaattgatgttaaccaagtctcgcagcaacacgcggggcatcctctagtatactcaaagttttgagccatatacgcaacgttcttactcagccaggaggaaccctgtatacgaaatcttaggtgggcccgaggccctccaaaaagggcccctattgacgtcaccctagggtcttctttttattttcaaagacattctgagcatgctgtttatttaataataattcttttaccagataaatgggtaccctggtttccatttcaccgataagagtctatgtgaaattttagttcagatttttttccctatttttttaatatgtttgaaattttgcatgtgttttttagatttttacgagttataagtaaaaattatatgttggaataattttttttgttcaattggagaattataagtaacaggttataggggagtgataactgataagaactattgaattatcacccaagggttaaaaaaatgactgaatctttttcaaacttcaggcgcctggaatcactcccaatttttcatatgaccatccctgacattttttttatccatggaaatggcagcaattacaagttgagcgacgcaaataactacccaagcaagttaattactgtagtaaatatttacacgtcttttaaattcaaattcaaattctcctcctcctcctcctcctcctagctactgctgctgctgctatcctatgatgaagtgaacacgtccgtttaatttctttcctgtccttgcaaatgaaaatgcagagaactcaaactgagccacttgagctccatgtcgtcttccccggcgagctcagcgacgacatcttgctcctcctccggtgatcgatcaggctggccgttgccggcggcgagctcagctcgctttacgccggctcgcgcgggcgcgccgcccagagcgagctgagcgcgcggaggcgctggcagtagtcgccgagcgcgaggagcccgcgcgccgcctgcggcagcgtcaggatcttgtacatgttctgcagcgtctcctgccggagatggtcggcctgcacgtcatcagcaagatgtcagccgagctctgctcgtcgtcggacatggagatgggaggtaggtggtggtgatcggcgatggcgtacatggtcgacgaacgcgacgaggttgctgagcctgcccatggcgctccccatctgcgccatgtagcatccgccgtcaccggcggcggaggacgacggctcctcctcctccggcggcggcggcggcggcgaggcgtcgcaggaggtggagacgacgacggcctcggcgagcagcgagtcggcgagcgtctgcttcagcttgtccatgccctgcgacagcgcgtcctctaggtggcgcgccttctgctggagcccctgcacgtcggcggcctgccgctccgtcatcggctccagctgcggcgcgagcaccctgatcacctcggaggggcggaacccggcgatccagaggaagaaccgctcggcgccggtgcgccacacgccggacatcacgaagaacacgtcgcgcctcgccgcctcacgcttcgccgcgaacagcctgtcgtagtgcgccagcgccgcctccaccaccgcccggagctccggcccctccgccgccgcctgcagcgacgccctcagctccgccgtctgcctcccctgctcctccacccactgcgcgtactccacctcgaacgtcaccacacctgaacacaacaaatcaacaaaattccatcacaattcttgtcgagctcgatcaatcgatggattcttggagagaagctgacctgaatcgatgggcgctggtagggtggctgggttgctgctgcggttgatgtacgcgctctgcatagctcagccatacgtcagcaatgacagccatggagaagaatctgctcgtcacaagctggttttctttttctttttcttttttttgttcttacctgttgccttgctcgggtgatctcctgctccagatgcgccagcttcatccggctcgtctccaggttctggatgtaagcctgtcacaaaatcaaacaaacctaaattaaatcatatctttgaatacaaaatcatgaacaatgagacgaataatgtgatgtgatcatgagcttgctcacctttttccgtagccggctcttgcgagctgcttctctgttctgcgcgagccgcctctggatctaatcgagaaaaaggacgaacaatcaatcgaattatagtttgttaattctaattaagctagtcgtaattagcaataatttcgggcgattagtttagctagcttgtgtcagagagattttgtcccaccttgtctcgaggcttggacgcctcctgctcgaagctgtccgacgcatgcctcggcgattcttgcagagctgcagcgttgtcttgatcgtctccatgctgcagaggcagagctagctgatccaacagcaagagcgaatcaaagattttcaagaaatacatcagcaagatgatggaggttgttgtgttaattaattattataaataaataaataattacctggctctcgaacttgggctctgttagcggcggcggcgcgacgaccatggcggcggcggcggcgttgctggtgctggcggtggtgtccgggcggatgaaggggtggtctccccagacgccggcggcgaggggatggtgccggcggtcgtagatccccatcgccgccggcgccggcgcagcgaactgcgcggccgccggcgccgccgaggtcatgtaccttggcgcgctgctcgccgtcgccgccaccaccacaccaagaaacaatcgatcgatcaattcaattcaattcaacaccgccaccaatcaaagaaacgagaagaaacaacagctccgatctctctctctctctctcactcagagctggttcggttcaatggatatggagctcggaataatcccgacgagctctctcccgctcctctccccgctaatggcgacgacgcatccctctctctcatatcgcgtagtagtatttgattgctttgttgcgtgctggcctggaccaactcacacactacactctctctctagtttctctctctacggcggcgtcgcttccaaagacgacaaaacggggcacagaaagggtgtcgccttgttcgcttccgccgtcgccgttatcactgacgacgtgatggcgtcagcggtggtgggggctgcgtttgagagttgaagagaagaaaaagaacgtcgtttttcgctagtacgcatctcaaactgctgactgatgtattttaaaaaatataaaaagttaaattaattctttttaaaatttataataattaatatttaattaattaggcactaatagtttatcttattttgcatattttttcaatgcttctcatatattttcttcatcttaaaatataccccctccgtctcgaaaaaaggcattctatagtaatggatgtgatatttcctattacaatgattctagatgaaagcttgtccaaatttgttgtatcagaaaatgtcacctctaatattatattgtctttttttttatggaatcatggaaggagtactcctataaatgatttctataaatgattttggaggtataaaagtacggctgaagacgacgcagcaagcctcgctggcgcatgggggcacagggcgcttgggtgggcccagaggcgggcgcccacgtggcaatgagtgggtagtatgggtggggccgaggtgagatggcggttgctgcgtgtagatccagtttgtggggggtacggtaactctgtcaaccgttaggtacatcagttgtgtgaattttttttttgaaaaaaaaataaaactaaggttattttagtgatgggtttgagttttgtttgtgaatgctctgactatcaagagggggatttaggattttagttaggttggctcttgcatacaaatccgtacatatacatgtttcgatttataattataagtagttactccgttcatataataagctcattttttcttctcacatctatctcaaaatatatttatttttaagtaatcattctatcggaatttatgaaagtatagagtataaagaaataaataattgtattgggatttaataaagtgggagtgctataattttttttagttctgtagtattaatgtgtgggatgggtgaaaattaaatttattttaagacgaaagaagtataatttaagacatgggagtattgctttagtggctatcattatcaaaagtaatagagacttttatgcgtacaccaaaatttggttcaatggtatatactccattggcattaggtatatcatgtgcaacctattttggattgtgtgctcataggaaaaggatatacattctaaactcttactagtactgtgatgttatgagcacattaattttctctaattcccattaatttaaatcaaacagtcaggacttttctaagagttatgtaaaaaaaaataatacgtgtagcgatgttatttccaataataatgttgaatagcgtattcatatgttagaaaaatacctattgaactcattataaattgataaatcaatgttacggcacaatcccattcagaagaagacatattttgacggaatgaaaaagacgcactagttactggtacgtgcattttttttgtaacgaaaagaaaaaaaaggaaagtaaatccatgcacgtaaaaccgttacttagaccggtaccatgtaaacaaaagaagaagttccatgggtttcatcacgtagagtaagatcctagctttccaaaggaacactaaaaaacaaaaacaaaaacaccatttttgtcttcaattgcgaggtcacatgttttgccggtggatctcatcggcaggagacgagacaacgacggagaagcgggatccgacgtggcggcatccacgtcatcccgagggtgacaggccaccgtgaaataacagcagctaagcactcaagcttttcttctcatggcgacacgtcatcatattttagaggttgaatagtacttcctccgtctaaaaaaacaatttactagatattgacacgtcataatactacgatcatatatagtattacaatgtatcaatactagcaaccccatcgtttagtttattcgtggcatatttgcaatagaaaagtaatttgtaaataaaatacttgttcttagtgatccaaaaacaaaagctgaaaaataaacttcgataaaaaaacttaaaatgaactttaaatctaagatagaaaatttaaatttccgctgataaatataagtataatcgccagcgatgaagggagtactagcttatcttgtggagtagagacagtgacggcagcggggaccatgtcgtcattgctggcgtcaccccgcatcagcacagtggggccgtacgattggctggctcactgactgtggcttggccggttggccgtgcgggtgggcccagatataataggcatcccttcgatggttaaaatgcctagttatcatatttctaacagtaaaaataagtcgatcttaaaaaaggtctttttaatatgggcataatcattagagcataactttgttcactatttattttaattgtaatatatttataaattgtaattttatggcagtttttctcacagcaaatgtatgcgcatatgattctcgtccatcgttattgctattggtatttaaatgttttcttaaacatgtagcaaggaattttacatggtgttttgaataagcgcttcatttggggtggttgtttggttaattattagttgtcacacatatattgttgacactactgagtgggctaaagcccatgtgaagaattattcttaagaaaatgataaaggtttttttaccatatgtgtaggataaagaaccttcactttcgatgtcctttactgggataaggcgctgataagttttctggaaagcgccctgggcgagtaatcgctagtctttcccaataactcatctttctctacgttcgggtattgcgcatcgacaccaacaccaggcacacattgcacatgcggtgcgtgttactccccgtcaagacaatcctcttcctgaatagaaccaggactgttggtatgtctcactcatgtttcgcatgtttaatgtgttcatgtttagatcagttgagttgattatgttagtttacatgcttattgtcatgatttatttataaataaaataaatttatatgtgtttctatttcaaatatatatggtctttgttttaatttctcccttggtccacactcaagattaaaatatgtcaaccgagtaatttattcataattaaaccggttcaaacaaagtactttctttcacactaactggttgttcggaacgtggatatctcacataggttatgattgacatgatattggtctaattcaaaattcatacactccaaaacaacttctaatataacttactagaaagtggaaatataaactttttcacacgaattgcatgcttccaaagtcataaacctagcccttttgtcagaaaggacggcaacatatataattgtcatggagtagtaaagataggaaaaatctttttctctctttttttaatggttgggaccaactttgattagttagctctgagttagttggcgatgatgcgtctctcacaacgtttgagccgtcagtgcgtcgtcagcaaattaactagcggcacttggaatctgactatttgtggggggtggaccccacaacatgccaccagggcaccagggaatcaggatctcctttgcagccactcctagtgctttctgcactattctggtcaaaatgaacctctattctagcttatagatttgtagtttgtgaaaccacatgcatatctagtaccactccaataatctagagccataggattttatgcttaattatcttgatgagggatcatgtattatctatcataaaatttcagccgtgcgatggtattcgagggcatcctcatcattttcactggaaagtatatccatattcctgactgtgacgatgataggaatgtagttcgacattttattggaggaaactatatcccttgatttatcatcatctctattttaacgtaatagttgatgtgttgttcagaagtaattgtcatgcaagttgagtgttgactcctacttttagtctcttaaagtaatcaagtgttcaccttggtttaactgttttgttataagatattaggtgccgcgctatctgttttgtgggagattatggattttgaaagaagttgacgacctagaagaccttcaatattagggcgaatcaactatttagacctccacgaatgggtctttgtttttagttcaatcaatttttcaaagtgtagatttcaaaggtaaggtgaatctccaaggacgagcatacacgtacacatgtcgaaaaaaatctccctctctatggactcccatgtagccatgttgtaccactagatgaagattccaaaagaagggcacagccccaatactgtggtggacctgacctcactttgttgtttttgtaaatagtccacttgatctgctaaagaactattagcaccaactctataatttagtgtatagagtaaaatgcaccggcggttcttaaacttgtcagcaggtttcacttaggtccacgaacttataaagcgcacatcgaggtcccctaaacttggtttattgtatcatcccggtccaaagtcgcgtttgaccgtagtcttgcctacgtggcacgccacgtgaacgatgacatggtttttttttattttttctctcttcttccttctcttttctcttttatgaaaagacgatgacatggacgatgatgtgtatgaggcattttcatcttttcgacaaggaagaaagagnnnnnnggaaggaagaagggagaannnatnnaatnnnaatccatgtnnnnnnnnnnnnnnnnnnnnnnnnnnnnnnnnnnnnnnnnnnnnnnnnnnnnnnn

SEQ ID NO: 563 - DNA, 16696 bp, Oryza sativa
tctgtttgccatgcctaaggttttacagaatcaccttaatttcttttgtgtaaattcaaatggaacaatgggttttttttagaacagagaaataataataaatggaacaccaattaagaaattcttacctaagtttgtggatgttgaaatggtcttcaaggtatcccgggtaaagctccatatgattcttcagttgatcaccgtttatatctaacatatattttcttttaagtgagagagagaaagattgaaaaatcaattcaacttttgagatacatatgcggtgtgccttcaccaaaaagagaactacatagatcctgaagcataatgtgtgttattggtatattttttaatgtagattattatttgattactgcttcaagtctaggatttgtagagtagtatttcatggaagtgtagattcttaaacgattttaaattcaacaaagattaggttttctcttttaaaaggaagaggggatatattcttttcccttgtttctgaatgacataagagcaaaaaagttgtcggtacgtcatctgtgaccaatggactaaagatgtgtggtgatgcatgaatatggaaaaaaaaatgctctcatgatatattagtataataccctatagaagatatgatccttaaaataggtttacatgtttgatcattctcaacctcttaggaatataattactaactggagagatggagttccattgattaggaaataccatggtctataaaaggagatgattgtgtgcatcctagttggtgcagaggctggaagtaatatttctattaattatctaaaaatattagtgacaagaaattttttacatttggttgttgacaattgatagaagcataaatacttgtggagaaacaaagatgatgagtcatgttctttttattttcagcgagctgttgctattctgaaaaaaaaaacagatcctgatgctatgatttagtttgctatgacactgtatagttttcttcaaggaagattgtgataatatactacaaggcaaaacattctacttcatgtttgccatgcatggagatgaacaatgtgatataaataaaccttaaaaaaattggcacatttctctgcaaggaaaaaaacctactagtccttcctttttctttttttcttcttttctttttgcgacgaaaaaatttctagtccaagtaacctgatattggccaaattttaaacacctccttttgtggttgaagtgtgcaaaataaaattactatactgaagaaatcaaataaaaagtcgacaactaactgtaaaccgaataaattgaacaaaataaaaaaccgagtagcaaggtagtacctttcctgtgaggatgaccagacaagaaccaaatcaaccaagcaagaaatggagcaagaagaaaaatggctcaagagctcctcatatatgcaagtgctcttgctgaggtccaaagggcaaacaccacttgcccacatgaaaccatgtaccaaggttatataaggagccacccctgcttttttccccctcagaaaggaagagccaattgcagagctgcttttgctaagaaatgttatcaccagggccttcatgctagcttaggatgcactaattattccttttagtaaactaatcaggtgcatatgtccaaagttaccagtaaatataatgcatgatcacctaactaccagaaagatggtaactttggtggtgtaaaagttaaaaaagaagaaggcttttcaagtaccatttactactggcacctgatgaactacacatatgcacactgcaaaaaaaagtgaagcttgaggttaagtagctctgtgcacacaactacacactgattaggcagaaaggcatgtataatgacagattaagaaaagatagtatatatacttactcttaacctagtcaccaaagtttaaagggaaaattagagaagcttgcttgattaagcaatccttcaaaggcaccttgtaatcattactagttttcagatttgcagcaagcaagcagccatcttattccagaatctcactgttttgattagcacatacacaatcagctagctaaggatgtgttagatcactaataaacttgaccatactttaatttgaagcaaattaaattcttcattgactgtgccacattgactgaactgaaggctcatgaagacatgcttatctacacaagattttaaattgagaaagattcatagtagtactagtatacaaaggactctcatgttacttgattccatatgcatgcatgatgcaagtattaattaatgatcaaggaaggattaactagattcaacaccttaactcatgcaatggagcttaccttttctagcatgtaatcacaaagaggcctctttacagaattacaccctcttttgtcagctatctgttcatgatactgctggtgttcttcatccatgtttgctttttaggtgccatatatagcaaatcatcatgagcaacatacctaccaggtataggttaattactgatgtttctttttaattagataacacattctaattaattaacccaaccaaaacaacataccacattgtcaacttaagatatataatgagtaagttcaacttaaactaagaagtaagatagtgccatgtacttcctctcaactcatgacagaattatatcctagaatgtatgtagccaaagcaattaactattctgatcaactatatagatttgaaccttttatatggaataatggatgtgacagagtaagtttgtcatcaataaattgtgttttttatgttattgtccctcttcgaatatataaaaagtagaatatatagtgttcaaagatatgttttgtcaacattgaaaaacagataacatcattctttatctactacaagagggagtatagattggtgcgtggcaacgaagcattctcctttgctctagctagaggctccagagaagataacacacctttggacctaattaaagaagatatactctgatgtaaagcatgcacaagggattaacaaattcatcaacagtgattagttgattaaaccacaatggttttttattatgagggctctaatgcaatgggcccattgctgattgcagcattatcaaaagctgccagctgcctctgtcactatccaacatttctttctggttcccatagttcctttaatgtcttgaatgtgtatgggttttccccttaattttcttctttcatggtttgcacaacttgattttccactccctcttcttaatttcccgctctttcgtggtacccatgattttatttgtggcttttaatgctttgagaaaagtttatttacccatgcatcctttttatcaagtgtggacctgtccatagaggcctacaagtatcctcgatgaattgtatatattttgatctaatttcctagaattttatatatatatatatatatatatatatatatatatatatagagagagagagagagagagagagagagagagagagagagcaggagaattatacattttattattattcatgtacacctcttctatcatctgggtcgaattcatgtaacctctagtactcccctgtgaattatgtgggttatttgctctttagcttatcatccacaaccaacatttgaatttcaaaacttaactttagagttgattttgattttttttaccatattttattttcagtattggctttttagatgctaacaacacatatgtaaaatttttgcccataaattatattttggtcgctaataagcgttacaacttataattagttatagtcaaaacgaccggactcatttgtaggtgcaaatttaaaagttttaatttgtaatgattatttctatatatcttgtataaatgatctagtgggatttttttgtggtacaccaaaactttgtgaaccattcattctacagtcatccaagggccaatatttttcttacctcttgggtggtaagatctcatatattatcatttatttaaaggctattactattaattactaattgaaatatggagagaagaaatgtttccttgcatgtaataaatgatcttgtgacatttacattatccaccagagtttatacagtcccatttccttactacttttttttcaatatgatacatataatcattaaaatgaagttaattccataaacactgaaattaattaacttcagccagatcagcacatgtctcattgtctggcctcacttctacagatgctgcactaaagtgcttgattggcccaaaaaaaatgtcagtaccttgtgttcaacatgaagttaaccataaacagcatggattcttctcaggaaaagagagaaaagacttggaggagaaaaggaatttgcatgggaccaaggaaagaaaaaaaaaaggtttcgaaagcattagctaaaagaaagaaagagtggagcctcaggtggtgagaggggttctatttcactagagagaagttaataaagagtggtgctgcatgactaagattctcacatcactattgtgcttgtatatatgcaatcattcatggctacatcaatatatgcatcatgcatgcatgtataccatatatgtatgtatttgcaacttgctagggaatatagaactttagacacctagattttggaccacatatatacactttgacgaatacattatacatacaagcctagctacttggaacatagatattttgcaagaagcaatgcaatattacatgatacttcttttagagagagagagagatagatagatagattttgtgtaatttgggaacacaaaatagtcagtaaaacttgggaagttagtcaatatattctgtcatttcaattggagtcagtgaaattagaggaatctccaaattgataattgtttccaaggtataaatgtagcaggatctaaattgggtcttacaaaggaaaatgagaaatgttatagtacttatgaaagaaggtaacatatggtatcatcttttctaatataaatttggttcattatgatatacaaggtcctggaaggcttcaaattttatgatgcctctcaaatattgtaaaatcactcaaagaaaataactgaaaccataagagtttactattatatgcacaagattaatgtagtgcagttttcttccatgtaatcgacaaaataagtagtgcatgcagtttggtgtgtcatcagcatggagtagggaccgcctcatcaaacatggcctgagttaggatcaaaagtgtcatacaatgagcaagctagagtgcaatttgataatttattctactaccaaaaagaggccaagaactagttaaacataacaattactcaattaggtcttaagataatgctggatgtctcattgtgatggttgcttgttgatcaatgactagatgcggcctcagaagccgacgcaggcagatgagaggtgaacatttttttctgtgattttggtgatgagatttcgtgtgcaaaagtgataagtgctgagcacaatagaatttggccatctggctgcaccattcggcgattccttgcatttgatgctttataaattttgcaacttgcgttactgaagaggcaccaggtgacagattcaggaaacttgcaaattctcgcatgaattaaactgttaatttaacctttcaaaaattcaccagtctccagtggcagattcagggaattaaacatattaattgtgtcgagtgatactatgattggcattattttaggtcaaattagcaaagtatatgtttaatttagcctaacattcaattttattttttcttcagaaggttattttttttaaaaaaaaacgcttgatagttatacaactgcactaattggttgtagcttcgttgaagtaaaggccagaatatccattttattaaaaaaaagatgacgtcacatgtgtatgagctcccactcagataaaaacagccttttacactgtaattaatcaccatttgttatcaccagtccgtgattacccaagagcgcaacacgtagtcatacacttagattggctcacgcatctactttgtcgaatcaagcaggtagagaaaaataagacacggagatgagaaagagaggcgaagtcttggataacctcattgccaatttgccaatataataatttatcagttgcaaagcttcaaccttgttagttaaacgctgatcattatgaggaggacacttcgtgcactcaagtctgaagccaaactctttgacaatatgtgccagaagaataattggcaccacttgttttgtcatccagaatcagagaagcagtctattttttttattaatgaaatggttacttgcaaagatctcgagattatatttgcatctctctctctgaaagatactattttaaacagtactattaattaacaagaagcaagatacagtcaggatcagaggctagctgagcagcagtgacatgcacatgtcaatgagataggcgttgacttggttagtgatcatcaaatgatggcctagcttgaaccaccaagcaattgggttctaggtagcaactagtggtttttttgctgaaaaaagtgcaggttttcatctgtagatgcagagaaggatgatatgaaacagtgtccttgcagacacataggatgagccttttgtcccactcacaatgcaataattggccaaagaatacaagcaattaatcagcaaacataatgcagcaggcaatgtcagttgtcaaggtgtcatctctgcctcacctttactttccctttcttgatcctttgcatggacaggtatagattgggtggtagctaggtgccaatttgtgccacacaatgtaccccatcgatctcagaaagacttcatttctaagtgctccaactcttgtccccaaaagactttatttttatcttttaatctactctagttccgtaaatcgaaaagttttatctcttcaataactcttaatttcctcttacctattactccgcagcactattttcttattaatgaggggcattttggtcttttaccctcatcactaatttgtcaacttcgtcttaaaattgaagtctttgtgagacagagggagtacatatggaggaccccaaccacaaaggcacgctgctttcacaagcttggttcaatctaaggggcctaaagttgtggaggaatatgtaactgaataacactgctatgtgcctcactaagacatgactttcagttgcttatgaagctttaagctgactggggcttgcaggaaaggagaggatgcaactcaccaaagtgcagagaaagttgcaaagattcactatctgtgtgatgcttttgacgatgtagagatgtatgttattctcatgtagctttcggttggtgcctggcttaattttagaatagtgccatgtatttagatttgctatatttgccacttgcataactcttcacttatttgttttcataccaaaaaaatgggctcttgatggtattgaactatcaccatattatcaaggctcctcatactatgctttgctatatttgtagcataagcctgaatgtaacctagcaagaaatcaacagagaattgcatgcagattagtcttctgcttgctacacagcaggtgattcattttcagtagtacactggcagtcagaactgtaattttaagctcttttgtatgacacatcaccatattttgatgtaccaaaagattcatgactacaatagcacattgtacaacatacacattcatgcgcggtttacgatcgcgatacgttctattgttaccattgcataaaagtaacacaaaaagaaagaactaaaaacctctcaattatggcctttttttttacatcatttcttcccagaagctgttgggtagatcctcctgaaagcccaaaggattctgcacccaatctgctgctgctgcttctccttgatgctcacctgatgctcatggcttcttgctgcactgcccttgtgtcctctctgctgctgctgttgccctttgagagaactggccacagctgcttcgtacaccattgctgcagacaaaaactgctgtttttttccccttgtcttcttgtcaagaacagattgccaaattgcccaaattgcttgcctgcttcaggtgactgaaaaaaagaggatgtgatgtctcatatttgtagtggttgatgatgcagcagagaggaatggctgtcttggcagccaaggaaccgaaactggcatgtgtctgaatttctaaatttctagcaggtagcagccaaggaactgaaattgacatgtgtctgaattatgaatttctgatggagattgtggtcaaagtatggctcattccactgaaccaaatgacaaatatttcctatgaaaactctggttttggcctcttcctggaagcctgggagaggaaggtacaattgaaggagtctaagtagatgaattgatggatggtttctttgtgcattatttattattcgtttattcgcttattcgcggaataagcgaaacaacatatttccaaacaaaaagtaatttgtgaataaaatttttatatacgtgttcttagcgatctaaaagcaaaaggctgaaaaataaatttcgatgaaaaaaacctcaaaatcagctccaaatttaaggttgaaaattcaaattttggctgataagcataagcataagcgaaaagacgaggccctcagtctcttcaagtagtctgactgtctaccttcttgttattgtattttttacaagaaattagatgccgcctatccgtttgtaggagatttttttaaaaaaaaatcgaaacaatgtatgtagacacttatatacccacgtatatattcatccctataaaaataaaagaattattactcataaatatgatcatcagtgctaagtaaaatacataggtgaacaggttccaccccccaaaaaaaataaccagtatctacgctcagttcgtggagatttcaagattttgaaagcaggtgactgcttagatgttgggagtgaatcaacaggctttagaccccacaaataggcttttgtcatcaatttgatcaatttttcgaagtgtcctaaatagttctccaaaaaagaaaagagtcataaattccaaagctaaagtactctgtgacgcaaaatatctccctccatgaactcccacttagtcactactccctccgtcccaaaaaaaagataaaccctggtttctgtgtccaacgttcgactgtccgtcttatttgaaaaagttatgaaaaaaataaaaagacaagtcacgcataaaatattaatcatgttttataatctaacaacaataaaaatacaaattataaaaaaatttcatataaaacggacagtcaaagttggacacggaaatccagagtttgcctttttttttttggacggagtgtagtcatgttttgccactggatggagattccaaaagaaagggcatagcctaacactgtagtggacctgatctcactttgtggtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatataatggaataataataaatggaacaccagttaaaagtggtcacctaagtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatataatggaataataataaatggaacaccagttaaaagtggtcacctaagtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatatatatatataatggaataataataaatggaacaccagttaaaagtggtcacctaagtttgtgcatgtgcaagaagagattatcatggcagcaaaatctggaaagttagggacaagcacaaacatgtaaaccattcccttaatttgcagccatttcttacatttgcgatcatccccaattgatggcacatccttgaagaatatgactgttggggatgctgcaagattaaacagtttgtgagttgttttacgtgaacaatggcttttgcattcaccaactcgtgagataaatatacaggcttatacaaaaggacggctgccaacaacgtggacctcgcggacaaaatatacaaccgggcccacactggggtaacattttgacaacaaaagaaatttgccgttacaagaaccactccctcagcaatctagaatctaaccaagctgagaggtggagccaaaatggcgcggaaataattatctacctggcattgagactacaattagctcaaagtttggggaaatgaagaaaccgctacccgcgccgcttccacagcacgaacacctagcaaaggaaaacatgccagagatcagaaaacaggagagatggttgatgttttttaatacaatgactcgtgcagttcttcaagaccctagtgtgcataagcaatccctaaagtcacaaatatttgattttgatgtagaatgagtatcggtcaaaacattcaaaattatggcaatcaattttataccatagcaagtttgtaaaatctaacaagtttatgatattatgacagtacttttcgaggcagatctatgtatatcattcgttttgtttttaaactaagtatttgagaaattattaatggtcggaattttttaggtttgacttatgttgtcctaaatgtcaaatatttatgactggagggtgtaaaatcttgccatatgcataagccagcgtttgggaatatgttaggactaggattaaggcatacctgtacagtaactttacaaaggggtaagaattttctgcaaaagctaccagcctaatttcaacatcatcctggtcctgaatttgaaggatgagcatacacactgccttgaacagcaggcttctgctgctgttgctgccgagattgcagctgctgcctctgcccaccaataccatgcccatgtataggcacgccacctgacatttgcctttgcaacatgccttggctagacactgacaacagcatttcatttccaacaaaggtatcttgaggcgagctagctaactgcgaggttgatggaactgtagttggatcatgagatgactcttgtctccgctggtttatagatgaaacaccacctgggctacctgaatctgtactctttgcaatggatgtggagggaattgcctgattatgttgaacttggtcaacaggtgattctatcctaccatcagtgttcatatgacggttttgttgcatcaccaatctctggatgttgttatgtgatggattcatgtaccgttgttgctgctgctgtgccaatggagatgacgaatgaagtggagcttgttgagaagttaacatagtctggttaggagaaccctgcattgagctttgactacctacatctgatgtttgtattggtgaatgaggcatctgagacccatatatcttgggttgattaccaggttgaaccactgatggaaccaagcccttattaccagcaaaataccccgggccctgttgcaccatacttttatcagaaacttggtttttagaggttgtagaaataccgcttgcttgagtggcatcaactggtgaactctggtgcatcatattccctcggcctaagctcttcataagcttagcttgctggctaccttgatttctttgctgctggttttgtctagactgctgctgaccctgttgcttcttctgcttatgcgatgtattaacaggctggttgggaggcactgagctatctagtgaattttgtgccggatgctgctgtttatgttgtgactgcgaagatgggatagcactggaagctggcccttggctctgctgttgcatttgtgaaccattctgtacagtcgacactgcactggctccagaaagtgggtgctgttgttgggtcatcatgcattgttgcatgtgtctatctttagccaagcgcatagcataagcctgctgctgtgggcttgactgggttgttccttgaatatgggggtgatgtgtatttccaagcacgtgtgattgttgtggcatctgatgtggttgggatgactgaactggaaaaggttgaccaggtgaagatgctccgacattggaaaatggagtaccactgaaatgaatggactggttatttccctgcgatacttgcatctgaaactccctgcatcatctgcctatgttcttccatgttctggccaggctacatcaaagaatgcatagcatcagcaaccacataacagcaaaaaaggacagcttctagctttttactgattaaattaagctttggatatcgtaagtatgtccatgagctaaaaaatggatagatcgatgcatgcatcattaactatgggatgtaataacatcacaaaaaagcaacatgcgtgctctagctatgattctttcagatttgtaatatgatactttaaaactatcacctgctaaccatccagcgattgatatttctaaccagaaaactgagggagttggctacagtattttagctttcagtaggcctagccaatgaagaatgtgcgacactaatgattaaccaggtttgtgcataggcccatcctaagtgggacctgagtattaagtgaattttgggcctagagtttgaaaataatacttgaataattatataaattcgcagcaggaaggactcaaatttccaggttccatccagtcttcccacaaagcatgtataagcaatggactgcatggcaaatgtttctgcttgttgtacgagcagtttggtcagatatgaaagtttaaaataacatatacatcagatctgaatagaatctaccgcttaaagagagaagttggtaatggatgcggtgcatactctatggtgatattttatgataaatcaatgtaggcaagtgtgtcgtattgatgtattgtaggacttcctaaaataaataaataattgcgtccactacacatgcatacgtgtagatatagcctgttgatatgattgtttaattggaaaattaagataaatacttttgcattttataagatcagagtatgtgatacttactaatctgaaaaccattgcagcagcacacatgcactgctagttaatagaataacattagaatattaaattgccagttagatagaggaaccccgcaaattgaccagtatcaccgattttcacagcagctaagtttgcttgcccacaacacatacaagccagtagcttgaatgaagttcatatatgttcagtcaatcagtacatattataactacttaggactggttttgaaactatgttatcatccatatgattagaacagaaggtaggcggaatacacgatattctatgcctctagcacacacaccagccaatggagagcacaagacatgatgaaagatatatatcataacacagaatggaaggaaatgtttacccgaagcatctgcattggatcgcgtggcctcaacatagtatttccatggccaggtatggtaccaggatgaacattcaccgtgttttgcatgccttgcccattgttgggaagcatgtttccaggtgaaaccatatttagcattcctgaggaaccaagccttggaaagggcggcctggtcactggagtaccacgatttagtccagtcatcacccccataccatgagcaccaggcatcatccgaacaccacgatcaactccagcaggcgcaccaggaacaggcaccccaggttgctgaagacttctgctgttgagcatctgattgtactggattctttgttgctcatcaccctgcagagaggtaggtctaggcattccgtacctctgagaatccctgcaacaaaaattttacagaaacgaacattaaaatgtaaaattaattttataagctagagaaggaaaataggatcatttacctaggagtatttggtgttgaaggtgatggcaaagtattgcctaaaaccataccaggagaccctggtagcctagtattcatattaccagtaggaagggtggggccaatggaactgggatggtttggaagcattaaaccacttgcatgagatcccgagtaaccaatagaaagtgcatccgggtttggagtcattgcatcacaaagatcaagcggcctattggtagttttaaatacgagcattagataaagtataaagaagactggcagggactgtggatacaggaaaagaacatataaattgaacacagcaatgctcatacatcaaaatgactccaggtgcacatgcttgagaaagtgcatgaagatgagaagaatggagtgggtttatctgcttgagctcttggctctcaccctgcatgaccaaaaaagtgaaaggggacatagggaaaatgatcagactaacgtgggtaaacatgtaaattcagaaaatacacatggtttaaattgcatatacagcaacaaatataacactatttaacataaaataatttggcctaacaaaacttaagcgagagataccacaaatatcataagattttatatccattttaaatgagagataccaaacataaggaaagaccactccacaattcatcatgacaacccaagatgaaatcagcattttcaatcattttcttatacatgtcaaactgtagcagatgattgtcgttactgccagtaatgagataccatatgatgaagcaagagcgtataaaacaacatgacagatcaacacattaacattgaacaaagaagaataaccattatgtactacacgccgtaggaaaatttacaattctaatatactaatacaaagtcaagcctgtaaaaggcttttccaaaaaaaaactaacctttctacgattcggatgcaacttttgaccaaggaatattattttctcgaagtgtgccttaagagtctcttcctcgaacggtccttgaaggcgctggaacaggtgtctagcactaccctgatatatttacatggaacagatcacaatgttaactgttaaaaagatgacatcctttgagcatctatatgaacactattggacaagaaaaactagcctcacactctgcaggtcaaaacaaaaactggatactaaatcaacttcagaatttgaaacttctaattctaaatcccatttacatgctaagagggataacacaagaaaacataaatgggagagcaaacctttgggatgccaggcaatgtggactgatagtgttgtgatgagcccgagtcatctgcgctatccgcaccatcacctgaacctttttctgtgagaagtttatggcgatctttacactcgttaggccttctatatatacactgcatatacgagatgccagaatccacaattaaataaaacaaataaaacatcaatgtactaaaacatcacattatgatgatcatatttgatatcacataagatccaatgtacaagcgaggaaataaacaaacaccaattaaaaaagaggattgacaaaaaagaatacaaaatgctaaagaagtggagaaaataacatggttttcaataaaatgatttctacaaggcagacttgccggtactgggaaaaacaaaggattgacatggcaaaaaaaaaagaaaactttgaagtcctaaataataatatattaccttcaattgaacaatgctgttcagtgcgtcactaaccagttcccagttttgacccatatcatgtacaagcacaacaagagcctaatataataaaaatgttaggttatttctgcacgatatagcaagatagaaatgatcaattattttaacagccaataacctgatcctcaaagctcgaccatggacttccagggcctgagtgactagcagccatctggcaaaaggatcaaaagttttagaaaacaggtatactagtgaatgtgcaacaaccaagaataagaatggagtacataagatgttaagaaagcaaaaaaggtatgaaagacaaaaaaagagaataatatgacgagttttttttccctttattcctctgtctcaaaattcaactacctatatattttggtcaagcggacagaggaagtagtaaacttccaattttcccccatgctgccttcgataaaaccatcacagagccacttttaggcaatgatttcagataattctttttgcacaaaatgtccaaaaactacacccttttgaagcattggacccccccccctctacctcggcgccggactcattggcgaggtccactgccacggcaccactgtgtccccctcgctcagagcagcggcggccgctcgcaccgccgctgcaatggcaagaacatgcagcaggagttcatacaacggcaagttggagatagaggagcgatggatgg

SEQ ID NO: 564 - DNA, 1899 bp, Oryza sativa
ctccatccatagttccatctcccgcttgccacccacatgaattccctcagcatcgcctgccactccggaggtgcatgcagtcaccatcactctgaggggaacggggttgacacgagtgccagagccagtagcaccaaccctcggcgctgatgacgccggcatcatggcagtggacctcagcaccaaggtagggggcccaaatctggaataagtttttggagggtttattcataaaataagtttttagaaaggcctaaaatgtgtaactggaccaattaccggctagaaaccatcgataaccaattgctaagtggcccaaagaaatgggacattcttgcaattgcatacataaaaatgaacatcatatgtgaatccatgagaaataaacgttatgacaacagcacaagcacaactattaggagtggcacggaaattaaatacacatgttgacatgaagatttatagttataacgagtaaatggccttcatggtgcacgaacttgcgtgttgggtacaagtaggtatcacaacttgcaattgtttgcttcaattcaacaacttgcctagtccgtgcaaacccgggccaaatcagtccacgtaacggaaaatgatatgatgcggaaagtacacacatatcccaaccccagttggccgataggtgaatattgtgtaattaataatgggagaacattatgttgttgtttataggatgttaatttgcagggagcagagatgcagcagctttgtgcaaaaatgaagtagaaggatcagattactgtgatggtctctttatattgtgttggtttcaatctttggagctattttatggtggaattaacatcaagcgatagctttagtaccggttcaatgtccaaactcagtagcatcgaagggaatttttttgttcctgattgctctagtttggtttgctatagtacagaacacaagcacatagttcaatgtctaaactaagtagctacagcacaacttactatataagcaactgatgcgtgtactacagggctacatgtcatcaatgagtgccacctcagatgatttccacctgcatggactgttttggccctggttcgaacagactaaggcaagttgttgcaccagaacgaatgatttgcaagctgttgcaactatttgcacttactacacaagtttatgcacagtgagcgtaatttactctataacaactgaacatgatatttgagtacatcacatattaattcattagagtccatagtacaaataaatcacatacaaccagacatgggtagagactctcatataacacaaataataggagtaggaacattttgcacatatgatggcatgaggatgatgcggaaattgtgacaaattcataaaatttaaattcaaaaatcattttggccagtttattccagtaccagtcactggcttcagaccggttaccaccggtgcttggaaccttgttaatataaaatggtaggattgtgatatcgacgagcaagcccaaccaattggataaagttatgcaaaatgaactgcagttctctaaaactgctgctttaaggctgtgtagctttactggtagtatatgattgtgaggtttactcatttgttttggtgatttataagtactgtttgtattagcaattatacgtttctataaaaccagcataatttagtgttaacaacagagaaattcgaagtaaaatacagattatgaaaagtaatgcgtctgagagacttaacatagtaaatttgtgtgtttgtaaacagatacaaagaaaacattcagccatgccaagaggtatataccttgagcactttattttttctcccacgatcccggtttgtaatgatctttataatcttagtaggatttgccatattactcatttgtga

SEQ ID NO: 565 - DNA, 721 bp, Oryza sativa
tgtgttgacaaatatacgcttgactggtatggcattgacaacctcataagaaccaccagaaacatgaatgatgaattgagtgcaaagtaagcaattactgctattacagtttaatgtttccaacacataaaaaagaaacatacacaacaaaattaattacatgatatttttcctactttgtaagaatataaagtgtaatttcacacacagcaagagcaacaaataatgcactactggaagagctaccttcttggcatacagtgagagcaacaaattatgcactccaggatcctcattgttcaaatcttttacacagaattccaagtacttgataacttcatgtgtttcattcctgcaagagttgaattcatcacatcatcctgattatggaaatcaagttggctacatagaattgcagtttgttccagagcttctgaacatagggagtttaggcattcttaggtttgattcgaattatcactatctgatatgggatttaagtgtaacagatctaaattcacttccaccagtagcaaaattcgtttcaatagtaacaatgtttttatatatagcattcagagttccctggtgtgataaaagacggtaaggctgtcaactgttaagatatcacataatattaaaggattcatatagtattatagcaatagggggataggaacgtataagaagccattagcatatcatacttggcatgtggttc

SEQ ID NO: 566 - DNA, 652 bp, Oryza sativa
tactatagaatgccttttttcgagacggagggggtatattttaagatgaagaaaatatatgagaagcattgaaaaaatatgcaaaataagataaactattagtgcctaattaattaaatattaattattataaattttaaaaagaattaatttaactttttatattttttaaaatacatcagtcagcagtttgagatgcgtactagcgaaaaacgacgttctttttcttctcttcaactctcaaacgcagcccccaccaccgctgacgccatcacgtcgtcagtgataacggcgacggcggaagcgaacaaggcgacaccctttctgtgccccgttttgtcgtctttggaagcgacgccgccgtagagagagaaactagagagagagtgtagtgtgtgagttggtccaggccagcacgcaacaaagcaatcaaatactactacgcgatatgagagagagggatgcgtcgtcgccattagcggggagaggagcgggagaaaactcctccggattattccgagctccatatccattgaaccgaaccaactcttaatgagaaaaagaaagagagatccgagctggtggttcttctcggttctttgattgggggcggcgttgaattggattgaattgatccatcgattgtttcttg

SEQ ID NO: 567 - DNA, 1281 bp, Oryza sativa
ccacccccaccaccaacccccttctccttcccctccgccgccaccgacatgatctctctctagctagtttagcttgtctcgagctttctctctctacctcgacttgtactagtatgtttgattgttggtctgtttgtttctctctctagggtgggggtggtgtggttttgagcctggaagggaggatcgtctgcggatgcgctggggacgggcactactggcggtggaggctccaggtggacattccctcccttccccctgctttcttttatttttctctctctgtctttcccttccctttcctatatgctttgcttgctgttgttcctcggtcaatttttggccccttgttcacgccgtgtttagattccaaatatttctttaaacttctaacttttctatcatatcaaaacttttctatacacgtaaacttccaatttttttcgtcatatcattctaatttcaaacaaactttcaatgttgatctgaactaaacacagtcagtttcactgcaaaatctaacttgctttcccataagcagtagaggatctattaaaggtttataagtgattgtttggtttatggtcatgcttctcttatgtggatttgaacaaaaatattaaaattttgtataggatgtttttcctattggataatttgaaacgaagaattgaaaactaattgaattctatgaaatttctgaggaatgtctcgattcatataaattttttaggatttttaatacgaggtccaatctcataaaaagtagttttatgagttcatctgtcctatacaattcctacatctttttttcgatccaattaagcgatcatttctttattttttgtgtttcataatcatatgttttgcacgttgattcttgcataatcctttttttattgctccgttttatcaatcatgtgtttcaaaggaactctttttatatttggttgtgtggtttatcatactttttcaataacatgtcccatatattattgatttaattttttactaacttttgctgctagcaatttattcatcatacttttatatactacaacttgcgtaaccttagttgtatttaactgtggctgacaactaaacaactcataaactccaaacaaaagttgattatggatagtaggagtatttgttataagttacagtatttcagctgttctaatcagatagaatttcaaggggatcgccaacggttgcagcgtagggcatttaaccttgggtctgaaaattacagttaacctaattcttgtattatgttca

SEQ ID NO: 568 - DNA, 10869 bp, Oryza sativa
cagatagaatttaaggggatcgccaacggttgcagcgtagggcatttaaccttgggtctgaaaattacagttaacctaattcttgtattatgttcatgagctctcctatcgagtaggtagtattgtactccctcagttccacatttatataatgcagtttgactcttgatccccttctccaaattcactaatatttatataaatttggacacatatatattcatacataaatgtattaaaacctaaaacatttagtgtgaaatagagcaaattaacataatgtaatctatgttactcaattatcttttatatttaagtgatcttatacttttggaataaacaaagagttatccatatgttgaacggaatatcagttgacccactattgtttgcagttgcctcctaatattagtatgaggcgtagacagtcaacatgtacctttgcaggttttattttatgatgtacaaaacaataccttaatttctttttcaaaagataaaaccaaggaaaaaaacaggacattggaaaatctaatgaattgtcggtgcgaaatggcactccttgatatttttctcatgaaaatcaaatatttttttaaaaaaaggttagctaaaattatgaaataaaatactccagggtagtacgaacagaacacgttcctgttttcacaataaataaataaaaaaaaacaactcttttaagtgttgtgtgcatctagtttactgatgagtactaatttcattgatatattttatgacgaatgtattactctttcatttcaatataagcataataagtatatatgtgatatatcttacgactatgaattcgaaccgttatgactaaaataatagttctaagatattttattacgtgttaagttgtagtactacgtatttatatttattggaatgaaaggagtaggctgctagcagtcgtagatggtgggaagaaagaaattaaaaaaagaagaaaaaaggaaaaggaagaagactggtggaagccgtggacatgaggctagcaagaggggagagaggcggcgagcgaggaaggccacaaccacaaggtgcggcggacgctgaggtggtgggggtggcccacgtgacgaccacctcgtattcctcgttccccacgcccccctcccctttctccagatatttttcgactctctcatctcccatatctctccgcctacaagctgcctaccaccactacatcaccctggcctgccttgattaatctgctttctctctcgctaaccaagttgctaattcttttattaggcctgctacaagtactaatcgtgatttaatctcgtttagttagctgcccacgatagtggctgcgtagtggagcattctcctgcatctacatccttttcgtattgaggaaattaaaggaggcacaaattaaactctcggtacgaaaccttccaaacatctagtgcaagctcgctctaaactcttgttctgttatgccggtgttctaacttatgtaaattggccacgtctgagtgcctcaccctctccctctcaattccaaagatgtgtttagagtgaagtttggtgtcagctgtaagggttgagttttgggcgatctcaattgtagttcctttgttgacctagttgcaaccggtcacgtttagtgatgactggtctagtgctagccttctcttgggtcagtgtgttggcgttgttggtgcgtgggtggtggttatttttttctttattttcctagctatgacctcacaagatcgtaatattgtaatttttttctgctataacaatatgaacttagcatctagtgcaagtcgttaaaaaaaaactcccggtactcaccactagctccgtccatgttcatagctattagtaaaaaaattttaggatggaggatgtcctctggtttattgcgttcacttcgaagttcttcttttctccgtcctaaattccttctcattttctctattttttctgcagagtcacatccagggcacataatttttcattctaatttcggctaaaaggttggtcctcacgaccactaacccctggaattaatttctataaatatcgaacgaaattcactgactgcaaacatgactgcaaaaaaccttggttacatcgtgagtatctactttccttttttttttgagagagagagtggggatcgcgagcatctctacttggcatggctaaatttgaatttttcaaatttgatttaggattatttccatgagttatttcatcaaaccgtttttcttcttttcataccctgatatcagactgtaaatttcaaaattagctcaaatgaatgctcgatatagctttcgcttttaagcacaagcttatttgaatttttaaaattaattcaattttctagggtgtacgattacaatttgttttcaaatacgggtgactcataaaaataaaattatgatgaaactgtgaatggtgggatggaagtattaaaaatagaataccatatccagtttcaacaacaaatttagagaaattcatgcgataaaactaaccctgcaacagcataattatatatgtggcctcatttttatgttttgagactgctttcaattccttaatttggaccaattttggccttactactgacccattatacacttgcgacattgttacgcggttggatcttagtttacctgattcgatgactgatccatcagattccgtgtcaaatctgtttagtagtactattatttataccctactctctctgtttaaaaaaaaaaaaaggcaaacattagtttttcgtgttcaactttgattgtccgtcttatataaatttttttataattcgtatttttattattgttagatgataaaacatgattaatattttatgcgtaacttgtctttttatttttttcataatttttttaaataagacggacacgttggacacggaaaccatggtttgtctttttttaccgagggagtactaagggcatgtacaacccacagataggggttcgtctccaagaacctcgaagttatcatccagacagatataaagacagctcatacagcccatagacagaggatctgtctgtaagctgtttaatgcttttgcatgtagctttgatcaattgcaaatacgtttgtgtataccattgtgtggctatatatttgaaataatactatcaagcatgaataagatacatgattacaataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacagaaactgaaactgaagcatgcacattcacattccaacagaaactgaagtgcacattcgcatttacaaatcacattcacattaattcagaaactgaaactgaatgagacctctcggcactccaactgacctcacaggatgtatatgtatagagacatacactgaacctgctgaaagattaaacataactgcatatgtatatagagagagtacaaaaagaaaaggaatgcaataaaaggctaatatgcccatctttttccctagattatatatactccatattagtagtatagtgtatcactgaacaagcaccaaaataggcttagtggattgagcatgaacaaaaattatataaactgagacatacactgaacctgctgaaagattaaacataacttgccaatagccagagtttaggatagaaaaagtggaaaagttggtttaggatagaaaaaacagcaagataatttggcattcaccagatagccaaagatagtagcctccacttgcaaaattgacatatctgtatcaataacagtaaggttcatattagacactgaagggactgcctaagacacttgtaatcacacatatttgtggcaataacatgtaagtttcagatattgcataattgtttacctgttcaatcagattcagggaaaagagttttcataagacacttcatcatactaactcgctgcgccttttcctcagcagacattgaacttgtatcttgtgagatgaggctgttataagtctccatcatctttgactctttctcaagcttccttccttctttgtactcttgtgctgtaaggtgggcaatttttgtggcctctagcttctcagaagatattttttcctgtctgtccaatagtttcatgcgcttgtcattgttttcctcctggaatttgctatatctatcaaatttgtctaactgaataggagactcctttgagtgaccatcatcactactgcccaaaccatttgacttgatttttgcatctagagctgcctttttagcggccttctgacccattggtcgctttggcatctcatcaaaagtgtcatcagcttcctcagagtctccttccaagtgaaatgatttccttttacgtgcattcctcatgttttcattgtatgttttccactttgagacttctcggcatattttccaaacctccattagcacaaagggtcctagctttgcctctttattgtcatccacataaaatttgtgtgctgcatcaatccacatttgattagaatatccacttgtaaaaattctacgagcctttacataagcacactcaaagagatccgtccacctattaatcttgtgccatctatccttgcattgcttcagatttctttttctgagaggtggggtagtcttgttgtacgattcaacaacttcaccccaatattggccacctcccttatctgctccacatgtagagtcagttgaatgctctatccaagcactcatcaatctgatatcctcttcctctgtccacagtatcctcttctcagtcctaacattgccattgccatttccatcatcattgccttgtaaaatttccacctctggtggtgaactagcatcagcaatgtaaataggcgcaccaaccaaatgagagttttgtgcatgatttccaaaatagctcatgaaaccaccacgtggatgtacatctttatcactgcaggataatagcatatatttgaggcaaataaattggataatatcttagatcacagggataatctctgcatttgagtttggctcgcttttgcgaattatctcatggcagctagttcatttcagttacagggttctagctaactactgtgaccatataacaaaggaagggattactgacattactaatcaggtagtataaacaaagtaacatctagagatagcttcatccaatccacaagaaattcataatataaacaaccatcagatttttatttctctcaaaagttgaatataacctcaataacattaggataacatgctacatgatgcaaaaaattccagagtcaagtaattaaattgtagaatgccttttccaatcagtactaaattagcagttataaacatttaagtaaactgtgaatggttaagttgcagaatgcagagaagctcatcacatggcaggggatgtacaataaagcctgatttttatgactttgtaacactaaaattagttctaacacagaacatagtaggcattcagatgggaaaaaacaagcatattctatgttctcttgtgatgtaaggggcaatttttaacccacaagaatcattagcagttcatgaatcaaacatccacaaggaaacaaatcacacaagcatattctgctagaacagagaacaagaataaaagattaccatgatccaggagaagattcatcaccaccggacgcatccaaccaagctgaagagctggggaatccacctctgtaggatccatcaaaaggtggagggaagggaaatccatccatggacgctgaataactggggaagccgcctggagggattgctgccactgctggcccgccaccacggccgagagagcggggcggcggtgctaacccgacaccgcggccgccacgactgaaggggagagccgccgtcgccgacccaacaccacaacctagggtacgggctggggctgccgccgccgcatctgaggcctcaggtgtgcctcccttcttcttcctacctgcagccgccgtggacatctcagcagcacccaaatcaagcgaggggagttggagattgggagagattgctgcgctatatgctggagcaaatttcctggatttcgcgggcaaatttcccggattgggggagtgggaggggagttggacgaacctggattttgcggggaaatttcccgcgctcgcgctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccaggggtttttttgcataaaaggcatcacaaagacggggcaaaaagacccgctgtacgtgccctaatcttctcgtagggagtactaatcttctcctacgatttgatccaccctgatctggattttctgcaagctgtgtggagtacagcacttgggctaggaatctattttattccgatccgtacatccgcattctcctagcaaataaaaatttcgggcattccttttttattttagtactgcatatttcatatttcaatgtatgacgccgttgactttttaaccaacgtttaaccgctcgtcttatttaaaaaatttatgcaaatataaaaatacttatgtcacgcttaaagaatatttgatgataaatcaagtcacaataaaataaattataattacataaatttttgaataagacgaaaggtcaaacgtttttcaaaaactcaacggcgtcataggagtagtatatctgattgcactactttatttttattatatggcggacaaacccgtacacactgctacatatgaaacaccaaacccagtctctcacacactatcaatacgtctcccaacacactgaaaaagacaaaaaaccaacggtatatacctaatcttatttaaattatatcgattggactgcattaataatatagtgttgtatattgtacggagtagtgcgttaataaattctatcgattgtaccaagtattcaggtgttaaatttcacatgtttgtaaaacaaagataaactttgatatttataccttctctatacaaagataaagttgggtgacaaaatatatagcaacccctcccccaccggccaccccaccaaaaaaaactctcaaaataaagttctaaatttaaaacataacacttaggctgtgttcgggagtgagggttgggaacctcactccctagcacataaaacaaagcagcgtttatctcataattaatcaagtattagctaaaataaatttgaaaaatgaattaatatgatttttttaaaaagtaactttcatatagaatttttttaaaaaaacacaccgtttagcattttgaaaagcatgcgcgtggaaaacaagggaggtgagttggaaaaacggagataagaactcagcctagaggcagtccaaaggggagtggattctaatccctcgaggggatatctattggtcgcgtaggctacgatagcataaatcaaaaatttctatcgcgtaaaccaggaaccatgcaagtattagatcatagatcgttaccactcgacgcgctgcgcagcggaagaagacgctgaaaagtcgaaggaactctcgcgaagtagcacgcgtcgatgtaaaggaagtagtcgatcgcaccggctcgaccttcttctccttgtgcgtactcctcgccgtacttccacgccgatcagcaccgcaaaccaacggcgcctctaccggtatccacacgtacagggacggaacgccacgcacaaatgtgctagcactcgcgcgcggctagggttttgctcggggagggaattgacggctagggtttctcacgtgatgcaatacctccgccggtcacacccctcacgaatatataggatccatcactcgggcctccaaggcccgtaggactcctattcggatctctatctgaattaagctcatattggatctctatccaatccccttattccggcccattaagcgtgcgaccctataagttcatatatactcggctgtaacccgaaaactccttttcggtccacgcgtcaacagcggcccctagtagaacgtattgacccaccgggcatacataaagatcatatcggctgaacctctagtgtatacttgtatgaacccctttgcctcacgatatcgattaagctcaaggctagatttgtgccatcctcttatagctcaatcattcactcgaatctgttgatagattatataacttgcgattgactcctcaatcacctttggcatggccatgcacttctataatctacaacatcgaggggcccagagatatctctccataggaggggcaaatcccatcttgattattcatatcccactacatgtttcatagcatacccgaaaactacttttataactacccaattacggagcagcgtttagcagtccctaagtaagctactacacatgttgggaaccatgataatctcaggtctaaggattcaacactaacactaaatgagatcattgatgacacaacacacatggctcttgcagtgtcttatgttgggtctatccaacaatatgttcaccaacatgtgtccacattattaatttggtatctctataccatgatccatgagatatgatcatcaattaatacatgtgctgatcatataaacatatttattccacacatgatatttgatcagggatcctttagaaatagcgacacataacataaagagtctcatgaaataatcacatatttattaaccaataatgagtttatctatttcaaggaacaaagtcggataaatatgtaaacatagtatgtgatacaatcatctttatgattgcctctagggcatatcactaacagtatcccctcgtatacctttttcttccaaattcgatgctaataattatgaaaaattctaaaaaaaattgacaatgtagagtataatgatacctactagtccaccaaaattcatgttcaaattcgatctatacatcgagaaaaaaaaagacaaatttagatataaacaatacgctactattcatacgctgaatttgtcttttttatatctcgacgtgtgagttgagtttggacttaagattttgtgaaattgtatatatgtgttgtatgaatgttgttaaatttttccagaatttttcataaccgtttagatggtttttgagcaaacgagggaacatcctcttgagggattagaatagtttcccgagtccaaagagatgatagtacggcagcatgactggggtggcactgttgaggcaattgcatagagacaagaagaccaaaatgtgaatggtctgctagtgagggcgaaaagttctaacgacgctagaagatcacgatgtatagatcccgaaaagaggatatgagaagtgaaagaagatgaggacgaacaaatggccaaaggaggcacatcattttgccatgcatagttttataaatttcagccacaggattatattactcttgtacaatggatggatgatgtttatgaaccttaaagcgataacactatcaaattttgatctacacatggtttttgaagggagctagcttgaagccactcatttgttccaactaaagctaataactattctttccccggcttctctgaaaagccgactcatggtcaaattacttatctttgaacatgtcattctcaaagccatggaccatttgaccttatcaggaatatcagatagctggttcacatcagtctcaagtgaagtttcccttaccatccatggagaatatcttcacccctttccccttcaccctcttagggtgtgttccttgtcaaatattttcagtggcatgtaatacggaaaaagctattaaagaattgttaattgagtattaaatattaaaaatttaaaaaacatttatttgatttaaaaagacttatattttttttgaaaaagtaatatttagcagtttgggaaacacgcttacagtaaatggaaaaaatagtttagctgagttgtagaattgaactcagcattagtccattgtgtcgattttcaagcggacaatccaaactgttgaaaacaacacatgcatcatttgaactacaaagctaaattattcttgaatcctttttttagagctagctttggcatgataagaaaaaaggaagcaacttttgagcactgcacaactaatcacatatacacatgtatgtactctcatcaagagtgaggaggaaaagtgaaaggaggcaagacaacatcaatacattcatcctaacatactacacccatgccagccactagtctcaagttctcaaccacttgatccactttgcttgattttgaacaaatatgtgtgtctcccatgattatcaaacaacccttttatagcattttaatttcgatacaaacccaacactcaaacacattacttacataacatgagtattaattactccaaaaaacatattagagagaaattcatccatatctctgagtttttacttagatcgccttctataaattgagagttctgctctatctaattttcattttcacacattggtcttgtttggatccttcgggttattaaatagccctccggaatcttgctatttatgagtattaaacg

SEQ ID NO: 569 - DNA, 1475 bp, Oryza sativa
aagggagcaccatgatttggtctgctcgagagctcccctttcccaccgttggttggtttcgccggtggccacacgttggcgccgcgggaaggagctcctcctgaccgtgcgatcaagatcggacggctgggatggcgtccggtgcaactagtggccaagaaggcgaggcgggggacgggtgtctgtggatggagcggatcgcgtggggcccacggcccacgtgacggagcccacccgcgcccgcatgttccccgaggtgctcgggcccaccgcttcggccgcgtggggtcactgcctggtgggccccacctccgttggttgtttctttctcccgccgtttctcacctgttcccccgccaaataatactactaatccagccgaacgaccccaccgacttggttaactgactggatcatgtctttggttaaagcttaatgctgcttttttatctatttttggtttaagttttcttgcttgatctaaaggtttatcttttcttaatctatttttcggtggcttctttgttactccctccattttataatgtaagtcattcaagtattgtcacattcatataaatgttaatgaataaaaaattaacatctgaatgtagtaatgctaaaatgacttacattatgaaatggaggaagtaattaaataattaaatatagcttgcatcttaggtttgttgtaaatatctaactcgttacttaacatcaccttatgaatatatttatttcgttgttcgcatcaatatatagtatatataatagctcatacgctctctttctgtttctctgattttaactcttggcctcacaataatatactaagaactgaagttgaatcgtaaacgtgttccgcacacgtgccaatagagcacaaatgaatatgtacgtgtggacaattacggccatgaaattgattccgttttgtcctcctctcctcctctgaatcgatcgatcagcccatggagagaaataaaaaccgcatgtatggccagcaaccaaccctctagtagtaccagtagctagcaacattgacaggcaacggttgatgtagattgctcggctgcagtaagcagctagctaccaccactacccactcgatcgatcgacacgttccaattattatattaaacactatctaatctaattaaatcaacggccaatctacatctatatgtcaagatcagcacagtgacgcacagcagctatgaagatggttctattccatgcatgcatgcatatctatccaagatatggcttggagaagatttttcatccatagtaataagtttttatgatagtaattctcgattactgctgctttcggatgcacgcagtcaatccttaaaattatagtaactcgcaaatttacgaaaacaatggtaaaaatataatccgatcggtaaaaatgacattgatagatgatctatcgtaaaacatattttaaacatatgtttttttaataa

SEQ ID NO: 570 - DNA, 789 bp, Oryza sativa
  unsure (1)..(789): unsure at all n locations
nnnnnnnnnnnnnnnnnnnnnnnnnnnnnnnnnnnnnntttcctgcaaagtttagtgaagctctcatacatactttctcattttgtagagcaagatgatccattgaaactatcagggaaaaccagacagcttggtcttattgtaagtttctttgcagtattgatttcaatatccaggactgtattgatttcaatatccaggacttatctttgtcctatattatttatattgcttgccgattgtagttctgatagttcttttctctaatacacgagatgtgtgtatcatttcattaagagaaggaagctctgagagtttttatttccatgctatacgattattttgcactttgctgaaatctgcactagttttttttttttctggaaatgttgattcgatcagatttacaacaaaacagtgattaaacaaaaataatctcaaaatcaagagcttggtttcttgcaaactactagtttgtttctgccatttgatttctttttggctggtttcatcatcctgacacctcagctccaacgactgtttgttgcaggtctgtaggggtacaacggtgatgcttgtatcgccaaccgatggaacggacgagattgccaaccccttccaatctgatggtgcataaacctgcaggagctgatggttctcctagtcaagatccatgctctcccagtagagaggcctttgtattaactcatgtaatctggtgccacagtctctnnnnnnnnnnnnnnnnnnnnnnnnnnnnnnnnnnnnnnnnnnnnnnnnnnnnnnnnn

SEQ ID NO: 571 - DNA, 1350 bp, Oryza sativa
aatccttcaaataccgccccaaaataatctcttagatcccgttatacaactgtaacgtacgcacatatataaatggtctatctgatttttgataaaaatatgtcaaatggtaattatagtataaatttagtatatatatatatatataactagtgtaattacatctgtaatttaggaacttatattataaatactttaaaactatatatgtaatttagaaatttatatcataataaatacaactaatttagtgacttaagtaaacacatactacaaattttcaatgaaaaatatgacgacacagttattagcaaatctgtaataaaaatgcgaaaacgagacgggccgcatgggccatcaaccatcatctcgtccagccaaccggcccagtccagcaattccactcccccaccaccgccatcctcccccccgccgcctccacccgccggcgtccacctccatctcctcctccatcaccgccaccgccgccatccatacgggctctcccgctcggctcggctactccaccaccggcaacgctccccgtgccgcatccatccccccccctccaagcttccagtcgcaggagagaaggcggccgccggagtaggcacacgcaacaagcaggtaagctacctcgtgctcgatcgttcggcttgcccttttagccttgggattcgtctggatttgggatctagaccgaatcgtttctcggcttgtgcactacggtttttgcgagcaattttgaatttggtgcgcgaccgattccgcctctaacccttgttcacctcgtagcttccagtaggtttccctcaccggcggcggcggcggcggaggcggcgagaagccggccatggcgacgaagcagcaggacgcttcgacgtccggcgcggccatgtccatgaaggagtacctcaagaggtaccaatccgacgacgcgcagggcaaggccaagaagaagaagaagaagaagcccaagcccgcggccgccgtgggcggaggtgtgcttatcgtcgacgaggaccccacgtggcacaagcccgtccagatcgaggaggagcccgcgtcgtccggtacgcgatagccttcaaaccctagctttgatttccccccgtggtttggtcttgttcttcgatctggcgtgcagcgtgctggatttgattggaattgtgattggttggttgcaggggatgagagaccgttggtggacgaggacatcgaggtcaagcggatgcgccgcctggaggcgattcgcgcggggcggccgtacaatgctatcgctgaggacggaagcggttgggtcaccgtggccgcccccgaggactccgatggtggtttaacccgtcgccg

SEQ ID NO: 572 - DNA, 21311 bp, Oryza sativa
  unsure (1)..(21311): unsure at all n locations
atgagcgtccacatcgtttcatcgacgggggtctccattttcctctctccagtctccactgctgtagaatctgccctggaaaaaggccccaacaaccggaagcgaccaagctagccgcggtgccggtcgcccaactcgccgcgccatttccagcaatccagccacgatcccgacaggagcaggaagagcagcaaaaggaggtcaacgcaacgattaaaacccgcgcgagcgagcgcaacgaggcgaggcggcagaaagattcggcccgcccgccgtagcgaacgcgatgattggagagagcgaagctgaccttccctgtaaggctgggtttagatctaaattttgatccaaacttcagtacttttccatcacatcactctgtcatatacacaattttttagtcacatcatctctaatttcaaccaaaatataaaatttacgttgaactaaacacagcctaactatgctggcagctggctatgtgctccggacgacacgatgtgtctgcctcgcacgctagtcgctggccggtgcatctaacgtgagcgagtctaatccacaatcataatcattcttttcatgtattttctcaatcaaaacatttatccaactattttcaaatattttcgtaatactcatgtctctttaaaaaatctttacattattaggttgactaggaagtatttttttcccgtctgtgatcgattgattgggacaaaagttcattttagagtggccatttcttcagtctaaattccgtcgtcacgtcaaagcaaacaccaccggttgggtcgcctcgcccgactgtctccccgtccgctccgtcccgtcgctggcgcgcgctgcgtacatagcaaacaaatccgtctctcgtcttctcccccaacccaacccaatttctctcgaggcacgcacgattcccccactcgatttgggcgcggaatcctggagatgatgatggactgatggtgaattggtgatcgggttgcttgctgggggaaggaggagagaggatgggaggcgggcgggtgcggttcaacgtgggcgggcaggtgttcgagacgaccaccaccacgctcgccaacgccgggagggagtccatgctcggggcgctgctggactcgtcctggaaccttgcccccaccgcccgcggcggcggcggcggtggtggtggaagaagaggaggaggcgtggcggagtatttcatcgaccggaacccggcgtgcttcgcggtgctgctcgacctgctccgcacggggagcctgcacgtgccgccgcagctgccggagaagctgctctacagggaagcgctctactacgggcttctcgaccacgtccgcgccgcgcggtggggcgcgttcgacggcgaccgcctccgcctcgcggcgtcggtgccagggcgggcgcccggggacgggacggtcatccgcgccgcgcccgacggggggtgctgcgtcccgcacgggggcgccgtgcacgtctacaactggatgctcgacgagcgccgcccggtgtcgctcgaccactcgcaggtcaacgacgtggcgtacctcgacgaggccacgctcctgatcgccgcgcgcgagcgcctggggaagtgcgacagcgggatggccgcgttctccgacgtctccggggacctggggcaccgcttccgcgtggcgcacgaccgccaggccaagtccttcaccgccggcgcgctggcgttcgaccaggactcgagcatcttcgcctagctgcaagggcaggctcaacgagtacggcatcggcgtctgggaccgcgccaccggcgagcaggccgacttcttttacgagccgcctggctgcgccttgggcgacgccgacaagctccaatggctggacgccaccaacgcgctcatggtggcgaccctgttccccaagaccgacaactgtttcatcggcctgctcgatttccgggacaagaacgtggcctggtcgtggtccgacgccggcatggccgcgtcgctcgacgacaagcgcgtgctccacgccatcgccatggaggacgagcggtccgtctgcgtgatcaaccagtacgacgacctcgggttcctcgacctgaggagcaacgccggcggcgtgcggtggagctcccggagcaagttcatgaaccggaaggtgcccagcgaggagagctgctacccgaagctcgccacgcacggcgggcagctcttctcgtcgatgaacgacagcatctccgtcttcagtggcccagagtgcgtcctgacgtccacgctgcggaggagccacggcggcgccatctgcgacttctccatcggaggcgatcgccttttcgccctgcacaacgaggagaatgtgttcgacgtctgggagacgccgccgccgccgatcatctgaccgcccaccagtggactacagtctgcagtctactgaagtttgtcatgtgtcaccttctttgtttctttctttgtcattcttcttcaaacttgcaaattctcactcaacagaaggaaacaaaaaaagaaattatagtgatttagtgcagagaccaaaagattactcaagaactgtaaccttccaacttaataacttgactgtacctgaatttcttttctaacacagacaaaaagatgcatattcgactgcattccaggggcattgccttttgccatcttgtactgaattttcctgcctttctactgtttcatactagtattttacagggtacatagagacgcatcacgcgttgctggtgtctgcgtcaggtgttgttctgtcaaaatcattgtacgttgattctcaagtaagtatgtgaatgattaagcaccgacagatctttcgtactgcactcaatgaggaggttccatatcaccatttgtccatatccagctgagctcttctcaagatgcttctgatttcatactgaagtatgggaaaagactgcatttcagtgtcttgttttatccatctttcagaatattgcttgggttaatgaggaggttccatatcaccatttgtccatatccagctgagctcttctcaagatgcctctgttttcatacgtaagtatgggaaaggactgcatttcagtgtcttgttttatctatctttcagaatattgcttgggtttctacttagttttgtgatacttttggtcaaagtctccgtagttttgcgtcaaaaaataaaagtctccgtagtttttcaaaaacctactcttttccttatcttcttaaagagattgttatgttattccttcttgaaccaaaccaaattcagatgaattgctttctgagtactactactaataactgattggtgctctactgatactgctctgttcttcatgagaagtctagatgcatcgatcactggcagtggaaaccacattgccactggtgctgagtgctctcaatctctcatccaaatgggaggcaactttataacccatcagagctactagcaactgatgcaactcatgctgagagccaatgcaggggtaagtgggtgagcttttgcttttgtggagttggtgggtgcttatgtgcacatccacagtccaaacttcttatctatagctcaacttggaacggaaggcacacaggacaggtcggagatgcgcagcagaagcttattatcagactggcctactcgtggaatttttcatacttgacgtaaagcatacacgaaaaagatgtgctgcattagcatggtattatgagtgatggcacatcaaactatctgattatgatgcctatctaaaaaaatgatcacctcattatgatgtctggcacgtttgaaatcagggtattcagaatatgttagctgtctttgctgattggttgtttcattgcttaagagaggttcttgcgttgtcagaaagtcaggtttcctacgtaattttcaagcagagtcagtctctacagtaccagtagtatcagaaattcagaatcgaactaccgcacgaattactttgcttgaggtgaaactcaacctgaatttatgccagtaccaaaatgaatcctttcgagttacaaaattccggaattcggaggcaagtacacctcatcactctctcgtagtacacaccaaacattttgtgcattgaagaactgcatgcaggcagggtagaatttggagcgacgagtgtgtgtacaataccgtgtttagttctaaagtttttcttcaaacttccaacttttccattatatcaaaactttcctacacatacaaacttttaatttttccgtcacaccgtttcaatttcaaccaaactttcaattttggtgtgaagtaaacacagcccaagtactcttcctgctgcgtcttcgtcgagcaggccggcattcatgtgtctgcaccgcacatgcgattctatcatccagtggacaacagatcataaagcctcccctaccccagcctgctgctccgtttctgcctgtcctcagtcccctctcctctcgccggggccacagtccccaacgcccggaaggtttttgttttctttcaccaatggcgaattggcgatcatggcgtacgttctctctctgcttcgtcatcctgcttatcttgcgttctggacttctggttatggttaggcccagttagatgtttggtgaagcccagatagttcacttagccaagtgccatgaaccaggctccggccatggcccatttgatatatagtataatgtactagtaagatgcactattgcttttgtgttcttccacgcgcgattttcttgtccgaaacaaagtacaattacagatgcttatatatgtgcgtgcatactctattatagtggcatgccttcaagatactagactagaactttatgaactgctcggacagggttgcttgttgataaatagcattcgcacctttttaaaaagagcatataatttaagattaacgaagtcagcgcatgcagcttattatcgatgggtgcattatctatcattaaaatagtttgttgtaaatgctagcttcatcttggacctcttggtgacacaaggaaaaaatagtttcaacataacgttcagaagaaatacaagacgttttttcactgtccagttctatgctttgaacaacgattaatccaataatatttaattttgcaaaaaaaaaattactgtaagtgaaatagtgtaacagaaatttatggccaaagctctcttggacagtaataatataccttatatagttattttttcatgaatggagttggattggactcagttcaaattgattagagctatatgtgcttgttgcttaattggatgtgtgtggactgtgatgccacagcagtagaaattgtctgtaatattattggtgtggtatcagccactgaacatatggtttcacatgtgcgccagagagatatgtatctatgtcatgtatgggcagcacctaactgcagctaggattaataaatatgatcggttttcgtgaaaaacattcagtttgtgaaaccgttggtggtcggtttgtaatttgtaaaatccatttctttttctttttgctagttttcatagtcatttggtttttgcaaaccattttcactttcagaacggtacagtaaatcctgactgcagcacaaacagtaatcattcgtgttttgtaatgatgccatggccgctacatgcatgcatgcatgtcgatccggtgctttaatgaaaaatccagtataatcatttctgcccggcctgacctgaaaacttcctaatataggcaggctcgtggtttccaatccgggagtctttcgtacaccatgcagtaaatacgtccgtacgtcgtcgtctactccacatcccttcatctgtccggcctgcatgcatgcctcgctgcgccgcagaggtcacctctggatcgagcaccctcctcctctggagcaaaccacgttcggtcatgtgggcattaattcccacacaatacacagtggaatcgtggaaacgcgcacatgatccgtgagactgtgatcgatccacgcatcatacactccagccggcgcggccgctcgatcgcccgctcctgccgtgcaacggtgcagggctgcagcctgcaggccacgcgctagctggcttacaccggccagcgcgagcgcgctgcaggctgcaggacgccgtgcgcgaccgcgagcgcgagcgggcgcgcgcgtccggggttaggaggacaccggggttctcgctctcggcaccgcaccgatggatggaggagtacgcgcgcgtcgtcgtggcctcctgggctcctggctggttaccgcggcggccgcgccgcggtgagcggggagggagtacgtacgtacgtacgtgcagcggtgcagcaggggggtgcgtgtgtgcatgcgcgcccacgcgcactctgtgtcatgtggcctgcaggacgccaggtcgtaccagactgcaccaatcacgcacggaattaaagctagccacggacacgtacgtacggcccccacaagctgatcaaaggaatcggtgaaaagagagaagacaagatgccgatcgatcgaccgggatacgcctgtcgatcgatcctgctcgctcccaggcgtgtgtggacgtgttgcaccttgcacgtactgttacgtttcttgggtcggtttcatctccagctccctaccgggcaattagatgcccagcctctttggaacgaaggaaactaaattaaacgggattaattgcttgattttttgttgcacattaattttcaatttgatggtctctagctctcgatcgatcttgggctgtgtgtctgtctcacgtttcttttgttaccgttctggctaaaattaaccaatgttgcccacctcggttgttaacaatcgacaaattaaagctcacggaaaggccatggactaagtgctgctccatcggtttgaaaaaggcacaacacactacgaccctggaccatcattaggcatgcgtaatgcgttagcatgcacaccacaccctggactagagcatcatccggcgatcgagaataacactggtcctatacaaaaattaagctttgattagtgttctcaacactaactaatctttagttagctagtactcctacaatactaggctaagctagcaccacgcacgcttgacgccgtacatgttgcgcatgcacatatatatttacatgcacatatgcgcatgcatgcactgtactgtgctgtgtacaatgtattcgttcgaattaaagggaccacgaaaacgctttgttcagtttaattgcttagttgtaccggcacatatattgtttttgagcctgctttgatcaaagggtaaatggagaataaaactgatcaaggaccacaccgaggtagctagcgtgccaaatttgttaatgcgtgagcgcagcgctggctctggcaagtagcaagtcaagtggcagctggccaggatgcgtcctttttaaccgcgtccctttcagcaattttaatagtatagctaactactcactctaaatcatctatagtcaatagttaattcatataatagttacctataacatatagtacacaatttaatacctggtcccacttgtcatacacatatgtattttgaagtccatgctgtagctagctataaatcagtagcccgctactattctctctcattttttatcttctcaaaatatgtttatagtatgctattatacctgctctcattgatcattgatccagctagctctaaatctacagggctcttacttttggagacgaaaaagagagttaacttttgcatgctttcaagattaccagcaggccatgcatgcacgcacaccaccacaagtgtatgcccatattcaggatcctgacgcaaaaggtcctcttcgaggaatttgatatttcgagaagctggtagtgagtaacaaagctaggaaaattttgaaaaaaaaacttaaattgtttagttgggttctagttataggagaagtggagctgaagctataacaatcaagccagtagtaccccacccatcctaaatcataaagagttttaggattgaagtaatcaggtaggtgaaattgaacgagagaagattgtgattggttgaaaagaaaaggtaggtggagaatttgaatagtggaagtgggtgaatgatagataaaagaatatgggtgaaaatttatcatatttgatatacactttatattgttgtattttgcaacgaatggaataattaactttttatggcttctatattccatcctcacttaccgtctcaattcttgtggctcaactttctttaagtactacttacagtactcgtagaacataagagaaggggtagtatacgtaacatattatccgcgtatgaattttgatgaggtaaagatgccaaaagaattaacataccgctgggtgggccatcttagagctctaggccggtcatgcgaccgcctagggcccaagcctatatggggcccatcacgaaccaacccagctagtaggatgttgttgcctatcctcacgtctgactcccatgtggtcacaccttatttcatcgtggttagtgtttagagtgagttttgtgatcttctcatttgcttaattatatttagtctgaaaattgggctaggattttgttttgttctcgttgattaatttacatcgtaagttaggtgtttataatgtttatttacatcattttcgacactatatgatttataacacgtatatattacaagtaaaaatatatttggtcttgagggcctattacaaggtctctattagggcctatagagagccggctctggttgacacgtacgacttgacatgagccaaacctacttgtgtacgggacgtcgaagccagagtacttgggtataaccctttgttccattaaaaaaaacactaataggagatgtgacacatccttgtactatgaatatggacaactttctattcggatttgtagtattaggatatgccatatcttgtgctaggtttgttttatatacatgttggaggagtaccatacctgcgccatcaacaatgtcactattcctatgcttcctgactttcagttattcattgagagcatgccacattagctcctgctagcaacggccaatggacgctacatgtagtactatagtcatacgaagaagagctgcagaggggcatggttcatgccttggggttgggttggggcaaaattcggaatcagatacataaatccacaggggaggcatgcatgccactcaccagctacagctagctatgtatagggcttataactagtgaggaccggagtacactcctagtctcctaccgttgcaactacagccttggcacacatcgtgttggtaccgtcaaattgcatcagcatatgcagagacatgcagcgatggagggcattccagaatgctggacttcacttccctggtggtcgttagcgcagagctcggtagatccgctgtggctggctagctagctaggcgcccatgcccgcgtgcatctctcatccatttctctgtacagggatgggtgcccgttactatatatttgcaacacattatagtgaaaaaccaaatactattggaacttttgaaacaaagtgaaaccaaataaattaaatttaagttttgaggggctaaaactaaaaccatgattaaactaaagtagaataatcattaccttccatgccagcccacgggcgtcgcgcccatatgataaactaaccttacgtaagacaacagtggttgtttctgagcgaacacttgatcaaatatccaatgatataagaactgaaatcttgctatctttttgcaatatatgcatttactgctatgtcatgttggggtctgtacgaaatgataataatttagagaacacctatgagttctatcctcttatggcaatatatttgttagtatctccattaattgtgtctgtgattgagcaacccgtgcattgggatggttattaggaatattgtaggagttctcttgccctatgggtcatggaggatgattctttcaggtgcttgaacaaataaagttaaagtacctagcatgccataaaagcgtgtcactacttacgattgaatataacctttaagtgcggatcattttaaagtcataccatgtagaagtaactaagataaaattgtcttcataaaactaaacgaggatgtgttcaaccatgattgagatgctttagctgatgggatagctgtcgataggacatgtcttcatcatttaggttaaagttaaaagtgtaacacgccatctcgtgaatcaattcaacccgaaataatagtgtaaaatatgaaagttaacacatcattttaccatgaaacattaacttcatcttttagactgtgaacaccctaggaatttttttttcaaaaagaaaaactgatgtgtactctcctcgaaaagaaaagtgcaaattaactttgacactatattgttgtacagccctcaaccgcaagggttagcttagccgcgcgatgtgggggcatgcatgtgctccgtgtcaagcccgtactggccctccccatattaatacccttctctcctggagagcaaccccaccaccctaattccccaatttgggagcaataccggcgcggctctgatgttaaccttagcttagctgggccgatcggtcgtccgccccagcagcacagccacactgtcacgactaattcccacgccagcctagcttgctcgcgcgcccacctcaattcgccgcaggtcagctagcgcgcggcgcggcttggtcatgcatggcgcgcagccaccacgccagacacccactaacccacctgaccaccgggatggaaaccctagccccgcgcccttcccggtcgagcttgctgctgctacttgctagtagctagctagctagtccaggtccaggctagcgcatgctaccttcgcagctggcccaccaccaccacctccggtgcacctccccctcctcgcgctctcgcctccccctgcctatataaatccactggccggtgggccggtccggtgtgcacgcctcagcttctcgaccgcgatccgtcgccgtgtggttggtgtacgttgcggtctcttcacgcgctcgcgcgcgcggcgaggtatgtgtgtgtccgcgggtttcatcgtgggggtgtgagctagctagctaagcgagcgtgagtgggtgtggaggatggcggtgtctcccgcccgcgggcgggcgggccggtggcgcgaggtgacaaaagagagtgagcacacggccgggcgtgacggcaccggcgggcgtgccgtcgcggccgcgtgctcactgctctttctgtcatccggtgccggccgttttctccccctcccgcggctagctaagctggcctctcggcccctcgccgccggccggtcgccgacggaatcccctgtactgctccgcgcgccatgagctgttccgagtctctaggctctttagattaattcgatcccctcttctccggcgcaatcgtgcataggcgcagttgccaggttctagatctctcacaatcgaattgatgcatttctgcgatttttcgttcgtgttccagccccgtgaggcggtgtgtatcctcggtttttctagtttgccaagctatttgtactcgactccttctaaaatctcggcgaaaaacatttcgttcgtgttcttttgggtaatccaactagaggagtagtactagcatggcactgttcggatggggaattggagtcggtgttgatgcctgtaccgtaggagtaccagcgcttgctgttgctgttttccatatctcctgcgtcaattcgtacgacgcccttctcttcatcttttgcgaggagcctagctactagttgtactagtacctgctagtactagccatcttttccattccccttcttgggaaggaaatgcaatatttactgcgccattgatggatcttggctcttgggagaagcaaatcatcgcaggaatctcccagggcatgtttgaaattttaaccagatcgagatcttttaacttgtttcaacttgttcctagcttcgatcttcttctgtagcgccccatccagtgttacagtcaaattaagcacacaagtgtggagagatcagctagctagatgatgaggatcggaggagaggaggaggaggaaggaggacaggcaggaacagtacggagacccagatctgcttgggcggcttccccttatcatcagtcagttatcttctgctgtctgctggtcctccatgttcttgagaattaacacctcacatctcgctctggcattcaaagtagggagtaatggtgcaacgatgcattgtcccccaatggctccaaaaatgtaggatactgttgggccactgttccattcatggtgctcgtacttaccaccctctctcggttcagagtccatatatatcccccactagtttgacttgagtttaatttgctgggctcctgtgacaagatcggaagaaactctccaggccacaagattcaagtctttgaaaaaaaaattaaggccacaggattaattgctcgatatatgtagtccatggacaaagctaagctatagcaaatgtacttgctgatacgagtcttgaaaatctgaatttatttttgagatattggaatattgtgagtatagaggccaagtggttcgacttaaatttttccttaattaaggtgaaatattgcctggatttttgttgtcctgataaagtgatttgatgtgcacgcgctagctggatgcagataacaatgaagtttggctaagagtcggtctactaatgacatagctagagaaggcatgcattaagtttacagtgcaactagtcatgcacggtgagataatacaccaaaaactagcaagtgtcaaatatgctagtagctggtttctctgctgaaatgggtgaggtctaagtgaatgcattgttttttttcacaaatttaaatgtatatatattgtgaaagtacctaagttagtatgcaatattgcatgcgataagtatagaatttatgtgccgatagttagcaattgatatttttaactgctcacttcaattcatgcatgtctaataggaatatctcagatagcatattgttctagctaggttccgtggcaatttcagttgttactggtccacttgaaagtctatgggtcgtagttaagtcacaccttatcgatgcaaagtacgatatctctcctctcttgttcatttttccactgcccataaatatcttgtttataagtatatatcaaagaatcagttactaacactggatcatggatcttacatgcatacctgctgctggtttttataagtcaagaactcgagcatgcacatgaaattgatcattcatgcataacctaattaaagtcttttcacaaacatgttaatgatcactttgctgcatctaattttattggagtactccatgcatgtctctatcttatgcatgccacattatctttttttttaatccaacaattatatatatatgactatctcttggattatcgatcccccctcgattccatggcattaattaacatcatgcacgaattttactttaattttggccacttactaattagttctagtaaattcttggtttatgaccggcatccttaatccatgcgtttgattaaaaaaatgggaggattagctaaacatatacgatcatgtttagaaaagcatataccatgaattaatttattcatctcatacttcttcccgtttcccatttgtaaataaaatatttaatgagaactaagaatttatccgttttaaatgtgtcacgcaaggattatttaaatgaagcataaggttaaataattaagtataatgcatcataaagtaattttaccaagttttatcattcactttaattgaggacatcatgaatataattgatgtaacattatcttatatactaatttaccattgtgttcgtgaaaactaaccaaggcatttcttacccttttttttcaattaatttggagtaaatccatgtgggaagaaaactctacaataaaagttcttttttcattttgtgttattttatgatattaaccaaatgtggtttatgtgcataaactgtccattgatttttcttaaggccaacagcacatttgaaaggtactaagtttatatatgggtggctaatatataatcagttttcccgcacatttgaaaggtacttatattcaattaactataagaatgtgtttggataatgggaaatgagaggtgggattgggattgggaaatgaatgaagggttaggattaagtggaagaggaagaatgaatggttaggatttaaagatgtcttttaatgggtgggaaatcatttccctatcccattagccaaacgaggcctaagctctttgaaattatcatcagtttccagctagctagttcttggcaaaaatcataagacaagaatttatctatatatatatatatcttggagataatgccgagttaattaaaactgcaaatatgtacacctgataaatttcatccacttgctgtgagtattgttttgtaggtacagagattttaactagtccgtccttaaaaaaaaaactatatatgtcaaaggtttaagtagggccgggaatcgattttgcactatactttagagcgtatatatgtacacgaaatggttgcatcttttgtgttctatttgtaacctgatcataaatcaattagttaagatgaaagaaagggagatattgttatcaacatgtggccttagctgatcgtctttgttttacttcatactcaaacatagttttgaatagatatgattgagtatggagtaaaatcttcgtttgagtatgtcaaatcttcgttctgatgatagttcctgttcaaccatatacttgtgaacaggaactatatatgtcaaatctattcaacaatatctattcaaaagctatacttttttgtttgagaattacacagtacaacgcacgcgcacccacccctatgaacacacgcacgcaaaccctacccctatgagcatcttcgaagactgggccggcaaattcctaccactgaaagcacaatgccattaaatcctgaaaaattcgcttccatgaggagtcgaacccaggaccttagatgctactgaggctcttgtaaccactaggctacacttgtgaactggaactatgtcaaatcttcgttctgatggctatgttcttccattttagttgattttgcagaatatatatgatcttggagaaaaacaaattgtcgtggacaatatatgttctagcaactcaattcgatcgcagattataaaggattgatgcatactacaagctagtcctttgtatatttttaagcacccatcatatttgttgcacatgactgaaattaagagtaattattagctatgttctgtcgttttaattgattgtgtagatgagaatatgatgtgtttccaaacaattgaatcaattctctccgcctaaataatacttgatgctacgagcccttttcttttgtattttaaagcaccgggatacatatcttccttacgatgcatatttaccatgcatgcatgcaacatatgtacttgccatggtgcatcgatgaatctgtatcacaccctctagctagctagctgctgatcaatgtctgaattgtcgctttatttgagattcttggagaaagcaatggctgcttcgacgtggtctatcgttttctcggtgatgccttttaataagatagtactcaatcaacatgctatcttttgatcaggctcaattaatttgcccaaaaaatctcttgaatccaagctaaatcaagatgctagttgttgcaacttgcaactgatggtttatcaaatcagaaaggttgatttgtgaatgcgtatatggttcgaatgaaatcttgctttcgcatgcaacgtatacactgacgtctgtctgaaaccatagcttgctctcgtctggtattctagatttcccaggctaattaatcaagtcgcgcgctgcaaccataacttgactactattcttcgcctggaaaaatttcacttgttctgatcaagtttatggagcaaaattaagtgtactgtaccgtaaatggacggagcagcacacgggctggcagcgatcggaactagcttgaaacgcaacgatggcaacggggaggtggaagggagcgatagatgctattgttcttcctcgtcgtcccctctgtttcgcggtgagttgagctcgcgattagtgttcagatagggtaggctcgtcgcgcgcgcgcggattctttgatgctctctttgacctttttctttttccggcgaccgcgccggcgccatcgcgcggttggattggtttggagcctgtagcattctgcacggtccgtggaccgctgggctgggctgggcgattctgttctgcgtggagcgtggagcgtggagctattctcttggctccggcgagctctccatgaccatggatgtgagtatatcctcctccgctgggttgctccttgatctcgtggccccacctgggtcgcgattacagttaatctgaacccgcctgacaattttcttcagccaatttttggggggcagttcgattcagacaacaggacttgctacaggatagcggtctgcagccgccattcttcctgatgatagtcgattgatccgtgagtcattcctgtgccccgattaagtttgtcatggaacacataagtctgctcaattttgaaagaaagaaaaatagaggaactgaaattttcatcatcagttcgttttgtcatctcatctaagttgtacaaaggcttctgtattttgctaggtagcactgctcatcagaagggagaattttgttctgcgacgaagaaattgcaatacccccagagtttaataaaatccgtgcatgattacatgattaatggaaaactgccatatttcttccacaaatcaattcaagcatcgttacattttaattcccacagaagaaggcttcacaacacgggatgctatcgcgctaaacactatacatgctagcaattcagagatctgataaaagcaagggtgaacttcacaatacatgctaacaattcaaagatctgacaaaagcgagggtgaacttcacatgccaactcagtactgcaggtttggaaacaagcatcacaaagaaagaatatacatcattacatgccgccgtttcatttgtcttgaaatgctaaagtctaaaatgtcctacgctacaacgtgacaagtaacaacgatcagaccacacctaaacgctacgataaacaaaatacacacatgcttatacatcatttgagcatttccccctattcgctatgaaatgctaagttcatctattgtacgtgcaatatcagcagctagtccattggttccattcatctgctgttccgtggcacgattgctactgtctgaattcgtttcgctcccaacagttgtgttagaaccagttgctgcagcagcgcattcagcaaaccggtagcaggagatcaagtggtcattggtcatgcctgaaacttgcataaacgtgtagacaactgttgggcctacgctacggaaccccctgcgaaccaaatctttgcttatcgcatccgctttagatgttttgacaggaacctggcggggatacctgaatctgctcaaaataggtttgttgttcacaaagctccaacaatacttatcaaacgttccaaactcctctacaatctgcaatgataagcacaatggattagataagccactgtgtagctcaggaatgtctttgggtaaccatcctacgtttttttgctttaagaaaagcatgatgaaaactgaatcggacactgaaacgccaaggtaaagccaaaaaactttgcttcgggatggggttaccaaattttatgaagactttacaggagataatgttatatcaggagggggttaccaaagaacttaaagcgtgatttgtatcattcttattccaagaaatgaactagagacctctttatgcaattaaaaggttcaagagtgtaaagggccaaccttgagtatttggcgtgcattttcaatgacaccacgcagtttttgttcagataacaaggtactgctaggacttccaggtgcaataatcttcttttcacttagtttagagaccaatacagggtcaaaatccatgaaaacctccctgtgagacatacttgaatatgttatttgggatttgccaacacctagtactacaggttcaagtacatcagaaatgcaaaatgttacctgaatataggtctcttgttcagaattgttggccatgtaagttcagccaatgcacctgagagcaccagcaactcaaacaacaccctgaaagtaatagagtaatttacacttgattcttttaccaaatggaagagtatcatatcaaggttgatgatattcacatacttgtcatcatgaactggaactccccattcttcgtcatgaaatgcagcataacagggttctgcacttgtaagcaatgagtgctcatgtgttaagatatgaaaatatatgctacataagatcagtttgataaacaaaatagagattacttggcataggtcctttagaaaatttgttattacccaagtccttagtaccaaaaaatatattcagtaaacaagaaaagatgaaaagaggaggacctgaccttgtctcgctcaagttcaatgtcagtcttataaattggcaagacagatgaaaaatgattccaccatcatgggcataatttcatcccgttttgttactaacacatgtttcttataaaactcacaagtttatgaattaatgcattcttgtgtttatgagagacatggatcggcctgcgtgcaggcactgtgaaatgcaaagatatgggtaatacccaaagatatggtcatttcaacagcaagcttcttagagttggtcaccacaaaatgttctcggctcccatccccaccccaccctagagaagatttattcaaccttaaaggtctgtatacaggattgcaacatgaaacaagatgactacagtgtgatgttacttctttgtgttcgcgaaaagtgatgttacttctttcacaagaatgacagattttacttagtataactccttgtgattgtagtggctagctacatgtctacacccgcaccatcataaaacatagtaatgtaaccacatacagaaaacatttctgtaacatttagaatcttgaagatcggggtctgcccagaagacagaatatgctctggccattttttacccagtgcatggtctttaggatctagcatttctaactcacaaatggtgggccttttgttctaaattttagtcctgatgaatcatatgattatatcctctctgcaacaaaaccatcgaacaaaaataactgtactagagacaatgcaggataaatttatgtcgacactggctgaaaaatgcaagcgaatcgggaacacgcaccagtattagctgtcacccatgaacacctcctcttcagaccaggcacatcattagcagaagccaatccaacctccctttccagcatggaaacaatcttgtgatcagtctgacagagagtcttcttcttcctagccccaaacgtcggcctcccaatccgccccgtggacgcccggctgcagaacgagtccgtggatgcgtccgacgagcacgacgcgtcgagcgacagccccgagcgcagcagcagctcctgcctgcgcatccctgccggcacactgagcgagggcagcaatgtgggcaccgcggcgggcttcttttacttcgccgacgccgacgccgaataccttccaggcctcggcgacggcttccgtccccttgtagcggaaaccgaccgcgttctgctccccgcagaccgcggctcagagtctccaccgccgcccgaagccggcgaaagccgccccctcgcgttagccccggacattgcggacacagctccgcttcccacaagcgtngctagaacccccccccccccctcctgatgaatcgagaccaaattggggggtcaaagcaagcagtagattgcacgaaacccacgcattccaagcgatccccgcctccccacgcgaatccacgagcaaaaccctagcaatcggcaccgggcctccccggcattgcccaggaacagttcagccgcccgcctccacccataataccccaagcaacgcccccccaaaaaaaagcctcccactctgagctgagctcgcggagacgagaccaagagcttaatcacaaaacctcgggggcatcatcagcgacgcacgacccagagatgtagcagagctgtagcaatggcgccgcggcgcgcgagccgagacgaaaccctaggcgaggtgaggggggaaggggaacgcgaggtgccgaggtggagtccaagcagcaacagcagccgcagctcaaaatttactgccgctggtattggtgggtggtgggagctcgctgttttttttttcttttttccctttctttagcggtagatttggttcagagaggcagagagtagttttggcctagcggtgtgcgcctgtttgtttcaactttggagagtttgaggtgagagaacggtggttgctgttctggcgcaataatatgcggatatgcaggtattgtttgtcaccagatattatatccaacctagttgctgtttctttacgtattaaattatagtggtttaaatatttatatttaatttcaaacaggaacaaaataaattattcaaatgttatcaaagtaattgcatatccagattcatggatttatgaaattaggaacactcaacacccaacaccgaaaaatcttatatttgaagttgtgccaaatagggcctaagccttctcaatgtatggtgagtgttaatataggtcttattgagtttaaaattctgagaagtagctgatgagagtatagaaaagttgggtgtaaattttcagcttctggttttgttctttttaaatacagctatatattttcataatcttagtaaaaatttggacttgtttttagggccaaggattatagaaaatgatgtagctgctagaaactaaaaaacacaagtgtgttaatatataggctgcgtaattaaccatctatataagaactctccactcgaatagaagtatccatatcttcatctagttccttaaatcaaagtagccaagagaagttttacagcacctgctacgtattggtgcttagttaatcattgatactttcaggattaaacgactccttcgggagcgtatgaattttacattatttttacaaaaaatccttcaaagttctcgtgaaattctttccaaaccgaatagaccctaaaatatctcatcctacatggcaagataaaatg

SEQ ID NO: 573 - DNA, 15739 bp, Oryza sativa
agagcaagtagggcaccagtaccacactaccactgaggaatacaccaacgcatacggctaaaacacatgcaagtacttccccgagaaaacaacactgatccagtacgtttgtcttacagagcaacagtgtcacaacaacaaaagatgcgtgtgccaaatgtacgaggctaccttatcggcagcgacgtatgcttgaaaagtataagctctcccatttgcagccgatgcaactccatcacgatatgatctacaggtatctttcattgaaacaaggagggaaaatgtatgtacaattgcgtgctggcaaagctgaaagacgataaatttccagtgcagcgtctgcacgctgcagtagaaaactgaaaaaaagggggggggggggggggaggaacagggaaatccattttacaaggggaaaaaccttctcttcttgaagtaccagatgaagcagcagaatatgactaagccgcatacgcctgtaatgacaagcgtccattcgaacgcatgtggtacattaaacaagtccacctcaaagttcatgccaaaaactcccgagacaactccgaagatggccaccacgaatgtagccgtggtcagcagcagttcaaattggatcagttggtttcggacgttgtcctgtaagaacaacatttgtgatgatcatgtgagcatattttcttgtccagatagagagtgaccaaacaggctaaaagaaatgaaaaacaactttcatttctcttacatactgaacctaatagcagttgcacactgctaatatcagcaatatgaaagtctgtgaaatcatatctctagccgagctactaaaccttgcagaaatatatgatagacatgatatctggggtaaatacatggtggaaacccatatctgtaatgatgttagtctaagataggaccttcggtttattcttaccaacaggccctttgtgcaaaagaaataccaccacagcagaatacgattgtgcatcctataataccaaccagaatattggtgaataaggggcatatgcaaacatgcatgttgtacagaaactgaccactggctgtcctctgtaatagggaaaaaatctggcctacagacatttgaagttatagtgaacagatgtagtgatacagaagatctttttgttgacattgaaaataagctaaccacatgctccaacagcctgtcaactgttgtaatcttctgacatctgacccaacttacaatctgtctactgtctcaccccagtcccaactttaagttaatctcagttagcatgttaatagattttcattagcttaaatggaactaatgttattgtgagcggattatactttatatttactaacttagtcttactgtattatcatgcatcctccaaaatgctagggagtaatcagcagtaacgttgtccaatattttttctttagtacaatctatcattcccatttggagacacctttttagataatatttggagacacttgtgaatgtatcttagtttgtcttgtgcctttttctagtcaactgtaacaactaaatgacgggttaaaagaagctatatatatgtcaaagtaaacatagtatgatggtcagataattgtactcctgattccaacaattatgcatttgccatatcagtttcaagaatacacaaggcaagaggcatacggtttactttgagtatagagaaattaaatagcagtttcagatgagaagcaagcactcgcagtattggataagaaacaagccaattctgttgtgagattggaaattgatctgctaccaaattaactatcaagtatgaagaagatatttggggactataccagttgtatgttgatgaaatcctctgtatcatcaatatactccttcagctgttggaatatatatatatatatatatatatatatatatatataaaacataaaatttattagcccatgtagttgtaaaaaataaacagaagggcataaaaagcgaggcttcgtaccgaagttaacttgctgagggtgtaatcaatgaccacgaaataagcctctaacaacatttcaagttcttctatgctgtactgactactgtctgcactcttgaagctgtcatgcctacttctggcaaaactcaattccttctcaagccttcgagaagcagggggtgaggaaactggcgaaactggagcagagaaagatgaaccaaatccactattgcccatcccctgaaacgcctgctcctctagcaatgatgcttccatcctcctcttcttctctgtgaggtacatttcagccatatcaccatcgtcgtccatcagctgctctatctcatctctgaccttaatgggggaaatagaccaattattgaaaaccaatttaatgtttgccaaaaacaaaactacattgacacagtccatttaccttttggacccttctagtcaatgcaaccagcttactctttaggcgccgcacacgttccaagttaagggtactgattttcgttgtcaattcatccagtaaaggataagcgtcagcctccaattcgacagcctgacaaatatgcaaatgtttttggttctccagttagataccgtatcattatgcacaaaagaacactattaaaagagcgtagcacaagacgatcactgcaggatttgccaattgatcagcaaatctgtgatgcattacttcattttgttcacattcaggttataggcaatcactcttgaaggcaaaggaacaactaagtatgagatcctgaaaaattagtagttgctacattcctgaacttttatcattggggtcagacactaccgtttagttgtatgcaacaatgtaagatcatatgaatacttagtatcgacataatgaacgttgtggacagtgatcttgcccactgcctgattcacatgtcaccttcctaccgctgtttaaacagagaatagctaaaataaaagctattgtttacatcatacagtgtcctggtaagtaaaaaaagatatcgtttagtggaatctactggtctaatagacattgcagatgcaaatgcttcactttatattaaatcataattgctagagcagtgcaattgttaatgaagtagtagtagcagacgccacgcaagtcaatacttctcaattgttaatgaaatcaataattcgcaagcaaaggtttccagataatacgcagtggcacctgtgcgtcgaggaacgagcaggcagcttcgagcgcgacctccagggcgatgaactcgaacggcagatcgtaggcgcggtccacgaggcggcgctgcagctcagagacgtacctacgcacggactactccgtctcagctactcctaaccccacgtcggggtcgcgcaggatgagcgcctcgtcggcggtgatgatgcaccgtatccgctcgaggttgcagacgacggcgcgctcgcgcccgaggatcgcggaggggtagacgaagagcgggtcgaggaggcggaggtcgcgcgcgggcaggtcgagccgccgcatgagcgccggcttggcgacctccaccgcctcagacgcccccgtcgccgcgtccacgcgcacccacgaccgccgcccgccgccgcgctttttcagcccgtggacgtcgatggccacgccgcccccgcgccgccccccgggggcgcggcgcggcggtggggcccattggccgccgccgccgccgcggcgcggggcggcaggaggagccgctccttgggatcgtggtccatggccgtcgaggtctgtggtggggcccggctgtcagcgtcggaaaggcggcgtgtaaagtgaggtgaggtgagtgcgcgtgcgaggaaaagggatctccgcgaacaatgccacgctgggaagtagcgtggtgcgtgggggtgacgtggcgaaccggatcggggtgaatcattgtgggatggattatttttttagtttacacctttttgaaagtttgtttacgaatagatccctaaaaaatattctagaatggatcttttcgcagctccaacttcattggcgctagtgttgttagcaaaaagaacctatttgaaaatattttataattaaaaataagtctttaaacacataagttctcagcagcaagccatccctttatgtaaatgatttagcttccacgagaaaattaaggggacactatcaatgtctgataccgtcatgttggacaacaatatcattaacgttgggaccgtggaaaaggtctattctcgaaataatttttttaatctatttataaaataagttttcagaagaaaagaaagggtgaacaatccagccggggagggcctagtggcgatttggggagttcgctgccgttggtaggccgaggcttcaggcccatcaagagagtattgggccacgagagaacttactaatggaaaaagtacaccgaaggtcccacaatttgtcatcgggatattaaaaacatcctcaaaccacaaacccagatatgcggggtcccttaaatatacaaaaccggtcacccgagatccttcagcggctttgaccccggttttggtctacggctgagttagcatgggacccacatgccagcgtgccacgccaacttttccctttcttttttttttctcttctttttttagttctctttgccgtgacggagtagcaacggacggcggcgagcggggctaagcggcggccggcggaggcagcgtgcaagcgcacggcgaccagcgaagcggcggtggtggcaggaggacgcgcgcacggcgccggcggatggggagcggcagcgtcctccatgtcgcgtgggcgagcggaccggcgacggcggcgagcgggagacggagccccgaaggcgcctcgccgccggtgagcctagccagccccagcacgtcctcgatgtcctccatctccatctccagctgcggtggcgcgtccaggccagttgtgggctggtggctagtagggttttttcgcttgcaactcctgcggctcgaacatcgcgcctactggagaagctagctcgaacatggcgcgccggagcgacggcatcagctcgccggctcgcaagccgtcgttgccacggtcgcgcatgtcgcgtgcacgctaatttgccttgctgctgctgctactagggcggcggcgagcggtgccaagcaagttggcatctccgtcgcgccggtgccgaaccgctggtggaaggcctcaacgcggcgctcgtcctcggcatacgaagacgagggcgaggacgccttcgcacgctgcggtccgccggccaccgcccgggcgtttgctccctacccgtcggccggcatgcgactgcgagagaagagtgtgagagagagagaggggggagaaagggagagaagaggggggaaaggagttacgtggcacgatgacatgtgggtcccacgcgccacgtaggccaatactgggttaaaaccaccaaaaaaaaaaaaaaagatctcgggtggccggttttgtatagttaaggcaccccgtatatttggttttgtggttcgaggatgcttttgtatcccgatgacaagttgagggacctttggtgtacttttttcccttactaatccatcatgagatgatgggccgacgcagcctctcgccgcggtggctccggcccagcccgcctgaaccctagaggggagcagctcagctcgcgtccgtcttataagtcgccgccccgcgaggccgctagggttttctcctcagccgtcgtctccctcctcgcttcgcgtccgccgccgccgtcccggagaggtaaggtaagcgtcccccgccgcaactaccaccacctccgcccccgccgtcctcgtgctcgtgttcgtcttagtcaagcgcatttctgtgctctgtagccgcgcgggatggagctcgcgtctctcccttaatctgagggcgaggctggatccgctacttgcgcgcgcttttcgtcgatttcttgtagtggatttcaggtcgttgctcatccagtagttggtgcttttcttctggagattcaatttaggatggcgtgttacacagtctagtacggtgaatctttagaactgtgggtgatgtttagggatgctggcgatattagtgtgctcgttatggttgatttgaacttgatgtagttgtttgttgactattaaggtggttttttttttgtgtgagttctgaatctgttgtcttggttagcttttggtggttgattggtttcacatcagaaattaccctgtttggattataatacaggatacattttgattaccacataggatgtatcgttgctgttagcctgttactagtactcttatacttactgaaatggtagggccgaacttttgcctgattgcttatttagatttacttggctaatgtgaaatgtgtgagcaagataccttttcctcctgaagtgtataacgactctactgtgaagcagttctatgcttagttaggtggctttctctttctatattagtaatgtattatgaaatagctgaattcgcaatggtgtattgtttagtttttctgtttcatacttctgatatcactgttctctttgtgtgcagttcaagaggcagccctgtgaagctccaatggctcctaaaggtacacagatgatattgctggatcatgtttacatgttcttttgatttcagaccatgtgcaaattgcttcatattggttgtttttaactatttctagttttgtacatcatattattatgtagtctcgcttgcactatataaggtcttagtactgaataagttcttttatgcatatttgtttaaaataagtattgaattgctaagcattgatgaatatggtccattggaaatgagtgtattcctgtagtcgggttgtataattagtctatgaatccatttctgcctggcttttttaacctcagcttggtgcttaattaagatgcatgaactgattgttttattttgtgtctagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggttagcactttccttcatacttcattttatcgcttgatttgctaggtagtgtagttaactgaccctacttgtcttccaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagctattatatgctttgcagttgatcacttgattgtaccgttgattgctttacgagccagctagtattttctttgcatgcccaaaattttgctttactatcccagtttttcaagttagtactataatgatctgatcaagcattcttacattatgatctggtaccttagcttggtttccatgttgctgtttgtgttaagagatcaattgttgacctcactatgtaactgacatgattcttgatttgttggtgaagctagaactacatctgtcaaggctttataatacagccacctgaaattacttgcacgtttgcgtggcggggccacaacgttgagattcgaaatggattgaggtgtcacggcagaaatgggagatgctactcctatctttcctttggcgttcggttcggccacacaacgccgacgtcctcgccggagtggccgcaccactcaccctaagccgccgcgcgctgagcggggaggacacgaatgaaacgcgatccgattcagagctagtctgttaaaccaagtagccattgatgagaaaatcgaaaatttctccttgccatgaactgaacagatcgttcagagtctaatttgcaaaattccggaccgctacccttgacagcggcatgctctgtaggggtcaattatgaatactttccccatcttttcagtcttccagtttgttcccttctctcccctgccccaactcaggacggccgcggagctccggcgatcccgcggcggcgaccggggatacagtcatacaggtagtaacaagtaacagaaacgagtcctcgccgacgatcctgaggagggccgtcacccgccagttcgccactgccggcaatacgagtcctggccctctctgcacgcagcggatagaacggagacaatagccggtcacgccactagttgcagcaacaatcaatctcctccaaaacaatctcctgatgacagagctagcagcactcggttcagaggatcccagaaatccaggttgcttccacaaggaccacaactaacatcatgcatggccgagattgaaacacgaaccaaaatctccctgctattctgaatgcagagcaactgagaatgcctacttgcacagcacagtgtattcaaagtgaacaaaatagcatggcatgcgttcatgtaggcttcatcagggaattcagatcaaagcatgaagagagatcataaaaagcagaagagatcataaaaggcagaatgaactactagtctgtaaaggcagcttggcattttaccaaaagagtaccactagtcaattaaagcattttcttccacgagactaaacaggatcagaaaggaatgtgcaacgaattcaagcgacccctcctccaggccaaatctccgtcgtcaatgcaccaagtacgacaagactagtcatcaatggaaagcaatcctacgaaggagtaaatccaaggttcacccccatctccgcatgagaaggatcgagatcaaagcgatatgcttttgctgtggcggctggggacggtgccggtactggtgctggaagtagccgccctcgcccccctgttgccctctgggtgcaggaaccgaaccagtatgacgctcatgttgtccgtcgatggtgggtctcgtgtaatggcctcctgaagaaggctctcgcagattaccgacagctccaccccctgtgttggtcacatcatacatatatgtcaaggcaaaaggaataacaacatataactgtaaatggacaaggtgcaaaacatggtgcacacgcttccatttttagactatacaaacggcaatccgacagaaaattatttaactaggccaggcaccatcccatttagaggatagtctgtgctaaatgtcagagctacattcagggcaagatatgctggacaaaattataattctcagtatgaagacatttctacaggcataatctgcacacggataaattttcctcatctggtagcaaggttactgttacagtgtatcactggagagggggcggggaatgtcactcacattgtttaagtgaaggcgtacaaaatcaaccacagcctggtttgccaagacatccctacaaaaccaaaaaaaatatgtaaatatagagcaaacagctgcaagttacattaattgtgtcaaagagtaatggtcaggcagggtgaaattcctatcaccactccatcaggtttcataaataatttcctcatccaggaacttcaagtttagtccttatgatataaattagatatattcgatggtcatttccatcgaactgaacaggtgaaactgaaattcatgccaccaagttaatagtcatctggacacaataaagcatccgaacccatatatagggaggtgcagacatttgacctctccaatgctatcatcacactaaactaacgaaaggaattagacccaccggttcaacaactgtacaaaatgactttatgtacatggtggtaaagtagcctagtcagtaaatcaaactgagctgaacaaaatctgcaaattttgtcggtaaatattttgaacaaacaaataagcgtacgagagagaattgtcatttggagttcctatattctgcaagaaatcatgaacatgggagaaaaatataagaactgtttctgatacttttagctgaggacttaccagactccatcacatgctataacaagaaactcggtatcatcagttaattggtcctgccagagacaaaaggggatcattttgcatcagctcatatccagtgggacaaacttaacttcaataacacaacgtagttatccttacagctcgaatttcaggagaacaagtcagcaattgttgttcaggacgcaactttttgttgttcttgtaagataaatcccctgtataaagaagaagaataccagttacaacacattaaattgtttgtgtatgacctcacaccgccaacaaacatataagctataccgattgctcttgatactgcaattccattattaacacggtgggaacccctagaaaaagatacggaacctcctgcagctactattctctgagtttcctccggaaaatttggtttgtgatcattggataaagcgattgccttcgaatacaacagaaataaacagaatagttaggtgacattagagtgcatcatccattatgaaaaaggaaataccagctaggcatttgaaaacaaaagtagtcactgcacctgaccattccttgagattacacaacgagcatcaccagcatttccaacaacgatctgcgtatttctaatgagaaccacacatgctgtacatccttctgctaatggtccacaatagacaggtccctggaaaacaaaaaccaacttgaagtaaataacaaaaatataaaaaccttagattctcgatctacagaacaattgagatattaccagcacacaaggagcacatctgagccaagaccgcccagctgttctccaatactcgttgccactaccatactcagttaattccttgcttgccgcctgatttctcaacatctcatccattctgcaacaattaaggaggaaaaaggattacatattttatatttggatgcacaacaggtgcaataatgaacaccaatgtggcgatggttgtttcttacattcttataaaaagaactcatgtggcatcaaaatatagagttaatggattaactagctgtaaaaacaacctgaaaaaggattgcctcaatgcattagcaaggttactgctaaaatcttcttgctccaaaaccttattgtgcaagtgatttgcgcaataccttgctacagcagaacctgaaatagaagttaaataattgagatactcatcttacataaccattgcgcaacattactcttgagtgcaatgaaggttgcatgtacatggatattataaattttactagcctagtcctccccccacattatgtactatgtagggtgagcatacttttcaagaagtcaaactttgtaggttttgaccaacaattagtcaaagtgctttctcgtcatattggttttgtagctatgaacaatatattatgtgagacatcaaagttgaaagtgtagctttaaagaagaatgagcatgcctaaagaaaatatgccctatacaatgagaagggagtatcccctcaatcagtacaataaatttgaattttgctgtttatatggggatgagattgaagatcaaacctccatggccatcataaacaccaaagaatgacgtgttagtgagagcatcaagattttcaatagtcgcatgctggagaatagaagagtacacaaattagcctttagaatttcaccaaaattagttgcaagccaaccccccatttctcctacaaaagactggaaggttactcacggcatcttccatggtgctacggtatccttgcatagctgatgaagcataagcaagtacagtgttccctccagaatgagtagactttgttatgtcaggaacttggaggggacgttgaggttgagccatagcggagtctgcttcgctgaaacataataataggaataaaatatccttaaattccatactaagatcaggttacagatcacctaaatactagaagtaacggtgaaaatacgaataggaattattggggcagaatgaatagaaaggttaactagcttgaatttgaactgcattttgcagaaacaaaaaatagatacgcggtatgccactgtttgcaaagctcaaagcataactccaatattttggacacatattgttgatgagcgagcaagcaaagatgactcatgactctaaagcagtccatacaaagcaattttttggtagacacaggtcccacggatgcattccaggatttttttttcttctttttatatcttgcatttataatcttcaagatacacaaatgccatcattttgaacccaagatctagcatgaaagttagacctaaggtgaactatgatgatacagtaaaaaatacatagaaatttagcacagcataatagtaaattttatcagtgcattccaacagagggaagtgaaaacaaacacaactgcatcatacaaaaagtagacaagattacaatcatcttgcaagaataaaccagacaatctgaagaatgaagaaattcactcgaggaagtataatcaaaacatatggtaacgactaatttagggaattgattaaaaggaagtataatcatagattctcgaatctagcattcaagaacaagaataaacgagggggagaaaactctgcggtcccaaatttcagttctactatggtctaaggatggatagatgtttaccaaaaacgaactgccgaacaatgtaacactgcagtagtgcacaacccccggaaactggcaacaaaatggaaaagtgttaatacgcttaataaacagaacgcgtcgatcttgcaggaaaaaaaataactcggtcagcaagaagggaatcctaatgaagatttggcatataaaaagcagaaaattaaaccaaataacaggtaaaaagcacgggcagagacatccagtttccgctcgcccaacaagaccagcaatcgcagcagaagcccaacgataggaaaggatgttacaagcctacacgttctaaaaccctaaacccacatgaagaaatggcgatctcgaacattccggaacagaaaatagtttcaaatggaaacaagcgagagatcgagacgaagcagccaccctcgtgttgccattgcgcatctgtgtagcaccgtaaaaaaaaaagaaaaaaagaaagagatgcatccaggaacagatggtgggaagaacaaaaaatcaccgagttaattccgagaagactcggatgcagcctcctccaagaaaaccaccgatcacgactgaaacagcagccaaaaaagcaacgataatgaacacgcgaacaccagaagatctaagaagggtaaaaatctcacgaactttttggagactgaagggcctaaaaaagagagacgaagctcttgcaccgtacaccgaagggatctagtagacgagaacgacaagaggacgcttcgatccgacggtggaacgagcaaaacccgtgggagttgcaaacacggaggcgaacggagatcaccatggaatcgcggtgctcgtccgcctccggcaacttcagttcatcccatccacgaaaaccaccaccagtagcagcaaaaccaacggcaccaaaacccgagaagaaaaccatcgtcagcatcagcaacagaaaggtcagaagcacgcaagaacacacacgacgacaagaacggagcgggcttaccaaaccagtagcacgcacgcacgcaccccccaccgcacgatgacgagaaacaccagcagcgagcgagcgagcgatcgacgttaccaacaccagtagaacacagacgcgcggccgcaagagcgagcgagagagcgagatcaagcacagcgaaatcgaagcacgaagagaggcgatagatcgagaattcacaggttcccccgcgaggaagagaggcttctgatcggtggaagcaaacgaacaaaaattcagaggagagggagagatgggaggagagagagagagagagggagagggagagatctcctcacctttggccttagcgcaagcggtcgccttccatgcaactgagggggccttcacttatactacccgggcgtcaccaccaacaccaaccaccccccacgcctcgctcggctcggctcggctcggctcggaccagcaacggcttcggctccggctcggctcgcgcgcgtccggacaagccccccgcccgcgcctttcgcgaggggtttaacctgaccacattaggaagtttgttactggtaactacagaatccaatgcagcagtgcacgaacaaaatctcaagaaacaagaaggattcgtagggggttaagagcgaggtcaatatatagccaactactggctccaaaatatctatagccaatctaatagtctatttatacaatagttaactataaaaatatactgcaccattaatacacggtcccacctctcatacacacataacatcttaaagtccgtgttgcagccggctacaaatctgtagctcgcttttttatctctcttcttttttcttctcgatatatggttacagccggcttatagcatgctattgtacatactcttagaaagaatatgtgcatattcggtggtaggcgcaattaatagctaaaccccctggttaattgctaaaccccctggttagtctttcggtggtaggcgcaattaatagcttgatgacgtaactaagcatagaaagaataggagcatattcagatgggctttgtcacgttggcttgatgcacgtacgcatatctaagttcactgtagcctgcactgcacaacctagccttctttttcactgtgctagctgtacctcattccccatccaaggttaattttctccgtattttttaatttatttctggaggaatactctagaagcacgagaaaatatctcgagtttgtttttttctaagattattatttttggtgttaaatagactttcagcattttcacatttgagttgaataaatgagcaattatggcgattgatctcacttgaatctactagtagcaataacactaggaaacgtctagcaagaaggggtggcacacgcaaatgtatctgcaaaaattcccatcgagaagccggcgtaatcaggcaacgaatttaaataatgttgaaattttcctctcgagttcatctgaaatgcgatttggggagttatgatgtgctcaccgatttcacacttgaagcagcgcacgagggccgcagcacacgggtgcgtcggaggagcgcggggtatcagggagagcctccgaggccgcggccgcgggaggccagcgcgcaacggcgccgcccacgggggcccagcaccggcaatccgcagggttgaccgttgaggcagcatcccacgtccgccgccccgtcggcggcgcaccggacgaggaacgtttgaaatcgcggagagcggggcgcggacggcatggcggcggcggtggcgatgagaagccactaggctacgcggggtaaggaaggaggggacggcgtgtcgcctgatcgtgtatcgagagggggagtggggggagaggcggtgagtgagggaggt

SEQ ID NO: 574 - DNA, 4553 bp, Oryza sativa
ggggggaggcggaggcggcgaaggaggacgaaaccccctgctcctcgggcttcgtgtcgcgaagttttgaacggcatggaggatgtgggggtcgccttgtcgtgtgtgtcccacatggcagtcgcagtaggcctacccccacccaaacactagaaacggaacggatgcttctccgctgtttttttcctctctttggaacaaaaggtcagagaacatgtagtatgcgtgtgagagagaggacatgaatcgccgccatgggcgaggcctgcaaataaacaagcctggatatccatggcaaggagtggttgcaacgaaaaacaccaggaatgcagctttgatggaagcaatcaagcaacgaatatcagtcaagatcacatatacgtttgatggaggcaatcaagcaacaaatatcagtcacgatcacatattcagttattcacatgcatttacttgcagttcataggcaatcaggctgttatagtcgtatcgtacattcgtactgtacaatgatgttcatctatcgacttgagctacaacaggcaataacttgacccaattcacttgtcatgtatttttggtaagaacaacactgccatgtagtttcacagaatacagcaccttttcttcattgttgattcctatcctaaacgaaaacaaaaaaacagctcattattggttgctcacatcgtcacacggctgtggtgatggccaaatatccttgcaagctaaggtacaagagaacgtggccagacaatttgctcaacaggagcaagagcatagcccccatgactcacttgaaggtattttacctgagaactctagctctacaacttctccctgacataacataagtagtctgcttacacctcgaagatcagcttcctgaacttctccatgtgctcagcctgcaatgagatggctatggataggctaccatccttgttcgcgcttgggaggacaaacgccagcccttcataggcgatgccaccaggacccatgaacactggtcttccccatccaaaatctgcatcatgaattggcaagcgcacccagctggtgagcccgaggttcggacaccggaaagtgtgtgctccacggaccaatgctgataaatcaggctgcagctccaggtagtccaatgctgagcggcagtagctatcgttcatcctatctagcgcctcttggatgactgctgctccatctgccagcccactggtcaccttgcctgcctcagcaagtggagtggcggtgaaaatgacattcccaaagtaaccttctggaagtggaggctgcaaccgttgtcgcccatcagtggcacaatacagcttagtgggctgttcagaaggcaggccacgtgcaagagatacgcatcgccagacatgtgcagcaagaactgcatatgtgctgaaacgtggtgcaccttctcctgatgggagctgcgaacgcagtcgaccaaggtctgagcgggtaagcttgaaaatgtccacagcagttggaggtggtgttgtcttattagcagtaacagactggggtacggaggacagcatggctggggcaggctggtactcaacatgtgggtatgatggagttggtggatctcgggctcgtaggagagtgcggtcaatgaagggcatgatggcaatttgagttcctcggcagaggtcagaccatgagttaataaagtgcaaaccggacatgccatccgccacatggtgttgcataccaactccaagggagacacctccgcacttgaagtaggtcacctggaacaaaataacaaaaccaaggagaatcagtgtcttgaaatgtttcacttactaagataaatataattcatattttcaactgcatataccattatagcaacattacaagtattgagatagatagtacatgaatgacacagatagaagttgcttacaccaataggcataaacattctggatgtcagaaattaactatgtactgacacaactcttcaaaaatctgcaagttatattgttgaactgaaactcagttccatactatactgggtactggatttctaattgaatttccaagacttaggatgcaagacataagcattgccaccaaaattgttgactgcaaccataaacatataaactcaaatttgtgcttctatacaaacttttgtcatgtaataatgcatacaaatgacaacatcctccatcaaattgccgatttctgattctaccataaaaaatgtgccatagaatccggcatcaggcaaaaaaaaattttcaaacaagagtgcaagggatacaaaaactagcgcaagcatgtactatgcctaatcattaattaacatgaaacatgcaggcatgcaattttataattaataaatgtgagccagaattgtttaaacctaatcacaaatacggacatagttcatgaggtaaacaatgtgtattgatgactaaatgaaattgcaagacaacatgatagtaataattggataatactatatgcatgcatattagattccgctttgttataggaacatgtgtgatctcccttactgataagtttggtcctttgactactgtcgtgcttactattaatggtagaccaaatacatatatggtagggggcattgaaagttggtctatgtcacatcagttaagtgttgaatcaccaatatggtatcatgttgatatagttttttttctagcataatcagctaaccaatgaggctacggataacaaaataaataaaactaacacaactaaaatcaaggccacgaaccagaagatgagatggcaaagtgattctagaatgaaaacagacatatgctgatgcatgaaatagctgaattgtccatggacatgaatgcatagcattgtgtgtttgacagtgactgctatggcatggtagaatttatggccactcaagaaatgttcgatgatgctttacatatgtgaattttaaaacatatgcacatgcaagatctgagtatatgtgctgcaagtgcatcaccgaatataatatcgcaaggacaggatcttagaggcttttactaggaagagccattaagacaggcaatacaccaagtttctgatgaacatagaaggaatcaactacagatgacaagagatgctccaattgtgcactagataaagagtaacataattttctctacaattttttggggttgggatgcatgatattcgcaggcctcagatccacattaacaaggtgttaggatccaacaattgacaagcactctaccaagcaatgcaaaagtacctttgccacagctgcaagacattttattggcaactaacagagaaggactacatgcaaatggcttgtctagctcaggatgcaacattccatggtcaacccaacccacaaaaaaaagaaggttgatgcatgcacaccacaattgaagtcagcttgccatctaaacaggtgttacaacaagttagcaacaactagagttgataaaagagaggaaatcaaggtttaaataacttctaaaattggaacaatatggcgcaaaacagtactatctattaacttattataagcaaaaacttgtcagatggaacatgctccagttaacactcagatccataccaaccaacatgcagtgcaccaagactactcagagtcatggttgctgacatatcagcgagtaaaaaaattgaatgaaactatggtttgtaaccttgtaaattttggcccagttttatgttatggaaagtgcatgcacaaattttcagttgcaaggaaaaagtattagcatgtgcctcaattattagaacaattttctaaataaaattttagctcctaaggtctactagacttacaagcaaataaattctttccattaacacgttgtgttgtacactgtaccatattatttcaaagtcaagtatgtctcacgtaagactaatgattcattcaacctaattgatttattgtacaagaattccagcatgaaagggcagctgatgatggataaccagaaggtgagcagatcagacatgtttcatttaggacaaaattgaacgtgcaacctgaatgatgtatccatcaaaggataaacagctcatgaggctctacaggacaagggctccagttatcgaacaggcaaaagaaagctattgtcagtcaaagactaactatcacaaaatgttaatatcacacccaattaagtcccctcctgtctacatcatggggcaaatggttgacattttggaacaatgagattgaccaatcaaccatatatgggagctatagaggccctagaagaaaacattagtgcctactaaaattgttcccatctaataacaagttttaatgcaatctaaccattacttctggcatcaaaacacttaaatatcagcagtaacatggaatgacatggaatgatcggcacttatgcttagtgatcaaagcaatatatatagtcatcgccacaaagttttaagtattcaacaaaggctagcagggttaaacgtgcaaatccaatgttaaaaagctccaaatgggataagcttctcggttcaaatatctgtaggtcatg

SEQ ID NO: 575 - DNA, 520 bp, Oryza sativa
  unsure (1)..(520): unsure at all n locations
agccgattctagtcgtagctgatctggactccagccgattcttactttggtcccgcaacaatccttatctccaactccggttcgatcccatcttcacctccgacgctgatattaccaaattcggttggtacacatgccccccaagtccgggatatttggtaatgttccggatttgccgggtactgacttcgagcaagtttcgcactttgctgttttccgaccgttattggcgggcttgaaatactaaccggcaccctcgagaaatctcacaccgtgacttctgttttcaccgctcaagcgaaactttatcctctctctctctccggcgattcctccgacgcaaaagcgacttccgggtgacttcatctncagcgagacctccgcctgcagcgatgtcgtcttccaccaatccatctgatgtgccatcggccgagtatgctgaggtaagtctccactggctagatcccctttcttagcagcagatcgattttctcctatcttatatcgctctctttctctc

SEQ ID NO: 576 - DNA, 271 bp, Oryza sativa
ggagaaatctcatcatctttaatgatggatcggctgctcaatctccaaggacctcctctaggcagcattgacaccataaagctggcaacctttaggagcaaattatttgacagatggtggggtgaatggaagctacacttattccatcaatcggcttccaagtatatgatagatctctttccagatattgtccctcaagtaagtcctaactcacttgattttatttgaataactacttggttgattagcccttagctaactttcctcctga

SEQ ID NO: 577 - DNA, 64581 bp, Oryza sativa
tgaaacaaaaagaaatacaactaaagagcatccctggaaggccaaaaagtacggagaaattaagcgatcaaatcaacttgtggggttgtgtattataacatgggagcatctcaatagaaactaaaattttcagcaagtagtaactaggaactgcaaaacatgtaaagagagatttagcgttacaaaacagcgtattagagaccaggtgcgacttgcgagtaataaggctctgtttggatcacagccaaacattgccacgccacagcgtggcttgccacagacctgtggcggaccttctccccgcctcaaaaatcactgctgtggtgctatggcattcaatggctaccaaccaaacagagcctaactcaatataataaatgcaccgagactaaaatattcctttccaaatatataacctaagattggatttgtccaaatccctattagtggaaatatataagattagatttgtctagattggttatagtgaaaaatgtctaatccgtcctagattgagttgataaaactttccttttgaacaagactattatcaaaatttaaaaattttaactataaataatgtctaaaatatttagtattttaaaagtatggtggtcatatgtatagattgatcttaaaaattgcttcaacaaaatcatatatttatttatattttatattatattataataaaaattttcgtcaatattgttttttaaagactatatccttataaaaagattttatcagtccggagaggtattttttaaaacagagggagtacaacttatggttggtaccaaaacagaagaaaaattaagaggatatataaacggataagaggatatctaaacagagaaaaaaatgagagaaatagggtgacattggtgcagaccgcaaaaacatgaaatcgatcgagaggaatgatttgtgcaacaatgcagaaaggcaaaggatgatgatatgaactacgacatttctctccattcatgcttgctgcaaaattgacgtctcaaatagctccagcagaaaatacaatctaataagggttgaacgacagcaagcaagaaaccatatttgctagaggctcacagctgaccacaaggaacaaaagtaacacctacattacaactaccactgcaactgctacaactaccagctgtttcgtgacggtcgattagggcaagacttggcaggcaaccagccaagggatggaagccatataaattgctaggctgctcatgccaaaaaccttcagactgcatgcctcataagtaccccttggaagaactgcacaaggccagagcaaattagttatgagccttccttctgcgcttctttccagtagaaattttagcagacacatgctcttcctcttcagatgactcgccttctttctccttttgctttcttttggtcgaaagaccatttgtcttggatccatcagcagctttgggagtgcttgcaccttttggatttgatccgctggatttagcttcatcttttgaatccttgtgtttgctgccaccatcattttttgatttgcttgcgcttttagtgttaccagtctcatccttgttgcttccctttagcaggccatcctttgtcttgccagtggatcgagatgatcttccaccttcattcttgagggcactgccacttttaggtgtcttggatatatcttcatcatcgttttctgcacttttccccttcaaaggactgtcatcattttgtgaactattgctggagcgcacacctttagggcgtcctcttttcttgggaggatcagcgacatcagtgccacgatgtttcccactgcatacaaaacaagacaacagtttcagttaaggtgttgcatgtaggctggatcaatatggcacatccatatgaaaagaacctgctgggtgtttctatttttccttcctttgtttgctcacccaagctaactctaccccttctgccgtgcggcctggtaaaaatgatcaaagaactcaaatatataaaaagaaagaaaacaaaaccatattataaaggataatagctgatgatgaacgaaactggagcattaggtaacatctgccagcagtatgcatgtcgcagcaaaatgaacaaataaattatgtgattacagttggaactcctgatcataaatagtaaagttacaatacaaacagaaacacagtaaatcttataatctatatggtagaaacataaactgaagataatggatgctgggaataatccaatcaaccacaactcaaagctcagaaaatcaaggtcattcatgctagagcaacttattttgtctccgttaacccattcaagaagcattccaagcatcttgaacccccatatcaaagattcaagataaggagattgcaggtttataggaatgacaatccgaatcatataaaagattttagtgctgatgtaactaagaaagtcatcaaaactttaagaggatatcgatgatgcaaagtagaatatttatttacatacatatcagacgatgcgtcaggattgttgtctcgcccctgcaggtagcagatgaatcagaaagtggctagaaaggatagataatggcgtcaaactgcatggacatacctcatcaatgaattcccatttttcattcttaaggtgtaggcgttcaacatctccatcatcataaacaacctgggtgccaaaaaaatgaaggtatccaaagatgaaactgagctcaaaaaaaaaactagcatttgtagtgatttggacagcaaaaaggcataagtcagagctcatttcccaatgcacaccttgtgcttttttgaagcaacatcaaatgactcaacaacacctttatagaacctgcagagcaagaaacagattcagaacaagccaaacaacacaccagtaaaactcatgtaagaaatcacatatcgtagcaaaaaagagtgaggagaccaggatagataaaatataggtgtgtaactcaatctagaatgaataattgtactgcatatattattaaagaaaaggtacatatttagaaacatcatatcaaagtaacgaataatgcaactgaagcgtcgtctgcaaaagaatatgccatgtcaatctagatcaagaaatttatttagaaaataatgttcatacatatgaaaatatcatcataaccaatgaagcaatgggtactagttagcctacaaacacaatcttaacaaactcctacatttgagaaacataaatgatggttatagaacttactttctgtcatcaggccaccacactttgattcttgagccaacaagatttcctttaagaattttgttcttcttgggctggggagtctgatgaaagcaaagaaaaagatttgaacaactgaaacagaaatcagcttgcaacaagactattcactaacagcaataagaatcaagtatgcatatacctcttcagcttcctgtgcacgtttcctttttgagcccccactgtcacctgcctggcctttgtttttacctgttttggccgaagacttgggagatacgatatcctgcgttatgataaaacagtcattgtggtcgatcatcatcatcgcatgcacaaacatttcaacacaaacccatcagatttacaccaaatgcaaataaagctctatgaatttcgccgtagatacaaaatagttggtggcaggttgccaagccaatcaggaagttaaaaggatgaaaggcagagaagtttaaaaatatgagagccatcgacccaacatgttatagttttggaaagcataaaatgttttgaggttccactatttctaaataacactcctaccaggaaaccttagaacatggagtcagacagatataaaactatgaatatgtaaaacagaaatccaaccttctgctagtgatatacttatgcacgacctatgtgcaaagcaaaacctcaaatcatctactgttgacaaagaaactacctttaaactgagatcctcatcagtgtcttcatcgggtggagtatcttcctgctgtttcaaattttccttctgcttcttcttcgaagattccccttcaccagtctttttgaatgaagacttgatatcatcatctttagctagtcgccttgtagcccttccaccagaatcactaactgcgtcagcttttttagactctaaacctgatactttgccttttccaacattcttcttctcatgcgactttgatgcaggaggccggccccgctttcccttgccagcaggtgtgttatcaacatgtttcgatttgtcatcagcagctctattcccagtctctggtggcagcttattatccccatcatcagtctctggggataactccctagagactaaaatatcctcgttgttgttaacagccttagaatgatcaaccacttcagaatcagtggaagtatcaagtttatggcttttctttaaattgtgatcagatggcttttcaggctctgtggtgattggttctggtatttctttagcaccggatatcaaatcatcagtgtcttttgcctgattgtcatcagaaggcagttcagccttcttatcagaagaggatggtccacttggagacttgaccctgtctattaaagcacaaccattgctaaccgccgaagtggaagtattgtttggaggagtaccgtcttttccagggcaattggcatcttgctctaattttgatgattcctaaggaataaaatatgttcattgtgatatctatctcactttcaagaacttcagattgaatgtcagtagcgacatacctgagctgactcatctgaaacaatcttatgagataatttcccatcagccacctgcatcacaagctttcatagtcagcttggctgaaataaactaattagtatatcagaagaacattggccggtatgatatcatatcagattgagagaatttacactacaaacttttacagatcacacagttgataacaccaggtcatggaccattctattgactctaccagaaaccaaaaaatatactaacatacaatcaagcatatctttgaataacaccaaaaaaacaaaattaatcccaagaccactgcttgatatttcacagttgatactttttcagtcaatataactttcaaccgctaagacagcattccagggtccaaattctagttattacctgatgggcaacgtgacattttaaatttaacatacatattactccagaaagaatgccatagaattgcctgtcaaaatagtttatatacagcatgatatttaaattaaaatacagttgatcatacaaagaaatgcctgtcaaaacatttctatgtctcgtgttcctctcccaagtcccagtggtggctatatagcataaaccatattatacctctatagagtgacagatctaaccatttccagtagcaaatagttgaactcaatgtgtaagactaaaaatatgtgttaaaggttgaccacctctaataaaaagaacatgagcagtctttgcccatttgaacacatctgaaaatacattgagaatgccacaaaatgcactaactctatggtgagcaaaccttaattaatattcaaaaaggaaatttgttagtagtttgactgaccatatcctttccaggggcatcagaattgtcggctactccagcatctaaagcatcttcgaacaatgatgtaacaacttcgctgtactcatccaagggagtgccccgaagtaaaggagtaaacactggctttaacttctcataacacttattaattaccttctctgcaagttcgaaagatgctggaagagtttcctacagagcaaatttgaaattttagtgaagatgatcagatctattaattttaatatgaaagatgtaagtgaattcgaattactttttcttcctttttaaggttcttcagaaggtaagatgctagatcttgaagcaggcaggatggcatatcttgctggacatcttcgctctcatcaattacaaacttcatcacagtttccatcgaggtgatgacattctcttgatgagtattgctgaaataaatataacaaagtaatgaattataggataaagaagacttaagaaaattaacagaacatacgcagggcagaaccatgaacatagacataaagcaaatatacacaggaaaacacataggaactattgtgactttatgagttttcacgtcaaagcaaattgtgaactgtgtaaacttgttggaacaaatcatcatgcatgcttttgcacattattatgtgataagagaaaagcagaaattagcaggttctagacaaacagacagaggacaacaaaggattaaaattacttcatggcagattgtgccattatattttacgcagggaacaaccgcttgtcggttttaaaataaatgatgaacataagctaacaatgaaaaactggggaatgggatatggcaactcctcggtatgtaaaatttagcatcgatatgcatgtaaaaaatgttattccccaaagatttgcaatcagaactgatagctgcggtcaatttggtgcttcaagtaaaaaatcaaacgcaacaacgcccaatgatatcgacaaaccatagtaatactaatacatgatgtttcccttaaagtaatcttaactggtgagtgtaattgcaaatgcagttctaacttcttctccatgtacataatcatgccaaattagcagcataatattaatcaggcatcttgcaagtcaataccagaaccacaacatatccctagtcaatttaagaacccgaaagaatcggcattctcaaggtgaagaaaatacgaaatgaaccagcaaaagaagttacacacgatatggttctgaagaagtggtgaaacatgtcccgtatcagatcgtcgcagtcaagatctagcatcaagacacagctccggaccttcgcaacggtttcaagcatcgcaaccctccttgcataggaggggctttccatatcatccaacttctcaaaggcctcaacaactctggtaaatacatcctgcaacaaagcaagtgacaatggtcagtgtgagcaggcacaacaattccgtagcgataaatcttgcagcagagccagtgacaagggtcactacaagcaagcacaacaattccatgacgacaagaagacatttaccttcatgacatcatcgtcatagggggcctccggggcagtgatcctggtaacctccgttaaacaggaggcaacagcaagctttatgtcagggacactgtgatccagtaactccttcttaatcagagcactcattgttggccggagagccttgtgcatgctctccggcggcgactggtcaaccctggccaaccaggtttctgcctcctgcataaacgaatgagcagttctaagtttctacccaattaataaataaataaaacattctatttatacagatccaaacagcgaggattaaacttcacatcaatataacaaccagtacatcctatcatgccaggctccaatctccacggcaacctagaaacgaacaacgcgagagaaaataataagaagaaaaaaaaaagcagggtcaggggcgctcacctagattaatctgagcagctcgtcgtcggcgtccgggagcgaggtgaagcgggcgccaatgtcgcgaaaccgccgctccacctccatttgagcgccgtctgacgccatcacggcggggcgcgcgcggtgccgccccagcgggagagcccgcgcgaagatctaccctgagcaggaggaggaggaggaggggcagccagttagggtttcgcgaggggattgaaggggcaggggaagggggaggagagggcgagagcagcggtagtggggggtgggagatgcgatagagatggagtgtgttaagatttgagaaccagattttcccctctcaagtttttcggatcccaaactgttttttttttcctccccttttccctcctcccctctcgcagctattcgttcggatgtcatctcgacgactctcgctggggtttgggttgggcctttgggccaaaatcgaaaggcccgtcaaccgattgattgcgttaactgagttataaaaaaacaagattcaaccacaatggcacagtataacacaacaatgtttgtgaaaaaaatatattagtgtgcatatcgttagctttcctaccagcctactaataaaattttacgtcgtttggaaaaagctaaaaatgttttgcggcattgaggttccatatttgaaagtgcagaaattgagagatgatttgattgttaaagttgttttgaggatccctgttatcttggctcttaaaaaagctgggtcaatctgaggaacgatctatgttctttaaataaagttatttgagggttattaagacatccaatacatgtggtgggagatgtgtgagatatataaaatgactctggtctctatataaggtttataatcatatactatgaaatctattactctgtctgatcaaatttatttgacataagtcgggtatttctagctagatgggtattgtatttgtcacatacaaacatatctggacaaccaggcgaagtgactttttacagagccgctcatatcgtatagcacataatatgttcatatgtggtagatttagaccacgggtaacttagagaaaagatataagagaaaagagagaggaatacatttgtgaatataaaaacaactgattaacatggcatgtgaaaatcagtttgttgatgttgcgttacagaggaacaaataacagcgtagtataaaaaattgttgcgatgcggtttcttgcataacatggagcccaaacaaatactaggtttattatacaaaataatcagtaaacattttgaatttaaaataaaaaaagaacatctacacccatgctttctcgagtacccctacacttatctacttaacatgtgctttctctattagatctaagatttgaacttaagaaacacataaaaagacaatcagatgatatagcatataccgaaaaagttattgataattgggtagtctactataataaacctttgattaaaatatcggatatcgctaactcaatcctttgtttggaaaaatggcatgatatatcgaagaaaattacatgaggccggtcctaatcttctggatggcatgtggtgcttgagctaagtcatcagcgctatatttgatctgatgatgttggcaaaagtggcaaacacgttgttggtgaccaacaagggagaaaccggggaaaagaggaacatggcgagaaagatgaggaaaaacgtggaagaaggatgactagaaagataacccagcatgaacaattaattaatacgatggatgtggaaatcacagaggaatttcttcttcgttacccaatggatcagatttaatcatgatttgattgggtagtttaggatatgccaaatattgtccccacctgtgtagtaatctacaactatattcacctgtaagcgtagaatccattttttttcaaggaacaatgcattgaagtgataaacaatatagattgattcagggaacatatggcacatccttttgcacaaggggaacaaattattgggacaaaacgacctagaggatgagagaatatcaaactcttccttattcctttagctattattaacaacacattatatggggatgactatgactcctagtcggtatgcatcatccgacaaaagtgcattttcattcgatggattgattcatcgcccaagctaaccatggagctatggtttcttggcaaaccgcccttagagacccgcaggggggggggaggggggatatatcggatatatgaagtgactagagtagaccaagtctattagcgatactttgaactataactttattaatgccgaaagcaaaagataaaatagcaaactatcctgatcaagtaccatatgaaaagaacattgcaagccaagtcatgccaatctaaggagcgcaaacaaagtacgaagatcacggtatatacgagcactccctacagaaataaagcaaactttatgaaataattagggcatatgactcattgagattttaagtcaagcaagtagctagactagactaatctagatagcttaccatatttatatcttatcttactgaaataatgcacaataattagggaaaaagtaatattacaaaggacaagatttatatacttaataccgttgagcactgaagaaagaaatagaaagggtgcaagggttacaggagagtgtgaacatgtagctaagggatttctcataaatgtaaaagcatttttgttcttaaaaatgtataaaaaccatttcccatcttacaatttgtgattgcattttttggaaaaaaaaaagagaaggaatccacaaaagtgcccaacacaaagcttcgaccattgccgtcccaagcgttcaaattttccacctcgaggcctacgggcggcctgtacgatttacctgttggttcggtcgctccgttcctccggcttccgcctttcctcgtcgcggctatacggctattatacctaccagccaccacaccacccttctcccacacttctccactgactcctcgagatggatcccgcgccggcgacccctcgctggaacctggagcggccgtacctcaccggccgcttccatcaggtacgcctcccttctctcctcctcctcctcctcctcccctgtctcggctgcccccattgccgcctccgcctcatccaccctcgcgctctctctctcgcaggaggccaaggtggctgcggcggcgcagggggccggatccaagccttactccctcgactccttcaggtgattcgccggttaaaatttcgcgcgattttttttttggtgctcgcctcgtggtttttctgatgccccggagttcgtttgaatctgcagccgcggcggcggcggcggcggcggcgctgagagtgtcatcggatcgtacgccgtctcagtgcaggtaccggtagcttgtacttttaggttgtttagctggcttaattggcttcgagcgactacttttttaatggaccgatgctagggtttaggttccggttccgcgcttctacttcgagctcaatggttcgggttaattggaagaattcgtcgtgttttttttctctctacatgtgcatgaactgtaaattgttgttaaccagagtctggattggagctaggaatgttattgaacactgtattttgattttttggactgcctacttccttgaattcaaaaaacaatattatgtaacggtgctaggttaaaattttcttttgatattttggttcatgtggccaatgtagtgtgagtaaatataatttcagataataaaatattttgttacataactcgaatcttctgtttgaatttgagtgattctcagagtttgttggtcggtggtgttcatgacatactgacatgccgtgctaagtacaacatatttgttgtaacaatgtcacaaaatagctgcattttcactatgttgctttaagcagctattctatgaggctcaatattgtaatatcttcattttgcacatctttaaaattatctgaagtaatttagctttcacaaacaactgaaaagtgtaactccaacctatctgttattgatttgcaggagcttttggtcattgatgatttgttatcagctcttgtgggtattgagggacgatacatttcgattaagagagtacggggaaaggaggggtatgttgtcttccagattgattcttcaatggaccttgcactccaggtaaggcctgaagagtacaacaactggatcatgaattgcctccaaaaaggcagatgcgtttggtacttaactctttgggtttttgcaggaattaactcgtcggatttttcccttatgtgaggattttgtcttggtataccattttgtggagtccagatcacatttcaagagtggcctggtcaaccatgctctagctgcagcattgagggcattcctcttggtaaactccctctttcgagccaggaatattttaattaatttgccttgactacaagctttcttatgtttggaaaaggtggcaaaaacgaatatactaacaatttcatattatatagtaaaaacagtaatgcctgaatcatgagttcaagtgttcagttgtttattctgacatggaaacatttgcataaattgtattggtagagagtaatcttattacattatccttaaattaaaagaaggcctatgttttccagtattggtcctcatatgtgtatttggcacgaagttaagtgttttatttgtttatcaggattatcaggcaatggttgctcaactggagcaccagttccgtcttgggagactgtcagttcaaggattgtggttcttttgtcaggtgagttttatttactgcattaattatttatcctgatttgattatcattttaagcacagcaagtcctgatgtgctttttggcagaggatgatgagttcattgaacgcacttgctgttctagtcgagaaagctatctccaataacaccagtggttctgctacacttaatctacttcaaagtcaggtatttcacctctgagatacattttttttcttttgcatctctctttctccaagtacgagaatctggtgggtatgaatatcgttttcagtaggctcctgcaatccaagctgaacagactggttttcttatcggcataacatatttctttaacatagccgatttctcaacattcagttttttgttgccttttcattctggtccacatgattagctctttcatccatgtattaaattgctgtactcctttcaacataggcaaaggcaatggctggcgatagtgctgttcgatcattactggagaagatgacagagtgtgcaagtgcagcgtatcttaggatgttagaaaggttcatcatgttcatatcttattgtctttgctacttatcggttcttacattttgtgttgaagttaacaagcattttgtaattgccagttcttaattggattgtagtgttaagacttaagacttgtttagattaaaaacttaattagcttgtctgctgtattttgataatttcagcttctaatgggcttcattttaggtgggtctatgagggcgttatagatgatccttatggtgaattcttcattgctgaaaacaaatccttgcagaaggtaccgaatgacttagaatttctggcctacttaaattccatcgttctctgcattttcataagactagaatactgggtttgttatattcttaagataatcagaggctttctttgattttgataggagagccttactcaagattatgatgctaaatattggcagcaaagatacagtctaaaagatggcatccctagtttccttaccaatgttgccgccacaatactgacaactggaaaatatcttaatgttatgagagaatgtgagtacactgtccaggtatgcatgattattttctgtggttgcatcactagatgctattttatatgtgtgtgttataagaacacacttgtcttacatactatgcttaggttcccttgtcagagagttctaagctgatgggctttggttcaaaccaccaatatcttgaatgcatcaaatctgcgtatgactttgcaagtggtgaactcttgactctaatgaaagataaggttacaattgttcatagcaaatgcactattagatttcattttcttctgtggtctggattctaattttgttttatttaccgtgtagtatgatctcattgggaaactgcgatccctcaagcgatatctacttcttgaccaagtatggagaaaattgtggagaacatttactctattatgtattattactccacatcagtactctttaaaatccacactcgctgggtatattctattaatacaatgatattgatagtgacaatgcatgtcatgttgtcaacttgagtttaaacacatccatatttattttccttgtattagttctccaatttgctttctttgttttgcagggtgattttctggttcactttatggatattgcccgagaggagcttacaaagaaaccagaagaaatatctgttgaaaaacttcaggtatcctgttgtgcagtattgtctgtctgtttcttgctatagtctcatggcggaaactgatttttgactgctctggtctaagctgatccttctccagtgatatgttattccttcttcgttatatgttcttttgaatgaattgccattctatgtttgcagtctcttgttgacatcgcgttgcgaagtacggcagctgcttcagatccaagtcatgaagacttgacttgctgtgtggtaaatatatcatctatgtctcgtcaaaccgtattgtgttttgttaatcaataatatttctttgtctatttttaaacaggaaagaagttccctccttaagaaattgagcaccctgaaagacttggattgtgcatatccttcagacaagcttgtggcagctgatgttgaccatcccatgccgttaagtgtgactggcttggaaactttctgcctgagctacaaggttctatcttctgatattttttattcgttgttctaccttctgacagagaaatgatatgccaactatatatttcaggttcaatggccactatctctagtaatttcaagaaaatctttgacaaaataccagttgatttttcggctgttgttccactgcaagcatgttagtcgacaattgtgtacagcatggcaaattcaacaagtatgaatgaaccttttcttcacccccattatatcagcttaattgttttctgtttactcgttgactgatgtagaactctcaaccagggtttccgttctgtcaaaatcctaggaacaccagtcctacggtcatcaattctttgccgcagcatgctcaagtttgtaaacagccttttacattatctaacctttgaggtaaagcatccatatcaccatactaactgttaccaaaggtgaaaaattgctaaagcattcttttgggtcatcaggttcttgaaccaaattggcatttgatgcatgatcggcttcaaactgcaaggagcatagatgaggttttaacaacgttcttatgatgaagaaagatgtattgcgaaaggggtacattaccattgctgttgatgttgtttgcaggtcatacagattcatgatttcttcctgcagaagtgtctaaaagaatgcttattgttgttgcctgaactccttgtggttcgtcttcttgctcttttatatacagaagtgtttgtcgctgctgtacgttatattttcctattatctgagctctttttggagagaaaagaattaccagtgttgcaacaactttacctcctcttgttccttttaaaacttgttgctttcttgtgaaagctgaaagtaatcactgattgagttcagaattagatttcttgcgatactggcattccagtaatggaaagttaggaactaggcaggtcagtgatcaggtcatctgactgcaagataacaatggcaacttgtctctttactgttaaagaagaaagtcactgtctttaccacactgtgtatccttagcttgatttgtgtgaattatatcacccggtgactagcagttttacccttagccctctgtttcaaaaatacatggtagtttgttttacactgaaatactgtagaagattcaatgtttattttattcttattattagtatatttgtcatgtgcagaaaatcgagaagctgaaagctctgtgtctccagtatgcgacttccatccagctattgataccatccattgatgttgctaagcctgaaaatacatcaaaatctagaatgccaagatcaaaaataaaagaaaccaaaaacagaggccagcaactgaaattggcatcggaaaatgttgtaatgtcagagtcaatcttgtatgattcacatattcagtctttttcacacaatgttaattttgtatcaattgaacatcatatgatacaatcttggactgtttgctgcaggaaattcgaggcagaattcaattcagagcttcaaagtcttattcctacgctgagtaacagttcacaggcagaaccatacttgactcatcttgggcagtgcattcttggtgtgggagttgatcaatgattgctgcgcgccatgttccgcggacttcagacgattgctaagtttgcatgtgcagtgtggaattcctcatccccgtcaaggcggtgttcttgtgaatgtattgaatattgatgaaatatgcatggtatgcttcaacaagatagatagtactgtaggatttatgtagtgttagttctcttggtggtgttgggccgtgggtagtttaggcgtttctagtttgttctgtttgaagattatgattgaactcctacgaagagaaactgccctgtggtactgctgccaccaatgtaacttgaactagatgtgatgaattagtgacaccactaacaatttgtcttgggccgttgtttccttggaaaatataaaatatgtagtggaaataactatcgttgaatttaaaatgggcgtctgatatttagtacgtacatatgatttgcagtagtacattatttcccttgttttccagccacgtgcgggccgtatggtttagggcccctttgaatcgtaggaatgaaaaaactaaggaataggaaaaacgcaggattctgacaggaatgcaggtgtaaaatagaggattgaaaaatacaggaaaaacacataaatgaccgtttgattggaacataggaaaaacgcaggaatcggatgagagatataaactcaaagtaattttttcaagaggttggacctcttgctaacttttctccaaaatccctataggattacctattccataggaattttaaaggatagtatagtattcaatcctttgtttcaaagggtttcataggaaatttttccatagaattaaaatccttcaaatttcctacacttttcctacaaatcaagtgggcccttaagctgaaacggattcgcagctactacaagcctgcatggggtgcccactatcgtgcggcctgcgacgtgttgggccggaacgggattcacgggaacgtgctgcgtgtaccgacggaccgagcgaccgaccaatgatgcggtcaggctgcaacgaaagctgccttgctacctaacgccgcggactcgtccaccagataaacgtcgggtccatctccgtatcacccgcactggatccggactagtggcaatttgcctaattcactccccatacaaagcataacaaatggcaagggcataaaaaaaaagttcaatgtgtttggtgaatgctgcccttttttgtaatgtcaattcgtggtccaagctgcactagttcaagtcttgaaatacccgtgtaaaattcgcggtacatatacaacgcacatatcatatgctattatgcttattaaccaatccaaactcaaataagatgcgattttcttcaagtctcagcgatcaataaccttattctgggttaatatctatactatgctatattagtatctctgtctcactcgactctaacgttacttaaatactactcagcccaaaatataactacttcttatcctaaagtatactccatccaaaaaatacctttgtaccatttgagtacagtttctggctccatcaccaattagcctaccctcatttaacttttactcaatcctacatgaggctgtgctcggaagatgatgttgggaacaaatcttatgtacatgtaaaaaagagtacaactcattagcatatatttaattaagtattagtttaaaaacttaaaaaatatattataataatttttaaagcaacttttgtatagatttttttagagaaaaataatatcgtttaacagtttggaaaacatgagtatgaaaatcaagagaggaaaagttggaaacctacactactgaactcgaacctaaatgatctcccatttgataatgggcatggtagtttttccctttataatattgtcagtttatcctacaaagtgtatttttcttacaccaaagtgttagcgcacatagattagagtccctttgaaatatacaacttttacaaatatacaatatcttcaacattcctcaatagctatgaaatatacaaatcttacaaatatacaattctttaaaattatttattagcaagttaggaagattttaggcctccatagtttggctaaatatggataatacaccattcgacgtattagcaaaatagtaataatttataggtaaaatttttatatatacgttcttagcgatttaaatatccatattgaaaaataaatttcgatcgaaaaaatttcaaaattaacgatggggaccttaatgccaacagcctgcacccttcgttccattaaaaaaataaacttgtgactacaaacctctggcgacgttccaaaatacaaccatcagtaagattttccggcgacggcgttggcccgccgttggatcgcagggaaatccgcgtccggcgcggcacacattacacatacctccgtgctccatgactccgtgtacccacggacccaccattttcctcgccgcagtaccgcaccgacccgcagttagctcacttcccactcgcccacttcccccaccccactctgcctccggccactgccgtctctcccattccccccaaccccaccaccaccgggaaacaacaagacgaaaatcacacgcggacgcggcccggtcactcactcacacgccgcgggacgagacgaaacggtaaagaatccggcagcagcaagcaggagagcgcgagctcggcgtccccgctccgctccacacgcattgcccgctcgcccgcccgcccgcccgtgagcgcgagcggctggagcgatggggcggcgcgggggcgcggcggtggcggcggcgtgcgggcggtggtgcctggtgatcctggccgtgggctccgcgctcggcgtctccgggccggccttctactggcgctacaagaagggattcgcctcctcctcctcctcctcataggtctccgcttccgctgcggccgtcgtctccccctcctgcccgccctgcagctgcgactgcccgccgccgctctccttccagtccatcgcccccggtgagctcacctagtcccttccctcccctcccgtcagatcttgcaaccgcccgttcgcctgatctgcgcgcgcatagtttgttcgataaaaatccaatccgtaggttgaaacttgcagcctgcaactagtgttgtgtcagatcgatgcgggaatcattgcatatttgcagtgtataagagctgaaatcagtactaagtaataggaaaactgaactaatttgcgtgctctctaccttgaacgcttgtacatcgctatcaggccatcactgactggattttgcaattttattcctttgcagggcttgtcaacttctcaacttcaggtttgagctcttccttccttcatagtccctttagctgagctttatctttatttatccaatattcccatgaaatcggttgagtataattgttatctgatggaagggtggtagcattcgtgcttaagtcgtatgatgtttccgggactgaatggtttggtatgcaacctgttacctgtagttttgggaagtaacctcagcaactattttgatgcctgggacgattaacgtgactaattgagtattagggtagctctttcaattattgtgctatgtaaatgtggcactgttaaaatggggggaaatttcatttgttgctaagagcacccctcttcgcatacagataaaaggatgcgtttaaacatttactacacctctttggtgtgtagcactagtatttgttggcacgcatcacactcacagaagcttaggaccaaaaatctgcctgactctgcatactaaccagattttggtactttgtggcaacatattaacagtatgcacctttaagtggatttcttactggtatttccagaaaaaagaaaggggggtatgactcagtgtagtaatttattgtgttgtgtagaatagttagtgcagataaagctaaccatttctgtaatagttttcccctgaaatacttgagcccctaaaattttgtcttgcctggagccctggacctgcacatactgcttttatgatttctcctaacatctttggtacaatgctccattggatagggaaattctctcgtgttgctctgcaagtagttgttataccttttgtataaacgactacattgctccagtctttctgagctgtagctagtgaaatattttcaattcgctccttcccatggttgaatcaattttgttctaccccctttttcgttcacgacaactgcttgatcttattttgttgtacctcctttttctttcataaaaactgcctgaccttgctggtgccattaagcatttgacttgaaacatacaggttgtggcaaaaatgaccctgaacttagtaaagagatggagaagcagtttgttgatcttcttaatgaggagctcaagctgcagcagattgtagctgaggagcatagccatcacatgaatgccacccttgttgaagctaaaagacaagctactcaataccagcgagaggcagagaagtgtaacgcagccacagagacttgcgaggaagctagggagcggtctgaagcggcaatttcgaaggaaaagaaactcacagcattatgggagcaaagagctcgccaattgggttggcaggactctagacctagagtcacaaccatttgatagcttgacatgtcgttgtatttcctttttcttctacaggtaaaattatttttggtagctgctggattgcatcctgcagccaaaccgagcagtgttaattgtacggctccacttgtaatgtatgtctatgtattatcatcagctgtgccaagagcaagaatatcatagttaaatgtaactagtatacatttactcaatgttcggatttattgtgacataccggagatatgctgtggaatgtggatgacacactttgtttatgatgcaatgtacgcaattctagtcttagctaacttaagctatgcttttgttcttgtataacgaagtatataaatggcgcataatgcattcttccctatgatttgttttatgggacattagtcatcctgtgcatttgctccataagtctggttccaaatagtgatatttacatggttggaaacctgacagatagccaacatctgtgttatgttggtcaacagaagtgtattggaacacgtgtgtagcaaacttcattttagcggtgacagatgagttcctgtcttcctagaggaccttagacatcaattcgtttaaaaaatatttacacatttgcgttgcgtttaaaaaaattaaattgttgcgttgtagcaaacatcatcattgtgtgaaccagatgagttagttacaaggacggacaaattctcaatactcttttcaaaaaataaaataaattctcagcaacttttaaagaatggaaccggaacaaagttctcaacgaataaaaagaaaatctccaaaacaaaatggcaaaatcaaataaattctcagcaacttttaaagaatggaaacggaacaaagttctcaacaaataaaaagaaaatctccaaaaacaaatggcacaattcaaaagttatcaacaaataaaaagaaaatctccaaaaacaaaatggcacaattcaaaaaattatggcccatgcaggtctcgaacctgcgaccttcgcgttattagcacgacgctctaaccagctgagctaataggccaattcgataaatttgtgttatttactgtatgcaaggctattggccattatcctctctcgaacctacgttaccctgcacgcttgtgtattttcatcatcgaagccatgaagatcccacgccgagcgtaccggcctctgaatctcatgagccacatctcctcctcctcctcctcctcctccatggtaataacacggagcgtaataaccgtagtgccccacgccgccgcgcctctgaaactcatgagccacatctgctgttcctcctcctccattgtccggcggaggcacaggcaccagatgatcatagcaactcggaacgtaagcgcaaggcacaggcaccagatggtgatgatgacgatgatgataatacgggacgtagtagccgtgcctctggaactcgtgatgagcctgcgcatctgctcctcctcctccgccttccccgtgatcatcatcttcttcctcgagagccaggatctcgaccttcttcccggtcttcttcttgatccgcctcaccgccttctccggctcgaagtcgccgccgcccgtcaccgtcaccttgttctctcccctctccacctcgactttctcgactcctgcgtaagtgtagttggtcgaaatctcaggtaatatgctttgagctgaagattaaataggatgtgtcttttggtggttttggtttgttattaattagtaaccgtcgattttctctatggctcggcgaacagatcgttcacaggctttgcaatgcatgtagattctcagttctagtttgatgctctgtacaaggaaaacaaacagtaagacggtgtggttaaacggaaatgatggtggtgattaaattggtgctttggagttcgtccatgtgcgtagtatgtacgagttcgcaacttggaaagaaaacttacgttcgtggagctagcattttcttcatccatgatgccggcctactgaacacggtacggtaagatgtagtatgaaaatcaccctgaaaatgtggaacatgtagtcaggtagaaagcaaattcagatgggcagaagtagtaaaatccataatatggtttcgacattccaatcaaagtcacatgtgaaaattcttcttttttttggataagaagtcacaatgtctttgaaccacaattataaattcccaagcgcatttcatgcagattaaccaaagacatacagtcaatcacaaccaatgaaaactcgcatgctggagcaaaattttcagaaaaatgcataattaagtttcatgcatgcaaagttagctatcctccttcacctggtcgtctcattcatcaatccatgccgatcgcgtgctctctcctggccaccgcaacgcctgagaaaacgcgaaagacctgacaattacacggattggtagaggtaataatctagctgttcttgcgccaatgttcagggaagaaagagaatctcttctattgtacccgctctcgctgtcctaagaattcgatcgaccctgtttgggaagtcgcattgaccatcaaaccacttctcggccgatcccgtcgggaccgggttgtctatttatgaggtggtaaagagtgataggactagaagtgggggagaagaggtcgccggaaagaataacctgctagcttcacgcgatcactcccggccgcagcctaaattcgcgtgtcgttgacaggaggctcctcctctgaaatcttgtggcagaattattcctctgcatgcggttgttgcggcattgttcctctgcataagaggcagcggagacggacggcgtcgccgcttctttggacgggcccgccggcgagagcgcgaggacggggctcgccggagctccgggccggtggtggtagggacggaggttcgggaggcgggggagaagaaggctgtacgtaatgcggcccatggttcctgggcctgaagtagttgtgccgtagcaggaggcccacaaccgcggcgacggggttgggccggaatgggggttttcacggattattttttttcatttttatttactttctaaatgtttttaaaaataaattaatttttcaaagttttgcaaaaatatactcctcccgctataccgtatagagcggaacatataaaacgtcctcctctcctacaataggatggactatgtgacgtagcacaatgcgaaaggacgtaccatggtgattttgcaggcggccctcttcgcgtcctcccaaaggcgatttagtttgcggacattagcaatagtgtgttgatgtataggatacaccatggtaattttgcatacaaccccctccaagtgataaatcgtcttaggggagggataaattgctctagagaagatcagaagagttataaggagccccctacaaaatcatcatgcacgcccctcttgtggagcatcacatcatatagaatgctttattgtacgttgatttatatgccttaccttacgatagaacggggtgaaccgatttatatgcaccacccaacggtaggatggaatgagtttatttcttgtaaaactttgaaataagaatttatattttaaatcttttaaaaaataaatataaaaataaaatgaatcgttctcacgtgtgtgacgtatttttttcagccagatccctagtttggatcgcgattattcgttgctatccttaatttcgcgaagaagccctaattttcgatcatggaatttttcaaaaacgtactccaggccagtagaccaggagtgctattaatcctgtaactttgcaaacgagaccctatttggatctttattattgcttacgatcctcagttcagacttcagagagagccatagccagcccgccgctccccgccgctgcctcttcgctcgtctccgtcgagtccgtcacgcaggtaaaatcccccgccgctgactcgcgcgctgatctcgtgtgtgttttggtcccgatttgggccgagtttgatcggcatgccgcctgggtggtgttgattcgggtggccttccgcaggggatagttggggggatcgatccactggttctcgaactgccatagtacttgctttagaggtagcggtttcacttgtgtgatcgaccaatcagccatttctgctcgattaaattcggccagacctgtgtaaattggggtttacgcgaaccgaggaggtgttgtagctgtgagtattcatgccacatgcccacattgatcaaattatgctcttcaaacacatgaatctactaaatttagaagaaagaaaaaaaaacagaggggctggcaatttcatagtggattcatttatttttgtcatctcatttttctaagttcttaaggaaatgttgtgcaaattaagcagaaactgtaataccccaatgtggtttcgtattagcacctgtttgtgtgacaggagattctcagattttagatttgaggaccatcaatccctcactacttcactagcatctacttgtcatgggataaatctgaagtcccaagacctgtataaacgaaatttctccaattctcatgcagatcgtagtaaactttggtctctttgtttcatccagatcgggagaggtttgacagtgcaatgtaatcgataagcaaaaccgacagatacaccaaatggcacgcctgtgcagcttcttgtttgcaatgatgtgatctggcagaaagaaggcttgttggttgagactgcagtagccttgggcagatacacttgatgatttattgatgcagaaattagtgcttagcaacataatgttgtctgtgtactttattaagctaaatggacaataaatatgctgatacaatcagcatgccattcctcgaaacgaagtactaaagagaataaatatcgaagaggtttttcagcaaatagctatgtcttcctcgatgagaagaggtaggagcattatctttcatagttgtttgaatcgagttattctgaatccctgaatgttgatgaagcttctatgcctaatctgcagcaaacccaggagttagagcagtcaggaagccctggagagaaagcagtccaaggctccaagctattagttttttcaagaagagaaacctgtgaccttttggtgcaatgtcctctttgggagatgttctgcacaacatcttgtgaattgtgatgctagatttcatttcctgttgcttgctttgcttccagctgactgtatatacatataggtgctggtatttctggctctgtgtgcagcagattgcttgtcatgtgctttttttttttcagaatgctctactgattacatatttacatcttcccagaaatcttgtttatcaaagtcagatttttgcacattttttttggagagatcctttgcacattttactcgtctactcatctgacttataattatttttttatcatttcagcttggtttcatgactctcatctagcacaagctcccggtctgactcaagccgagtgggctgggcctgggccgcatcacgcaggcacacgagctgggatgggatcatttggactcttccagttcgcgccttatataatgacctcacgcacgttggctcgtcaatcatcatcggagcagacacgagagcggcgatctcatctcaggcgcaacgctctgcaagtctcggagcgctgccggagctggtcgctgcacggcgagctattcggcgatggatcaggggagctcttcgtcgatgtcctcgtgctcttcttccacgacggcgtctaccgggcccgatcaaagaagattgtcggcggcggcaccgacgttcgacccgtctatggcctcgagttcgtccatggcggctacgacggcgggcgttccagggagctcgccggcaatggcgcctctgcttacctctgcgaggatgtcctcgggctcttccgcaagttccactacttcgttcgacccagcaggatcgtcggcgttggcacctgcgcgctccccgaggcctggattgtcggcgtcggcacctgcgttctacccgacgacggcctcgagctcttccacgccggttatgccggccgttccagggttcttgccgcagattcctgagcccaccgcttcttgttccggtaagcttcgaaaggagttctttgtgtatctttttgttgtttcgaattgtgattttcttcctggttcttgtggatcgatgaatcctttttgcttcgattcccaagtgcttatcttggctctcccgaatcttttgatctttgggttctgcggaatctttcatggttcttgttttcttgttttttttttggctcatcttggctttcctgcataatcaccttcttgttttcttggttctgggttttaactcttcgtgtttatttggaatccttttcttgaaggagacaaaacgtgatatttttttataaaaatgatattagcgatttcactgatgaatctttgagaattttcttggtcctgtatgaaaaaaaatgccatcttttgtttgatgttcggtagtctttcacattttccttgccttagatagtttgctgtcattttatctcgggcagcgattaattatcgtgatatcttgatcagactttcctccggagatgctctggcatcatccttgtggagaacagaagatcaaaggaggacggccggaccttcttggtcgtgagtttggtattcttgctgaacagaagaggttgattcagagacatttagatctgaaagaagaaatgcatttgcgccataacaaggagatcgagaatgccttcatttcggagacaaggctggcccggggtgtggagcaagatctgcttggggactgcaagaaggccgtgctagtgcagcaagatcaatctggaaaagaagaagaaagtcatcagtgcctgaggcagctgcaagacgtcaacggcgagcagcttgtgggggtgccgaagctggtaagtctggaatcaattgaactaccggtaatgttgaataggagggttattagcatgaattgttgaatttaggaaaaaaaacaacaactgcatctggagatattttaaaacataagtacacattacatgcttgagaaatatgcagatttgcaagtgagtcccctacagaaaagctactgttacactatcggtaatgttgaataggagggctattagcatgaattgttgaatttagtaaaatgacaccagcatttggatatactccctccgtttcatatttataagtcattttgactttttttcctaatttttttcgagaatgcgcaaaagatttgcgcatctttgtattatgattagggaattaagtcaacaacttacaaaccaacctgaacagaaaaaagaaacaaagagaaactttattaagtttgaccaagtttatagaagaatttagcaacatttaaaacaccaaattagtttcatcaaatctcattgtatatattatgataatatgtttgttttgtgttgaaaatgataatatgttttgctataaactttgtcaaacttaaaaaagtttaactaaaaaaaatcaaaatgacttgtaatatgaaatgaagggagtgttttaaaacaaggaagaagtacacacttgagaaatgtgcagatttgcaaaattgcaagtgagtctcctataggaaagctactgttaggaagtatagttgggttggcacttacagcttaagacatgctttgctgttatttgtcagggtcttcctggagctgaagaaaacgttgcatgcaacaacactgcttcccataaagaattcagtgaatttccaggtccagatattaaggtatatccatgtcacagaagtgtcaatgtcagatactgcaattcatggcagcttggaaatagtttaccgacattcatgcctcatgctgcttagaccatcttataaaatgctgcaatagtattcaggtcatcttgcaaggatgataaccatatttacgatacgcttctgactgcagtttgggagcatcaacatcagagatataccattgctgcagggaaggcaagctgcagttattctgcccaatcctcagctagatagaagaacttccggtttaactccagctggagccagttccctggatcaggagacagatcaggagctgaatgaaaagcttttgtagtagttatgaaatagttactcagatcgtgctcctgtggacttgtgcagttgtgttgtgctgtacttacaaatctgtcttaaattgggcatttgtcatgctgaaaagaatccgctgaagatagtggtaaactggtacacaaaattctgtcttgaaacacccattaggccattaggcccattagtcagcaagaacatgttgaaggcagtgtcaccctgctgtgcattatataactcagaatagcaagtattctttggctgtttgtactgaacaatagctctggtagctacattctgtaaatttttttgccttctggaaatgaaaatcagcaagaacatatactgtcaccctcctttgtataatgcaatgtagaaaagtgagtattctttgattgttgtactgaacaatagctcttttagctacactgtgcatttttttttgcctctggaagtaaaactatgaaggggtctgcagttcatcagtgttaactgcagcagtgcagcattgtaaaaggtggaataattaattatttgccactcttacgagtggtgctaaatgatttaccactggacccacatataatagacacatgagggtccacatgttatagacagcgagtggcaaataattaattaccaaatcttaagggtggccaaaagttaaatgtctcggaaaaggttgtttctctccctgataggcctataatgtatctgcctcgttaaggcccgtttttctcaggctaggcctggcccaatagccggcccatgctaccatccacgagttagatcgagcgcagcagcagaaggatcccttcccatttcctccaccttcctcctcctcgactgactcccaccttcgtcagatctgccattaccgaagccgagcaagcgaggcgaggcgaggcgagcggaccccatggagcccggcgtgagcatcgagtccgggtcggcgatccgcgtggcggtgctgccggtgggcgggccgatctcgccggcgcgcctccgcgactacgcggcgctggtggcgcggcacgcgcgcgtcgacctcgcctcgctgcggccctactacttggagcaccagaagagccccttcgcgcaccagccgtggggcggcggctgcctccgcctcaagttcgtgctcggcggctgcgtgccctcgccgtgggaggacttccagtcctcccgcaaggtgctcgccgtcgtcggcatctgccacctcccgtcctcccccgatctcggccgcgtcgccgccgacttcgtcgacgccgcgcgctcctacccctccgcgctcgccagccgctgcttcgccttctgccccaccgacgcgcaggtaccttttgctaccgctgctgctgctgctgctgctgctgcgtctcttcccaaacctctggatcacgtggttgttttggtagtgcgcggctcagcaaccactcgtgaattgagttggccatttggttgtggagttgctatactgaatacgtgtacctatggcttgcgcattgggtagaacctggcagcttcagagtgttccgatgcttgttactttcgggtgagatctgagtatctgacctctcgatcatgcaatccacgctgaactaatacactgattctattgcttgagagttggcgattttgcatcacagcagctggtctcgtggtgttaattcagccatctatgtgttgttttagttgatgactaggctgtgctcagttttcttgtgatgcattccgctagcatttctatccttaaactaatgtgtacttgtttatatcatcatatgccagtctttcttgcataatcatattaaacttcaccaaatcttgtatctacattccttgtgtaaggaactagggaaggtcatgatttactacgcaccaagcttctatgtagtgttgctatgttgatggattatattcatagctcttgccccaacgttctgatgccagccttgatgaattgtttatttgatcactccatgatctgatgtgattattatttgcattgtttgttctgtagctggtgcagaaaaagagggataatattattatgttccctccttctgatcaacaatcgttggaacttcatatgctcacgatgatccaagacctttctgcttcgctgttgatggagtttgagaaatgggtcttacgtgcagaatcaacgggaactattctaaagactcctttggattcacaatccagtcttggctcagaggaggttcgtactttaggtgttccgagtattttgactagtgtatgttgatgacataatagtacaacatttattgattatatgagataatatgcttccacattttctaggtgattaaggctaaaaaaagaaggctgggtcgtgcgcaaaagataattggagattattgcttgttggctggatcacctgctgatgcgaatgcacattatgccactgcaatagagcttgcaagattaacaggagatgttttctggcatgctggagcccttgagggtagtgtctgtgcattagtggtaagcatttgtatgccttattaagctttgggattgaaagcattccttgtatcagatcatactgcatgatagctgtaatgttatacactgcatattcagtatgatagctgtcatgcttatacactgcatcttcagtgttacttgacataagatatctagatctaatgtgagaaacactgcacttgaaatttccaccagaccccactttaaccccacccaaattttctttgggtctagattctccaatgtctgaaacttttataatgtttaactccaaacaacatatttcgaggacttgttaaatcattgagaaagggatccaacaattacatttccatttctttccaatatgctgagaagtgaaaactggttcattctcgcttcttttcctcacctggttagaacattcccatgacaaggtttggcgataattttatgcttataatcaggttgataggatggccgaaagtgaccctgttttggaggacgaagtgaagtttcgttattacaccattatccagctatacagaagagcaactttacaagacaatgctcaaaggtattgaatttgtcatgtcattccttcacataatgattgctttacccttttacatgctcaaaagtatgtcacgaggcacaaatgaaagaattgaattatttttatcccttttgttttttcttcttagctttgctgaaaactggatagaggattgcactccctgaaatttttacttggtgaatttacttaataaactaatatgtcatttgcacttgttctttttcttccttagagtttcaccagtcagctttgagcttgaagctgcattgaagctggcaagatatttgtgcaggtgagtctccctattattatatgagcagcacttggttagccaggttctttgtgctatattaacaattgatttctatagaatgaaaatcccaatatctcctttggtgcttgagtagattcttatgcttctttagttataattatttgactggaaaaactagggtggaatgggggtctgagattgttgaaagtatactttacttaggtttgttttgtccattgaattttgctctttctttataaggcggcaatgtgccaaggaggtgtcagatttactaatgggcgctgccgatggtgccaaggctctgattgatgccagtgatcgcttgatactctatattgaaatcgcgagactttttggtacacttggttataaacgcaaggcggcctttttttcaagacaagttgcgcaattgtatctccagcaggataatgcatatgctgctatgagtgctatgcaggtcctaaccacaactacaactgcataccatgttcaaagcaggaagaccagcaaaatggatcatggtttgctcaaggtgagattttgagagcttgcagcattgagaattatttccattattcagaatactgcaccatattcatatgttctcctcaacttctccaaacatgcctcgcattttatcaacttggatactgctttactcagtgaaatcatgccatcatcaaaatgtgctttctttttatgctggaaatttcacggaaataaactttgctatgctagtcacgagttaactgcacaacattttgccttttattcatctttatatattagtactccctccgtctcattttaagtgcaaccatgagtttccatgcccaaatttgatcgtccgtcttatttgattttttttataattagtatttttattgttataagatgataaaacatgaatcgtactttacgcgtgacttatgtttttaatttttttcaaaaaattttgaaataagactgacaatcaaagttgggcacggaaaatcatggctgcacttaaaataggacggagagagtagttgctttccttttatttctgttgatgtggtgagcagggtagaataaatgtcgttgacaagaaatataactcaatttaagcattttaggacgggtatcaatggttaagaaagatacatgaaccccaatgcaaactgtattaatcatgttagtaaacattcctgctttattaaagagcatgtgagcactttgccagcatatattttttattttatggtgctcatcttgttataccagaaatgatcattcagatatcattcgtttaatcacacaaaggacgagcgtaattattatattgacaaattggtgttgagtttatattttattttacatataatgataatgacgtatattgaatagttttgcattcatagctttactggttatccttatttgattctggcaatactgatcctggaaaattgcatcctcagtctgtagtatcactatttgagtcacaatggagtacccttcaaatggttgttctaagagagatactgatgtcttcaatccgggctgcggatcccttatcgtcgtggagtgctgcagcccggcttcttcggtcattttacccactcatcaccccagctggtcagagtggcttggcaagctctctttcaaactcagctgataagcttccatcgggcacacgttgtgccgatccatgtcttccttttatcaggcatgtcaaattaatgaatactcttattgctatgtttggggaaacttaaaatagatactgtaggagtccttttattttgttgcaaaactgtaggaactactgttgaatcaggaagaagattttgatcgagcatgtttctttatttgttttctgagtttttatttctggtgtcctttttttaactcaggttgcattctttcccactgcacccttcacaaagagagatagtgaagcgcaatccaaataaaaaagagtggtggactggtggtggtccttctggaccttttatttacacacctttcaccaaggggggaacatctggaactagcaaacaagaggtaaattggattgtgggagagccagttcaagttatggtagagttagcaaatccctgcagctttgacctaattgttgagagcatttatctctctgttcattctggaaattttgatgcctttccggttagtgttaatcttccaccaaacacttccaaattggttctgttatctggaattccaacacaagttggacaagtatcaattcctgggtgcattgttcattgcttcggtgttatcacagaacacctattcaaagaggtcgattgtctactccttggagctgcacaagggcttgttctttctgatcctttcagatgctgtggctctagcaagtttaagagcgttaactttccaagcatttctgttgttcctcctctgccattattagttgccaatgttgtgggcggagatggttctattcttctatatgaaggtgaaatccgtgatgttttgataacactgacaaatgctggaactgtacctgttgaagaagcaaatgttgcattgtcagggaagaaccaagattctgttatttcgattgcccatagcacatggaaatctgcacttcctattaaacctggtggagaagtgacattcgcagtgactctcagagcctggcatcttagcccgacagatttggaagcagatggcagcagatctcctgcaaactcaaggaggatagcaagagaagggagtaatcctttcttggatattcactatgctggtgggttcttggtgcaacattcaattttattagtgcatcgaagtcacatcagtttaacatattcccatccatatgcatccctaccaactgtttttatttatcctagattcaaatgtttcagcaaaacacagtaggaattagctgtaaggaattaccatagcaggatagaaacagataggcaagtacgagtagcttgtttactactacatccgtttcatattataggttgttttgacttttttcctagtcaaacctttatgtttgacctactttatagaaaaatatagtaatattttcaactcaaaacaaatatgttatcaaaatatattcaatgttacatatagtgaaacttattcggtgttgtaaatattgctattttttttataaacttagtaaaacttaaagaagttagactaggaaaaaagtcaaagcgaattataatatgaaatggagggagtatgtgtgttaaagccccttgtcagttgttatttattctcttcgatgatgtttacagtatttctttctctgaaatggcgatgctcactctttagcctgtcttagaaatgcataaccaacaaccttggcctttctaagcataaacaaatgaaatgtggagagtattcttttttaatgatcagttaggctgtctacagtcttgaggaatgaggactgaatttcgactttctgccattacaggtccttcagggaactctgagagcaatgatgtttctctcccacctggaagacgtctggttgttccgttgaatatttgtgttgtacagggcatgcgacttgtaagagcacgcctgttgtccatggaattacctgcccggtttactgatgctcacttaagatctgtcagtagcaaggacaatctaagcaatggcagtgatgcgattcgtaatgacattagcttattgaagattgatccttataaaggaagctgggacctccgtcttctggaacttgagctgtttaatcctactgatgttgttttcgatgttgatgtctcagttcatctcgatggcacaagtgtcgagcaaaaaattcttccagaggataaaacggccagttcggcttgccacaaaactcgaattgatcgtgactactctgctagagttctcatacctcttgagcacttcaaattacctgttcttgacacttccttctttgtgaaggaaaatggaagtgatgaacctcttggatccagagctgccacgttagcagaaaagaatgccaaggcggaactaaatgcttcaatcaacaacttgatttcaaagataaaagtgaagtggcattctgggagaaatagctccggtgagctgaatattaaagatgctattcagacagcattacaggcatctattatggacatactgttgcctgatccgctgacattcagctttagacatgccaaggatggaacaacagccaaaactgactcttcgaaggagcctggtgacggttccagtcgttctgctgatgagagtgttctgaggtgtaaggatcctatatttgctaatgaaatgacccatatggaagttcaaattcgcaataacactaaggaaactattcggatgaacctaagcatttcatgcaaagatgttgctggagagaattgcttcgacgaaaatagcgcaactgtcctctgggctggtaatttaatgatgacattatctttcctgctatccttgtctgttttgacattttgttttctgaaggcagcaaatgatcacggttaaggaagatcacaatatttacattttgattagtttttggctttccattgaaccaatccgttaggttacagtttgtcattgcattctgcccttaatctgttcatctatttactcacaaatgtcctttttggtgcaggtgttcttagtgacatatatctggaggttcaaccactgcaggaggtagtacatcctttttctatctacttcctggtccccggagactactcgctgcaagctgcttctgttataattgacgcaaccgatgttcttcgtgctcgggcaaaggcagagtcgcccgacgaacctatactatgccgtggatctccattccatatccatgtagttggtacagcttagccggactttcttggatttagtctagagcgtgccctgtatcgtgcgtgagtttcgtgacatgtgcagctgcgaagatcatgtagaatttttatgcacatctgatttatttgagccgcatgaaggcttccctgtaacacagttgtgttttgtacagtgtaaaagcatagtgaaggttgtttcacagacgcgcgaatttgctggttctggtttcagcatctcgatgtaaattttttctgtcctacgaagaattccatacgtatgagctctcatttctgccattaagaaatgatggggatttaaaaatttcgatgcatcaatacaagttgaaatccatcaaccatcgattgttacttttcatacgcatggatagtcatttctgccgttaagaaattgttggggttttgaaattttgatgcatcaatacacccatcaaccagcgattgtttaatttctttgcaaacagtgacaaggacaataaggcaaaggtcaagttgtcaaagaaggctgcatccctagtcttgtgatcaaatcttttatatgcttcttttcaatcttttatgtttcttgggcggaggtcctcactggcatgcatttgtttgttgcttgaagtacagcctggcaatcgccttgaagagcaggagcttcaagggaagccttcgccggtgtctgagctactgaaggtttgtgtagaggcagataagaatgttttcaaattactaaccttgcatactgcagtcttatgttttgaaatggacatgataaaagttacgaaatgctctgattgtcttgacaaacttgagcagtggcgaagtcctacccctttttgtccgtgtgcaattgcaatttgtagcttgcacaaaactttcaatgggtcgtgcaagatgatgtgaacttctgacattcctttacttttgttttcatggtcataagtgtgcaggattttatgccctccgcaagttgcaaaaggtagttatagaaatagaacgaaatgaggctcgactggagaaaatcgctaatgttgcaagggcggctcttacgaggatgaacaatggggagacactatctcaggaggagatgaaatcgtaccttgaagaaattattcgtttggctagtatctaaggaactgatcccaggatagtgtaatttttcatcacctctgtaatactcctatgtcatacgatgcgtaatcaaacattgcaaatttgcaatcatatgcccctccagctagatatttggttaactgtttatttcttcaactctataaattagttgtacttataacatgatgcattctgctttaattctttaaagtaaaatattctcgtcatttgaattcagagagtaccagcctgtaggacggcttagctttggtagcacggtaatcaggcttaccaagcttacggagccatcgtttcgcttattcgcggaataaatgaaacggcatatttgcaaacgaaaaataagttgtgaataaaacttttatatacgtgttcttggcagtctagaagtaaaggctggaaaataaacttcgatgaaaaaaacctcaaaatcgactccaaatttaaggttgaaaattaaaattttgactgataaacataagcatagcttttgcttcgtgttcgtataatgtttgaactttgaagtgacagaacgaaacaaacatcctaatcgtaaggcactcgcatagtatagcgctcgttgtgccggtgccgttcacaatcacacacgtgcaggccatgtacttcctagtcacgattactgaaattatctcaaccaaattggggagacgagctttttttttttttgatagatcttcacatcgtcaagcattctacaaactatatgttgattgaatgggaaaacgatcagtacacagacagacatgggcgcagaaacttcttaagattttaagcttgacaagtaaagtcaagtcaaattcctagtacagaaaggtaaactcttgtctagtcaagatggtagacacgagaaagacatctaggtggcatcaaaatctcatgatcaaagctttcagaaccctgaatatctcctcatatacatcttaagcggctgtgaaaaccttcttccctgcaccactctttgaccctgccggaatgaccttcagcacattgaacctcacggtctttgacagtggcctgatattaaacagatagttgagtaatttgtggatttctgggatgaagcacacaaaataactgtactttacttggctaagattagaaaattcatgctcaaacattcaggtttgtattcactgaggtacacaacattcacaggtcaaagtgagccgtcacaaaaacattcaaaggaacatgacaagctttacctgcactggccaatgatcacgtgatctccttccttaacacggaagcacggtgaaatgtgagcaggaatattggagtgcctcttctcgtacctgcatcagcatcaataaaattaattttatgaacaaacagcccaatgaggcattatagaactgatacccagcaaccaggttaacttgcctctggtacttcttgacaaagtgcagataattcctccgaacaataatggtcctgttcatcttagcactatgacatgttccagctatgatacgacccctaattgatacagtaccagtgaatgggcatttcttgtcaatgtaggttcctgcaagaagtagcaaactgaggatatgcagaaacctaagtagttttaacagaggaactctagaaccaggcatctaaagatatcttccaggactagtaaaatgtcaataggaaacaataataggagtaaagatgatctcataagtcgtaactacacaataaatggaaattaccaatactctttagttttagtgaatgctaagcttcaagcctggcaaggtgaaagcatttgggcagctactacaaatgttttaagaaacaatcattcatgcttgtctaccaatgagcacaacaactataaatctgtcttcttaactacaatagaggcaaattggtctacaactagagcacacaggttaagacataagaacaagaaaactgcactgggaactaagatttattgccttaatttgaaaagagattggcatattactgagcgatcatcaaccagggtggaagacaaattcagagagcaggcaaaccatgctgctcctgttcaattggaaatgtgtacagatagaaacagtagaattcagtgttgaaatctaacgcgcaataactatatcaacctggacaaaccatacaagcaaaagatatgtttagttgtttacaagccaagaattaacaggaacataatcagaccttcgatggcttccctgggtgtcttgaacccaaggccaatgttcttccagaacctattcccgcccttgccaggcttcttccccttggtggttttcttaggactggattccataacagatcatgagccacgtaccacaaatacaaagaaacagacgcacaaaaattatgaataaagaacttgctcttaccagagaaaaaccttaggctgcttcaagaatgccctctcagtctgcaaaaacaaatgagcaaagacgtttaatttctgttaaacctacagcaactaataacataatagtccatctaccaatccatctatacagcgatcaaaattaccaccagaaggtaacaaattctagagcttaaacaactgatacaatctgtataatccacctagccatttcgcgctagcatgccattagagactgcggcattccaacagctatgcaccaaaatcacaacgctacgcagaaaaaaaaaatcaccaaccggactgcacccgcacgcactagatcacctactaccacaacgccgctaacgaaacgagatcttaaacacgcatgcaagagaaaaacaaacaggtcacaattgatagttgatacgagcaactcgggaagggttctcacctgctccgccatgatcgccgcgcgaggaagagacgcactggcgcgagacggcggcggcacgggaggagcagcagcggagaagaagaaattcccgaggctttagaaccctagccttcccctggttaaatccgttcactcattacacggtggcgtgaggcgtccaagcagagtgggccgagatgggcctgaaacatctcggtgcagggcctcatgctaacatgggccgcaacttgagttggaaataaataagttcactctaggtccctcattgacatcaagtttgaattaggtcgttaaactaaaccgctaccagatgtaatgcatccctcaacttgtaaaacaggtgtactcgagatcctatgacagtatattgtctgattttagttaacgtgacgagttaattgggatcgatctgggttccatgctgactcagtcggggtgacagtagtcaacttgtcacgttggccaaaatcggcactatactactctggaacatcgagtatacaattttctacaaagatgagagatccaaagtaaacttatttcagttcgaaatgcatcgcattgctggttggcccataactcttaccggcctactactatatttgatgtggactcggttctgcacagcaggaacgtcggaataagttcccttgtgacccttataagtgtcgaaatttaatccgtgaccataaactacaaaaccggatatctcgactcataaaacagatatgcttgtctaccaatgggacataaagatctggcaagacgacagctattggcctaccgctgcgtgtagatggccgcagggtccaacgaagtagcagagcaagcttggaattgagaagaaaacatccctgcggtccagcaaaggcgatgtcgcaggcttgctcgccgcggatcctgcttggtgcggcttggtcggatcaccgatggcggctgttgcttgccaccgcctggctagcgcaccgatgctgccgccgctttgaccctcgccgcccgtcgcgggagaaaaagagagagcggcgaggaagagaaggaactggaggaaggagagagagaagggacacgtgagtctcacaatttcttttgcgtgtcaatgataaatcggtcccacacatatttttaattctaaacgccacctaaacgccatgtcaatcccacgtgtaaaggagacccggtcaataccgctacgtaggcgtcacgtcagcaaaaccgtcaagggagttaaattgcaccggtcttaagagtttagaggtcgagatattcagttttgtagtttaggctcacggattagatttcgatcatttttaagggtcactaagtgaacttattccccgtaacgtccccggagtggggtggtggcccaagcctgtagtatgttttgtcgtactgtagcatctaacacaactacacaagggacaaacaggtttaaaaaaagaaaaaaatatgaaaacaccaggacaaacatcaccagctgcgtctttattgctcttggaattgtctcatcttttgcatcacgaaccgttgcatcaccagctccgtggcagggggatagtctagacatgacatcgtagtagtctggtttgctctgagaagtgagaacgcattttcgcgtccggtgccggtggaaacgaatttaattcctcggcgcacacgaagaaaaaagctacactccagcacgccagaggcagtagcaacaagccaacaaccggacaataaccggtgcgcggtggagcctacggatcgacgacgacgggtgcgggagcggtgtcggaatcggcgagattccaagaaagcgaggttgggcatgggatcttgcttttgcggctctcaatctcaccggtgtttctgcgtgtctgccttttttttaagctaaaacttattttaagaatgatttttttcagcgccaaatcgtatagtgctgaatttaaacatatcagcgctaaattgcacgacgctaaatacacgtcagcacaccgactcatcctcctatctgcggtggcacggcattcagcgtcagttgacgtgggatttggcgctgaacaaaaggatcatttctgaaataagtttgggccactgtttatttgtaaggccccgtttagtttcccaaatttttttcccaaaaacatcacatcgaatctttgaacacatgtatgaagcactaaatatagataaataaaaaaaactaattgcacagttaagaaggaaatcacgagacgaatcttttaagtctaattagtccatgaaattagtctagtggtttttaggcgagttatgaaattagtttttttattcgtgttcaaaaaacccttctaacatccggtcaaacatccgatgtgatatcaaaaaattttcttttcacgaactaaacgtaccctaaatttagttcttgtaaagggtcattgtcaaaatctgtgtgtctgccgcgttgcacttccaaaagggcagaaaggcgagagagaagtcagagaacttgggacaggtgggcgagaccgagacctgccgctgctggcacccgtggccccgtgtgggcaatggaaaggcaggcagacagcgcagcgtaggcacgcatgcgcgcgcgtgccggatcgccatcgatcgatcggaagaagcgaagctttctcgctcggcgccgcccagggagtttgttcaccgacagcatcatgtatgcgccacaatagcggaggacggcggcgccctgcctggcggagaggcccggccgggcgtggttctatgggtgcgtgctcttggtagtggcctgcctggcctgcacttcacactgtacgtttgatttttggttcccttgcgaggtggcaaaagataggtccagcttgttcaggtcgttctcgttcgtttgaaggatcacacaagccattaaggcatgagcttaaacattgaccgatatttttgttggagtatgacaaatagtcaaacatcacgttagaagccaatagcatcatatattgaaaaatgaaggaagtacaaaattgtttagagagtgtgctctataatagttgagatgataaaggctcccatcggatggcctaatcagccaaaaaaaaagctaaaatttgaattttcaagcttaattttgagattgattttgagatattttcaacatagtttctttttcaacattggctttcaagtcaccaagaacacatttataaaaattttacctacaaattcatttttattttctaataagccgttttgacttattaggaaataagccaaacgatggggactaaaggatctaattattaatagaaaatattttttattactgttgctttatttttctcctatcattatgcaaccaagtttacattttataaaatttaagagttgttgttttttttgataatggaatataatatcccggtctttgctcaaaaagaactacaaccaattattacaaagatccactccagaagagagtgtagttcaagacaagttgaacacaccaaacaagagaagagaggacctaaactgagaaaagcaaaataaaatgtggagctagaaggcctcgtcaaggcctaagactgaagttcgaagccaatgcatagaccaatgacaatatccttgcacgaaaaggtttctccaaagcggtgcccccaaggaggatgcgacgtggatcgccgccaccgctcgttcggaaccgaagcaaggttttcacccagagaatatggtagggaaaggaaaggggtatgctaaaacaacacctccaagaagtggaacgacgccaaacggcgtcgccgttgtcagccagccaaatagctcggcaaggctttcgcccgcgattccctgtccaaacccacaccaccaatccgcacaagaaggatcatcttcggtcaacaacattgtcctttcagcgattcggccaaggccaccgcccacagttgttcccgccgtccacggcgcgcccgcacccgaactcctccttccccgctgccagacccctttcccgcctccacataccgccgccgccgacgacgcaccatcagccggatgatggccttcaaccatcgccgccataggtaccattgtcgacagccaccaccgccactgccacagccaccaccgtcgccagccaccaccgtcagccaccatcgccaccgccaccgccaccgccacggacatccccgtccagccaccaccgtccagccgccaccgtcagctaccaccgtcgctagccagcgccgccagacgccagctgtccagatccggccggggtggcacggattagaggtgtagcgcgagcacgggtcgccggcatcatggaggaaggcgtcacgggcacggcgttcacagcaggaacattgccgagggcgccgcgcctccctcgtggtggcgaggttctcccgagggccggcgtcgcggcacgcaccgcagtccgcagtggtggtcgccactttcgtcgcggccacatccgccaccatggccgctgctagccacctccctgccaggtccgcggagcagcgccggcgacgaccgagcccatcgccgatcaccccggccaagcggggagaccagatctggtgacgccgtcgcccgtcgctggagccgcggagaaccgacaccgtagcgccccaccgccgtgcccaactccgcgccatcgccgcgccgtccccgtcgccacgatctcgccgtcccgccgccatcgtcgccacgcccgcgccagagcgaggtggagccgaggaggatggccccgccgccgccatcccaacgcgtcgcccggctttgccggcgacgagctccggcggcggcgaagcatggaggagggaggaggaggggcggcagcggcggctagggtttcggcccctagggtggcacaatttgatggtaatctgaatctctctccaaacaaatagtagaaaataaaagaaaaagaagttgttgttgagttgttgttaaccagagcaatgcccctactctctctcccttctacccagcaaactattggctcctctcaatatcgcacgaagggggcaacaacagttttctgccaaaaaagaaaaacttaaaagttagtgttggttaaagaaaaaaaagggttacatcgatcacgtgatttattatatgttgaaattataggcatataatgatttaatctattccataaataaatcatgacattacagatgaaaactagcatgaacgcatcattagatctacacatgtaaactacacagtataacatgaacagatcaaatatgcgcaacatattgaacacgtaccgaggtggtggaaagaccggctgctcggtcgaaacttttcgcaggcgtctacgaaggcacgcaccacgcgagcgaagaggaagacgagccgtcgcggacgaacagggagcagtcgcgcaaaacgcttcccaaaaaccttattgtcgccttctcccggtgcaggacgtcgaaggcagaggttccggagacctgctctcccgatcgcaggtgcacgccagcgagcgggatggagtaatctacgagcgacggcgcagcacagagtaggaggcaaaccctagattgatttcgcatgtgttgcgtgaagacggcgggtcggtttatatagagaagggtcgcttgatcagggcgcccacacgatctccactgcgcgtaaccgaaccggataagtcacgcgtaacttatccggactccacgccgtttgcacgcatcggatttttcggaacgtttccacgcgcgccgcctgccctgccctgccctgctaggccaggccaggcgagcgagcgcgcgcgtgtgttccccatcttctctccaccacacatgcttcaagtggctaggagggcatcctcccttttaaggaggtccccatctcgtagaataagtaaggtggtactaaactccacatgcatgccatcccataggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccgattaaggttgaacatccacctagaactccaagctacacttcttactcacaacttgaacaatggactatgccttgaattgcatgtcttgtgcaagcaagtttcactcagagtcttatctggtactagaccgtctgtagactacccctcgggtggagcgtataagtcatactcctaggtctatagtaagcttcctagaagattcacccaaaatctccatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttagagagggtatagattggtactctcctctagtttactaatgatttgttcttcccagattctaattcacgggatctccgatcacatagactgggttaccaccatagtataactcacatgggtctcaaacccatctccttcgatgcattgtctatcacatttcgtgatagtccctttgtgaagggatctgccaggtttctagctgttgggatgtaatccaacattataactctggagtttcttaatttcacatgtctagacaatttcatattatccttagaactattcactttgacaattaccgtttgattgtcacagttcataaggatagccggcaccggtttttcaacaataggcagatccattaatagatcacgcagccattctgcctctacagtagcagtatccagtgccgtcagctctgcttccatagttgacctcgtcaaaatggtctgtttgcaagacctccatgaaacagcaccaccacccagtgtgaagacatatccactagtggctttgatctcatccacatcagagatccagttagaatcactataaccctccagtaccgcaggatacccagtatagtgaagccccaattccacagtatctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaatttttcttgttcttgcgaagcaacaagctaggatcataagttgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgccccaaatatcagtatgtcattaacatacaagcataaaataactccctcacccccaccatggcgatagtacacacatttatctgcctcattgactgcgaagcctgcagatgtcaatgttttgtcaaatttctcatgccattgcttaggagattgtttcagaccatacaaagacttcaacaatttgcacaccttgcctttttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttgtttctgagtatagcccttagcaacaagccgagccttgtacttttcaatagtactatcaggcctaagcttctttttgaacacccacttgcatcccacaggtttacacccatagggtcgctctgtcacctcccaagtcccgttagcgataatagaatccatttcactacggacagcctacttccagtagtctgcatcaggagatgcatatgcttctgaaattgacttaggagtgtcatccacgaggtacacagtgaaatcatcaccaaaagacttagctgtcctttgtctcttactccttcgaggagcttcactgtcatcctcctcagtgacatgttcatgtgtatgttcaatttgttctggtggtgtgattgaactgggaattatttcagatggttggctcgaactactatgtgtatccttcattgggaaaaagctctcaaagaaggtagcatcacgagactccataattgtaccaacatgcatgtcaggtacctcagatttaactattaaaaatctataggcaatgctgtgataagcatatcccagaaagacacagtccacagtcttaggtccaactttgcgcttcttcgttttggtacattgactttcgccaagcacccccatgtgcgcaagtaagaaagtgatggttttctcccaatccatatctcatatggtgttttgtccttatttctattaggaactctgtttaacacatgattcgaggtcaacaatgcctccccccaccatgccttaggtagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctaagtctttttatctttctatcaagttgattttcaacttctgccttataaattttaaaatagtctagagctttgtctttcgttttcaacaagtacacatagtaaaatctagtagcatcatcaatcaaagtcatgaaatatcgttttccaccctttgtcaacaccctaattcatttcacaaagatctgaatgtaggagttctagtggtgccaagtttctttcctcggcagcattgtgaggcttgcgaggttgcttcgattgcacacaactatggcacttagaacctttgacaatggaaaacttaggaattaaacgcatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagaaacgactactttattagactcaaaaaccaacttaaatccgtctctagttagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgtcctgataagaataaaacaataagatgtcagcacaaacatgtacattggccccagtatcaacccaccaattagtagactgattaactgaaaaaacagtaggtaaattaccatacccgcttccatcttcagtgttgccaatggtcacattagcagacttagaagtctgccctgcaggtgccttcatccccttgcgctgtggacacttcctagctagatgaccaagttggccacacacaaagcaagtcctctcatcctgattaggattgttggtgttcttcttctgcttcttgaagttggtggtttgctgagctttgtatttccctttactcttgttctaggccttgtgcacaacattggcactggactgtccaccatcgcccttagacgcgacatctttttcccgagctttctcctcaacatcaggagatgctatcaacccctcaacggagtattcctgtctcttgtgtttgagtgcagtaccgaaacttctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtgatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagatagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagatttttggattgttgagattataggcatataatgatttaatctattccataaataaatcatgacattacagatgaaaactagcatgaacgcatcattaaatctacacatgtaaactacacagtataacatgaacagatcaaatatgcgcaacatattgaacacgtacctaggtggcggaaagaccggctgctcggtcgaaacttttcgcaggcgtctacgaaggcacgcagcacgcgagcgaagaggaagacgagctgtcgcgaacgaatagggagcagtcgcgcaaagcgcttcccaaaaaccttattgccgccttctcccggtgcaggacgtcgaaggcagaggttccggagtcctactctcccgatcgcaggtgcacgccagcgagcgggatagagtaatctatgagcgacagcgcagcacagagtaagaggcaaaccctagattgatttcacgtgtgttgcgtgaagacggcgggtcggtttatatagagaagggtcgcttgatcagggcgcccacacgatctccactgcgcgtaaccgaactgaataagtcgcgcgtaacttatccggactccacgccgtttgcacgcaccggattttttgaaacgtttccaaaacaaaaacgaatccgaatttgcagcaaaacaaaactgcaaaaggaggctgcatagaaccaattttggcggaccattcgacgcgtacatcgtgcacgcgcgccgcctgccctgcccaggcgaggcgagcgcgcgcgtgtgttccccctcttctctccaccacacatgcttcaagtggctatgagagcatcctcccttttaaggatgtccccctctcctagaataagtaaggtggtactaaactccacatgcatgccatcctatgaggtgagcttttgtgattttccaaagaattaatcttcgagtgggctaaggcccattcattaattccaacattatatacataccctgttttatcctcagttgcacaaaatatatttaagcagagacaaaccagtacagataaacagatatacatcgaaaatgatataacaaacaattatcagacaaagaaaatcgtttaggtgttttaattaaataagggtggctgagatgatagtagaatgtttaataggcgatggttaaaagaatagatagtactccactttaagggcatgttcactttgattccattttcaaacttaccaaattttggaaaagttgccaaaaaaaatagttacatttagtttgctgccaaattttagtaactatataagaaatcatgccaaaaatttaaagttgccaaaattttagtataattgccaaaattttggtaatgccaaattttggtaaggttttttttgacatcaaagtgaacaggccctaaaagtacacttgtcgtgggactaaggaagtattatttaataggtgttgaactcttcccgataaatagactcgatgggttcttttctacttctatttcttttcaacttcgacacacttgattttcaaacacacgctttctaaactatcaaacgacgccttttaaaaaatatagaaaacttgttttttttaaaaaaacatattaattcatttttaagttttagtcaatgcttaattaatcactctattttgcatgtagggaggtgaagttctcaacctctacctccgaacacaaccagtgtattagttttgagagctttttatagtttcaattatttaagaatctgcaactcctcaatcatccaaggttttgtttaggaaagtttaagattttagacgtagttatgatcgagaagaaactagcggtgttcaagttcattttcctaaattatacaactataatttcttagattttaggtgaaaatataaagtatttacgagagctgaagattctgggagaagctaatactatcaaaaactcccaaccacagtttacaagtttcttccacaatctacgacttctccaaacatatcatattttcacccagtcttgagatttgtagtatataatatagaaaataaactagaatcagaaggtgtaaaactaaaaattttcagatacttcttagctacttgatttttcaccagcagttccatatagaggcgcctaaaaattgaaatcatcaaccccatgtttcttactctcacataagttgggtgtggctcgtcgtttccaatccgtccatccgagagtgttggcatggacacccacagcccacaggggcaaacggagaggacggagcaaacaacgtccccatcgtttggcttatttcctaataagccaaaacggcttattaggaaataaaaatgaatttgtaggtaaaacttttataaatgtgttcttggtaacttgaaagccaatgttgaaaaagaaactacgtttgtcgaggggtgaccctctctagcgggaggctgtgaggcccccctttgagagttcggccgggggcagcgggtgagattcgaggatttggtgagcgaaactgtgtgtgatcttgatctcggaggctcctctaagacgataaaacaaaagaggtttatataggttcgggccgctatgaagcgtaataccctactcctgtgtgtatgattcttctgtgcttagaaagtccctaaatccctggtatgcaagctagggttagacaagctttggctcagggatcctcagtcccatcccccctcctcgctaggcatggtcctccttttatactctaaggagataccacatgtgttgcgagtgctacctagggagaaggaaaaatattatctatattaattacatgtcttatgccttagcccagaagctatctgcacgtcggttgcttcgcggggcccatcaaatcatgcagggtgcccttgtcattctccatttaatgaatgaggacttccgggttctcgttcacaccagaaaacgggaacccgggtcagttcagagtggttggaccagctctgaccgaggtaagaggctgtgaagccccttatcattatgatgggacgggacggagcacgctgctcgccgcctgacacagggggcgcccaagtcattcaccatttaatgggtgaagacttctgggctcctattacaccgagaaacgggagcctagctttgaccagagcgggaggaccgactccggctgggataagaggatgagaacctctcaccatcactatttgatgggacatgtcaggctgcacgccgcctgacacacgagcagcgcataggcgcactagccagtcccatcggtcattcgaccggtcacagaccggttgagtacactgcacgccgcatgcggcgtggcgcgaccgctcgggtcgtcataaatgcgggtaggtgggcacctgtaggcggacacctaacccaccgtacgtggtgacctagagagggggtcgggggagcccgacccctagtcacgggagggggccatcgctgcccgacctcgggcccgatcccccctcgggggagggccacgtggcgcttggggcagccttctccatctagtctcagccagggagtggccgccaccccaccttaggcctgactccccttgggggagggccacatggcattggggggcagcctcctccgactagtctttgggaaggagtggccgccaccccacctcgggcctgacttcccttaggggagggccacgtagcattggggggcagcctcctccgactagtctttgggaaggagtggccactaccccacctcgggcctgactccccttgggggagggccacgtggcattggggggcagcctccccgactaaacatgatacccccgggcctatatcaccaacaacgttgaaaatatctcaaaatcaatctcaaaattaagcttgaaaattcaaaatttgactttttctttagctgattaggccaaccgatggaagccaacgattttattggttgggggtggacctttcttttattattgggatgtcaaatatttagctggagataaaaatatattcacaccacaaatccgattatagttctatgaaaatataatttctgtatgaatttttgggcttacgctggggacgctccgacacactaggagagattgcgattgatccgtgtgctccgcatcagcaaatgtccttcgcatgcgtaagagtgtaagtggatcagccgcgaacccacttataaatcagcataagcggatttgcggcttattttagtctataagtgggtttcgcgggttagccacttacaccccggcatgcgtgtacccagcagtagcacattcccagcgtttgccggccacacgtcgaccggcgccgcgcgccagcccaactgccgctcgctcaccatccgctgtcatgtgtggatgtgccagcctgattgatcggaaattcggattgcatctcgtacgtggcccggtcgccatgatcatcgatcagactagtacactatactacttctgtctatatacatatatacatagtttcagaatgtgtcatatcccttcaaaatcgtttatattataagatggatgaagtagtatttagacgataatatccttccccaaatcattggccatacatgcaagttggcgtctattaattcctctgcctctgaccggccaaccttctcaaaccacatatacacgcgcgtgtaccgtgtgcgatcgggacatcgttcgggccgatcggttgctcggatgatcagctgggacgacgacgattttggctgttcaaatctgaaaaaagagcggcttttgagccctccaaacgccggctgattgattgacagatcgattcagcgtatgcggccacggaaggagacgatgatcgccgcgctagaggccgagatctgcaacaagccaacacgctgagtataactggagtagtagccaacaactgcaaaggatgtcgccaactgcgtacttgcaactactgtaattgattagttagtcatgcgcatagtatcttagcccataaacggagcaaaaggccggttaatctgctgcatcttgccctcttccttgccagctgccagctgccagctgcgagctgcgagggccagccggaaagcgatcgacgcgacagcgattctgtgtgtttttccgtgggagagacggccaacgacgacgcgacgtcagtcatcggctccccaggctttggagcttcacttttttgcgacggaacagaacacatcacacatgtttatgtttctggcgctgatactactttaaagagagaagaacaaaaggagtttcggaggagtgtccgagcaaaggcaggcatagagctgataggtctattggttctactgttctacacgcggatcaggatcccttgcagtaactgtaacttaaacagtttatatgtgcatcataacatgatctagaatggaaggccagcacatgaagcggtatcataacaaaaatactgtagcagaaatgcactgtacaatagtatgttcatactatagcggtcctctagagctgttagatccgaaaacaaatggtcaagattatgtacagttacagtaacaaatgtatttgatttcaatcctctacatgtttagctgggatttacttttttatagaccgcgggatctcagcaggacaatattttcgataggtttggactaaattttgcttgaatttactgatttaaatttgaatcatcaaaaaccattcaaaaactgccttgcaattgaattttgtcccacgttgaaaccttaaaattacgaaacgcagaggggggataatggtcaggtctatcaaagcaaccataatcagtaatcgcactcataaattacaatcttatactcagtgcccgaaatgaatagcaggtgcgctgaacttttcactacttcataatcagcagtcgatctggttcccgatctctaccctataattttccggttctataatgtcacatcctaattttcgttccaggatttataaattatctaataaattaataatagaatttatattaaatgttctttaattttcaagtgaagttaaatgtgggaaataaaattttctaaatttaaagcatggttggatttaatttttattaaattctccatgattaattatactctctgaaattttctctgattttttttttcagagctcaattccttaatgatacaaagaacagtttagtaattagtaatcaattaatgatctaattataattatgttaagtgcttttcttgtttaaaaatccttaatttataaattgttgcctaaaagggaattattagaaatgatcttaaaagcctagaagagaatatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaagggaaaaaggtttttaaaagtcttcttttggccccaaaaccgctctctctctccctcggcccaagtcggcccaagtcgagccgcccgcgcgcgcgcgtgcgaccgccgctgacaggtgggtcccacctgtcagtcttcgtcttcctcgcgccgctgccgtcgcccgagccctagcgccgcgccgccgtcgtctccttccaaatccagccgcccctttccgtttccggtgaaattaatagaggggaaatgatcttctcgatctcctctaccttttccttttggaatcgatcgccaattcagttggaaatccatggattcgagttcgattcggatcgatctctctcctccgaaccctaaaccttcctttccgtcgccggtcaccgtgggccttcgccgccgcctccttgcccctataaaaggacccccgagcttccctctacccgtcgccacccttgccttcgtctctcgtcgtccgtagcgccctagccccgtgagacctcgtgccgctgtcgtcgcagccgctccagccgtgtgccgccgtcgctccagtcgtcgccatcgctcggggaggtcgccatcgtggtcgccgtcgcgtcgccgccctcgtccacccctccgtcgttgctgtagatcgccggagcaccgccgtcgtcatcaagccgatcttctccgccgccttttcctcgacgccgtcgccgtccgttgatcttccgccgccgttttggtcaccggtgagttcgccgcgtcgctctctacgtgctggtgccctccgttcgtgccgtcgcgccgtcgttcgccggcgagcttgcacgctcgagccgccgccggtggtgacgtcaccgctgacgtcatcgtcgtcgtccatccgtgagccgcggtggatccgatggatcttggccgtccgttttggatggatcaatctcggccgttcgtttccgtgagccgtcgccgtgcacccggtccaccgtgaaccctagccgctgacgcaataattcctttttccttttcaaaaataattcattattgcgtcataattcaattaatacccatataagtattttaatccgatttaatctttaaaaattcataactaattcatcttagctcggatttagttggttcaagtctctaaatttttctaaaattgagatctacatgttaaaaatatccacatgtactgtttatgcttgtttttgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattcctttattccttgataccttgggttattataacttgactagttgagctttatatattggttcaggtagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacacatggtagacatgatgttgaggctgtgtcttgtgggtacagcggtacacctctggccagagtaaaactattcgaatagccgtgcccgcggttatgggcgggttgagcaatgttttttgtgattagtctcacacctctcacaataattattgatgttatacctggtaataatttgtttagctcctggtttggagttagatctgtacagctgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttatacccctgttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattattagtgaatttccgggcgtgacatataataacattttagaaaataacacggacttcaaaatatatttttgattttattttttattataatatatataataaataaatacttgtttacttttattttagtaacttaaaagacatatatagatctatatatgttgtttgatgttgttatagttcttttaaataaaattattttgaagttattgatagtcagaaaaagtttgccctcactttattcaagacgtaaagaattataaaaccggagtaagtagctatttttttttcttttgggaaatatcacatccagatatgtatggccaatatacataactgtggttcctgtcttaaaaaaaaaactgtggttccttatcatgtggaccataaattattgtaccttaattaacggcggataattaagatgcgcgatggagtcctatataatatctgcgacgatgattgattattataaggccatgcgagtgtcagtgtctcatcgagtccgtttacctgtattgttaacatctcttttattatagtcaaaccctaaaacagtttttacataaagaggtactcccttcattccaaattaatctatatatagttttttttatggtatttctaaataatctacatatttatgttcattcattaagtctattcgttatttatgcattagagtaaatagaaattgatgcatgcatccttgcacacaagtatttataacccatatgcaatatcttgatttgctattggctaggaaatagtggggatggtgcatgcattgagtttgttgctagagtaaatatagtatgagagagttattagcttttcttggtcttagtgtgcctgtgaaatatataaatcaatttgaaatgaagggagtatgcctgtgaaatatataaatcaatttggaatgaagggagtacgtaacaacacatgagttgtacccctggacaccatggtaataatagagtgttctaatgaaacactgttaatataattattcctccatgtggagcacatagatgtactagacgattaactaatggataaatgtccttatcaattatcacagaggagcacgcggcatcatattgtttatgaaaattctgatcttcctttcgtgtttaaggaaagcatattctgtaaagagaattttgatcttttccacggcgcttgacgtacgtagttaaaatgaaaaccataaccataaccattgtcatgatatatatagtgagtttagatactaaactcccgtggtaaatattatataatgctatttttttttggaaaaacatataatgtcactgacttttacacaatacatttcaccattagtcttattttttttaaaaaaaaatataataactatttactttgatgtgacttgttttattatctactccctccgttccaaaatataataagttttagcttctaggatttgttccaaaatataacaacttttccaccaacattctcttcccaaccaatcacaatcctccaccattcacttttcgtacctaccgccactacccatccaattacaaccctccaccactcacttctatatactttcttaataaccgtgtctaactctaaaacttcttatattctgggacggagggagtaagctactttatgcatggcttatcttatattattttcatgtgtacactaagttttaaatagtagaatttgctaaacgccacgtaaaaaaattcaatatcataccttttcaaaatggagagagtaatagcatggagtatgactgtatatgtttaactatatataacgtatctagaaaaaaaagcaaaggataaaaactctaccgcggataaaatcaaatatactttgagggagtaataaaatggagtaattgcaggctctccgtttatgtctgtctgcaattattatccaatatcccaactattctttctgtcacaaaataaatacagttttgtattgttcatatttaacgtttgatcgtttgttttatttgaaattattttatgactaatatttttattattattagatgataaaacataatagtaatttatgtgtgactaattttttaaaattttttcatacacttttttaaataagacggacggtcaatgttggacatggatactcatgtatttaacaatgatgagatttgtcggtgtactatgttgcatgtgcaatattgcagagatgaaatagtcatgtggttgattgtgatgttttggatctcataaaatcctgatgaaattaccacgaatatggtgacgtttatatctcagcactaaaacaataaaggagagtaagcagcaattcaataatgtataattattttgaaatttgcagtggaccggaggtcataggcacatctcaatacaaacatcctgataaaaatgccagcttacagatggataattggatatgttcttttagtaaattgcataagaccctgagtacacccccaagatgtataaaatcagagagattcttacatgtagcatataatcccaaatattatgatactattttgtacaataccacacaattgataaagtctactcaaatctgacatgtggtatgaaactcttagatgctctcacatatgggatgaaactattacatatatgctcacagagtatggtggatgaaagaactcacggaatctacatgtcagatttaggtatcgtttgtttggcttatggttttatggaacaccgcttctataatatttggagttatgtatcaggatccataatctctgagattttgtacaccttaaacgacgatacccatgattcaatgcaatttactttttgttttttactcccttcaggccttcattccaaagcaaaatataagcagccatgtacatagaaccgacaagagtcaattcattaaaatttccatagcaaccatgaaaataaattcttaaactccattgtcagtggaaattaaaaacagacatataaacgagcaacgagtagtaagtgaatactgtactctgtacacaggtacttatatcattagcgtgaccatattattcactctttctttgagctgatgactgggtttcgttattctctcaactttctcaatcattactttctcgtttttcatgtacagtgtattttgccaaaaaaaaagttctatagaaattatctctaccttttattataaaatttgaagatgtttccactgatactatggtacgtcgtccgtatttaagtcagcttttaagttcgttcgtttttaaaaatacaaaagtagtcgtataaaaattccttttaaaaatttcgcatgctaacttagaatgagaagacggattcctaatttatttagaattctcaccaggtcataagaaagcaaagtacaggatgtaaccatcatcctaataaggattctgaattagatatcaatactatcaaaataaaaatcccatatattttttaggaaaaaaaatctaacaataaaacgatttaaatagcttttacccgttacgcacggtcatcttttctatttttattaaaaaaatatatttaattaaatgtgtgctaataaatcatgtcgtttatgcgtacgtaagagattagttcccatcacatttagccgaacacagcacgaaattctatttcgatgggtgtaaagatgacaggaacatagccatgcgcatctctttcaggagcaagtagaaagaagaacaaaacgggattcctcgactgaactcatccacgatccatccaaattctcctcctcaaaaagagaacaaatttttgagtggcgccggctagtctgccaatatagaggccacaggccacagcaaccgaagcagccatcatttctgctccccaagtgagctctccctctcctaccaaaaagaaaaagaaaaaaaaatcctaaaggcagtgaaccaccggccacgtcggcagcagcttccccccattctcctcgtcgcgccaccgccgccgacggggaggcgccgcacgatatatacggtggcgcaagcggcggtgagctagctaggcgggcggaggagaggggggcgtggagggatggccggaggagggggagggggaggggg

SEQ ID NO: 578 - DNA, 6164 bp, Oryza sativa
gggaagcgcgtacgtgttcccgctctactcgcacgccatcaaggaggcgctggggtacaaccagaaggcgctcaccatgctcggcgtcgccaacgacgtcggcgagaacgtggggctcgtccccggggtgctcgccaaccgcctcccgccgtggctcatcctccttatcggctccgcctgcgccctgctcgggttcggcacgctctggctcgccgtcaccaagaccctcgtcatgccgtactgggtggtacgtagcctcccgccctcgccctttcagtgattgtgtgctcgtcttggcttttgcttgtttgcgtggggatttcttgctgtttttgcctgatttgagctcctcatcggggaggagattgagggatgatgatgaacagttttttattgagggacctaaaattttagcacatacgaagtagctctcaaattcccaattttatctttttttaaaaaaaaagcgattattgtccttttggagcgtaatttctggatatggcttggttgactgaacgaatgtcgaaggtgatgatcgactagcggcatctgtagaatgttgaaagatgtgcgagttttttaactgtatgattgacaacaacgccggtagatattttcctagaataagcgtgaaaccaaatgtggcatatgtagttctttacttcctgccattcggtagaacatgtcagactttggtccattctttaggtgaataattgttgactatttaaacaatcatgcttgcaaatggggcacaattggttccggtactgagagccacagcaaacctagaactttaatttcgcaaatctgccaactcgagctggtgacctggtgtattcgcatccctacaacttcttatatagttttaagtgttggtgacagattttggcaagttaatgccctaaagttattttcaagaagcagtaaggctgactttaatcagttcaaaattctggttttagtaaattgcataaaaatatcacatgtaaagacatttactgttcagttttacatgagttttctgttgcagcagcaacagaaaactatattatctgtgtgtgccacatatataaagattatgccataaatgaggaggtcaaaatataagtagtaaggcatgcttagtagtgctatctaggttgtctcttatgattgccatgttatatatattaaaaaaaaagtaggtggcagagaaagggggtgaagtgagagaacgtgtcatctcttatacaagagacgatatgagagaggacaccgacacacaagactgagagttctgaggtgagtatgcgattaaaagaaggggaattataatggcatttatgatagagacaaactgttagagatcatataggttgtacgtgaggttattcttgaatcttgatgagtcagatttgtaggagattacattaggggtctctttattttacatggtctaagttcgtattacttgattgaagcattggctgacacccaaatacccaatacaacatgattgagattcctgaatgtgatggttgctcaacttttggtgattttcaactttgaatagccatctgacctgcaacgcctggggatgtcattcattggtgtttgtgaccactggaaggttattgctgaagttggtatgaacacaatttttgttgggactttttccattacaaaatacattgacaatgtaaaagcaagccaaagaaaaacagtgaagttcatgcatccttagctttatacacttactggtaaacatgttctggtcttgtgttgtgtagctgtttattattattatatttgcttgtgtgttgcttttttgtgaccctgaatgtctaaactctaaaatgccagcccattctgtatatattaatgttttcacaatttagagacatacattagacctactgtattgcttttttgcattcgtatcgtattgttttagggaaaaaatgtttgttgttttgagccaagatttaatcaatccaacaagatattggtattacactgtaactttttaatcactgtaaataattttttgccaaaatgatatggaattcctagtcgacatttgatactttttttaagttcagagctcactagaatttccatagaaacaccagtcactttacaatcagtgtcttcatcttcaaaatctcagccgctgaatgaacttcttggacaaaattagtccctttttagtttcatgatcgtcctgatatgttcaacatactcaattcatgaatcaagatactccattaaccgcatagtttttccaacaaagtagaattgtctcacaaagaagccactattaaggcacttattttctttgaatgttgcaagaatttcctgtaattgtaaatgttctgaatctccaaagatccaaaaaaatcgatcatcatgtctcttttccctttttatgtactagtaaatgtaaatcaggcgagcagtacacgtgcatgctatccttatggagagatctgataaagaaaataaattatgcacacgcttagaaggcaattggttgtttaccataaatattttatctgtaatgttggcaagtacgaaaatgctgactagtgttacgtgcatagaacttttatatctgtaatgttggcaagtacgaaaatgctgactaatgttggcaagtacgaaaatgctgactagtgttaaatgctgactagcttcctaaatcatggaaccgcatcttggtaaaattctgtctcaaatgcctgatgagttgtccatatctgatatttcttgctcatgttgtagctcatactttcaagcgagtctttttatatttagcatattttgttggatgcctcttgcagttgtgcatagccttatgtattggcacaaacagcagcgcatggttgggcaccgctgcacttgtgaccaatatgaggaactttcctctcagccggggaactgttgctggtctgatcaagggctatgttgctgtgagtgctgctgtctacacagaaacatttaatggaatgcttcagaactctcccacaaaccttttgctgttgcttgctttggggatccccaccgcatgtgttctggtgatgtattttgttaggccttgcactccatcactggatgaggacaacgcagcagagcacagtcatttcatgttcacacagatctctagtgtggttctcggtgtatatcttatggtagctacaattctcggtgatactttaaaactaagtgacgctattacctaccttttgtttggtataatgatacttttgctcctttctccactggcaataccaataaaaatgactatttatccaaacaaaccaaaaagggaaaagactagcacccttgcactgtcttattcgactgatagtttgtctggtccggatcaagagaattcagaaccacttcttggtggcacttcaacatttgtcactggagccaacgattctgatgaggctactgatgtggatcttcttttggccgagggtgagggagccgtgaatttgaaaaagaaaagagggcctagaaggggggacgatttcacattccgagaagcattggttaaggcagacttttggctactatttattgtgtacttttgtggagttggaactggtgtcactgttctgaacaacctagctcaggttgggatggctgttggtgctgatgatactactatcttgttgtgcctcttcggcttctgcaactttgttggccgtatccttggtgggtctgtctctgaatatttcgtaaggtcagctccctttaaccactttgcaattactttattcattcaatttctatcattgcatagctgacatatatagcaactaacataagccaaagacataacattttctgttcttgcctactgtgatgtactgatattactccatatgaccatatgaggccaaaagccactatcacctcagcacttcctgtgaaatcctggcagactactcagatgagctggccgctgatatttatctcctgcagactggcaatcactttgcatattcctagtcatccacaatcctatgattttttctttactcttgttgttaagctacatgcttgataactattagttgctgcttctgtaaaatgattcgagtaaaacctgattgcaggtcaagaatgcttcctcgccctttctggatgatgtgcacacaaataatcatggtgataaccttcctccttttcgcaactggccttcatagcttgatttatgtgtcaacaacatttctgggcatatgttacggtgtccaatttgctgtcatgatcccgacagtctcagaactttttgggttgaaggactttgggttgatgtacaacttcatgttgttagtgaatcccctaggtgcattcttcttctcagctcttctcgctggttatatctatgacaaggaagcggcgaagcagcagccaggcgtgttggaaccttcaacctgccttgggcctgactgtttcaggcttaccttctacgtttgtgccatcgtttgttgctgtggaaccctagtgagtgtggttttcatagcgaggataaagccagtttatcagatgctctatgcaagcggatcgttcagacatcctcggagtcaacaactccattgatggcacgcgcatgaacacagactattttggagagaattatcagctcggtgtgtatagttggctttcttatcacttcatatcccagtgctgtattgtcctactgttgcttggtccgtccccgttggatcggagagttattttgatttcatctgtacctgttctgtaaagcttgtgatcagtagcagactagcagttaccagcatacagccggctgtcgaagggatgaaacttgggggcgcgtatacatggtggggccgttcttgtgcttgtacatcaagtttgagaatgttgtacaatatcttcttcatcccactgacgctgttaataccatgagtgcaatgagcctggttatgtgtcttcttttttttttcccatggaaactgattatgtgtatgtgtcttgttttctatggtctgaacatctgaatttcagtagatgtgtcccaagccaactcccaacttgcaattactcctaaaaacgatacatcaaaagttcttacaaatacctatgaatgtaaactaacacaacgtgatgagcataacatggagcgacacttccgtcccttaatataagggattttaacattttgcttgcactgtttgaccattcatcttattcaaaaaaaaaataatagaattattatttattttatttatggcttactttattacctaaagtactttaagcacaacttttcgttttttatatttgcacaaattttttgaataagacgagtggtcaaacagtgtaagcaaaatatcaaaatcccttatattaggggacggatggagcatatgatttcttcgattttctgcatggaatatgggtctctccgagtctgtgtctaaattaggaaaaaagagcacctaagttatgatattatcgtaaaggcacatgtagtaagtggtaagccggcaaactagcccatatcaaataacctgaacatgaagggtacatgaaatccactttctactccgtcagtcaaaaaaaaaaaaaagacaaaaaagacaagggactatctacagcagaatttttttgtgaaaccgatctccagcagaattttcatccactgaaatgcgcaagtaacagccaaagcactcaagtggtgccaccgtgatgagctgatttgcaacttgcaagttggcgtactttgctccgtcctctcgtggatgacttgattgccatgttgatgacagtgttgggagggagaccagatccaacgcaatttatcttaagcaggaaccaccgtgcaggcgtgcactccgtgcagggttcaggctcgctcgactggacgttgcgatgggcgtccagttggttggatccgagtggccacggaaccaaatcgcacctgaaattggctgcatcttccagaaccgtgggccgttttgcggtggttgcagcgctccggtgggcgccccgcgtcccccctcccgggcaaaaccaccggcgccgcggcgcccggcgacgttgacgctgttacaggtgggccccgggtgccatgttgtgaagcgttgggacctaccgacagagacgggatcagaattcaatttcttccgtaggacgcg

SEQ ID NO: 579 - DNA, 2093 bp, Oryza sativa
  unsure (1)..(2093): unsure at all n locations
tattagaatatatcacaacatattctttataggttaagttattttaagacagagtgagtaggtaactatttaattgggatagatagagtagtactattggtggtaggtaggtaggcgacattaaagaaataaaaaaaattttgatttgtaatcaagtgtagataaaaatgtagaagttaatttattttaagataaaatttgatcatcaaagagttgatttatttttgaataaagggaatattccactccatgctaacaccgtgagtagctgtatctcccaacattattgcttgtctatgttgatcattaactatcccaacttattgagggaccacatggccatctatctctaagagctaaactctagctactacagcttattttaaaattagaatctccccaaacattttagctttgggtttaaattctaagggcctgtttagatccatttggaatggcaaatggcaaatggtaaaagttttggtggcaaaagtactagttagtgtttagatgcatgttaaagttttgccattctagcactaaagtgaaagagagaaagagatggggagtggtcccaaagcactttttggcacaatttgctactatggacttttttggcacaatttgctactatggactagcaaatgccaaatgtcaaattgccaacttttgctactagtgtttagatctaaaatgacaaaaagtgctacaaaatgacaaaacttttgccattttggaggatctaaacagggcctaagaagctgtacttgtagaagccattaactgggaacccaattttttaaaattctcagaaaccgcctataaactaggttggatatgtaacacatgctaatacaaggaatctggaaagacttcttgtctagattcgttgtaataggatatgtcacatccaactaaaatcccttatatttagggacggatagagtattttttaaaattttaagctcacaaacaatcctttctgaatgtaagcacctttctgacgtatatataccatataaactttccgtataaaccagaccgctgactaaaaaattgcaacgactccaatccgtgtgcagaccattgtattgatgtatactaggagaagctttttcagaaagtacagtagtaccaagtgcaaagcgagatgcttcttcgtgtgccacccagggncctaatttttaaaaaaaaccccccagcttttccgctgggacgtagcaaaaaaaaaaaaaagaaagaaaaaccgcaaagtcaagtaaacttcatcaccacaacaaaaacgaggcccacccggacccacttngccccgacccgaattttattttntnctngnntnctttcctatnctcccatccttcgncgnacgcgcaggcacacgcacacctacgcatngccgcctcctccttttcctcccactccgcggaagcgcgtaaccaccacctcgttcgttcttatctccaaagccgaagacccaccgagccgatcccgacgcttcccccatggctcctccgctcctcccccgcggcgcggccctcctcctcctcctccgctccgccgcccgacggccggcggcggcgtcctcccgcggcttcctgtcgagcgctgcggcgggaggccgcgagggggcgctggccgccgccgcggtggcggtggtggggtccggcctgggtctgtggctggtgcccccctcgctcgcggactccggcgaggcggtggccgacgccccggcggtacagatctcggtaggctccggctccggcgcggtaggcgccgtggaggagcgaggccggaagaggaggttcctcctcggaggtgagcttcgcttttgcttcttatcccccctccgcgatttgcttcccgcttcacgattgatctcgcgattgttctcatggagtgcgtccgatcggtttgcgcgtcgccgccgccgccgccgttgtcccgtgatgcttgtttcctttacttctctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 580 - DNA, 1423 bp, Oryza sativa
tcatttttaattggttaaaattatttccaaggctctgaaaattccactaaaatcttgttaatgcattggagcatggggaactcaagaaaaattccaccacgccgaattcaattattaattgcatttattaattagggaattagctctaggttaattaagataatttcttcggacgatttatttagccaatttttaaagcaaggagagggggaaacttcagggcgtgacatacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctccggaactctcaaacatttcttcaactgggagacgtggaacacattatggatgccaagcatgttggaggaaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcctctgtctgatcccagaagagcggagtacgacacctccgtccatacagtgcttcaaacggtgccatctgcagactagcttggtaactgttgttgtaagagaactcagcatacggcaagcttttgtcccatgctccaccaaagttaagcgcacaggctctcaacatatcctctagtatttggttgactcgctcggtctggccatctgtttgtggatggtaagcagtgctgaagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacatagtgctacgaa

SEQ ID NO: 581 - DNA, 566 bp, Oryza sativa
  unsure (1)..(566): unsure at all n locations
agtccccggggagcatcgtcggggtagcggcgcctgtccatgtaccagaacaggtagccaccattgacggcaagggcggtccgccatcgggtgatggggtgtggaggatcaacggcggtctccctcaccggcgccgggctcgccgacggtgagcacctccatccccatggagacgggaggatccatggagggggagcggtagaaggaccgaaccaccttgtacctgccggtaccaggatccagccccagccctgcggtgtggctgtggccatggccgtcaggcaacgtgatggcttctcttgttgccgggttgaagaggtagagcttggtgatagtcggggcgagcactaggccatcaccaagnttgggggggtgggggttttggtaagggtttgggggggggccccttttggggggaaaattttttttaaaaaaaaaaaagggccccccgggggggggggaaaaaaaaacccctttgtggcgcagggaagtcttggatccatgatcctcgcaagggaggaggcaccttgctcccactggtagaagctgatgtgggtggaaaattt

SEQ ID NO: 582 - DNA, 741 bp, Oryza sativa
tgtgtttacctcatcaaaccgttcattaagctctggaagttgtctatcaatgacacttagaaacatgtcaacatggaagcgatgcatattcttgatttaaataaagaacctcctatctcttccaaccggccgatagaaagagtccatatcagggatcttgatcttatgcttcacacaaaaagattgcacttcttgaagaaaatcatcccatccaggatcctcgcgtaattgctgcaattgaaactttgtcaataaaatcagtcctactgcattaacaatgtcttgatccctcttctgcaaagcatgattcaagtcagatgtgaacccaagtactgtttgcatcaagtgtgccataaaaacaaactcaaatgattggaatattgtcaacactgtttgtgcatttgcacattctgcaccaaaagagcgttgacaaaataggagtgatcaaactaaaacaatgcaaagtaaaaaattgccccgcattatgaaacgaagggagtaaaataaattaataatagagcattcaaataaatagccttgtcatttgcaggagtacttgtagtgataaacagagggggggaaatacaagcagtgcatacaaactgattctcatgggataaaaagtagcaagaccgaagaagctaagcagcggtaattctaacgagagactcggtgtagggcatcaaggtgaagtcgacgacactcttccatctcgctggcctaccaccctgatacgggctg

SEQ ID NO: 583 - DNA, 763 bp, Oryza sativa
tgattgaacacctttacctatgaattgcagcaaatgctggagcaatgatgctggacagctggaggcctggagcaaatggatgttgataaccagattgctaagctgatggtggagctctcccgcatcaagattgtgaaattggggatggtaccactgcgatggtggtcatgtttggatcacttctagaccaagctgagaaactgttagaatatggtattcttccaattaggatttctgaaggttatgagatggcgtcaaggatagtttttgattatctcgaacacatctcccaaaagttttagttcagtgctacaaatatagaacctgtttttttgtacaaacctgtacgataattgacaaccctaaccccatcattatcttcatatgctttgtttgttcaagtttttattttgggtactttcaccccatcattggtgaatctaaccaagacaccttgtgctagctgttagcagaatttatctgtaggtggtttgaacattctgcattgattttgcaggaaacgaaatgattattgaggagaccaagtgaagtattcatgatgctctgtgtggctaggaatctgattcgcaagaactctattgtttatgggaatggctcagctcagatatcatgctcaatctattatattattaaaggaatagaaaaaggagtctcacgttcgctctcatggcctagaaaatctcacattaatccgagaaaaagaaaaagcagagtccatatagaaatacaatttagaaagagc

SEQ ID NO: 584 - DNA, 731 bp, Oryza sativa
ttgggaagcgtgcgtacggaaaacgaaacaaacaatctccctatcaccccagaacgaacgcagcctaagttacttggttggttaactaaatttggtatctggatggatgcagggagagtggcagcagcagcattagttggtgggggcgtaccactgaatccacggtacccggcgattcctgaagaaccttacataggccggagaggcgatccgtacacaggtcggggaggcgaaccttacacacgcccgggacggggatgcaccgttgcatacggatgctatggaggtcctccagctgccaaaccatgacgatcgacatactactctgctactgctactgcatgctcgcttgttatttcgatcgatcaatctcatggcctgcgtagctcaccacataaacaaataaaaactatgcatctaataattaacccctgatctatcgatcgatcagtagacgggtatgcatcaatcggcatcagcagcatatgcgatgtgaattgtgatgtatgcatggtgtatttttgtggtaaataaagtgaagcagatatctatctagtatatacacatcgttcctgcttctatgttgcctgcgaattacatccccttttgatgttgtacctgttcataggtctagttcatactacttcataggtacagacctcaccattccaatcaagatgacatacagagattatttttgatgtcctgcatattggttgtgcaagcagggc

SEQ ID NO: 585 - DNA, 304 bp, Oryza sativa
taaagttattgcaaaatttaaaattatgatatcattttaatatatttgaataatataatgagaaaacatatatgctattatatgagagaaaatataatgatgctagccgagcaatctgcgcgggtcaccatgctagttgctgttaaaactgcagcagatcaacagcctggagttgaccaagtaagtactgacattggacatttaagttacaaaatgaagcaatgtctgcctgtcttctgattgtgtctgtgtacctggagtatgctatcattatctgatacctgaaaactgtacgtgcagatct

SEQ ID NO: 586 - DNA, 3164 bp, Oryza sativa
ataggagtatagtacgtccacagtccactgcatattactgtacgtaggtggctgtgcctgttcggcgctgtaccagcagatagaatttcatcaatattagctggccatgtttattcgtgtaaccatattatttcatggcgtcattgattagcttagagatgggcctagcagcagcagaagccctagaagaagaagaagaagaagaagaagagtgtcatggtgatgagggtggagagtttcggcagccgtagacagcgttgcatccggggggcgttggcgtgtaaggccttccaggaggaaccgatggcctgtagtttggatccagtgacctcctgcttctgtctctccctgcatccatccatcatgctcttacttagttcattaattaattaattagatcagaggtttagtttgtctgtgtatgcatataaaggatgtacagcggctggcctgggatgttttaggagtattattaatatatgctgatgctgcatgaacatggctcaactccaatgataaaacacaagaatgttttaggagtatttgtctgttgatgctgcataaaaaactagaatattagggaaggacctaatatcaaataattaggaggggtgaggctttgaacccaggtcgtctagcccaccaccttgtggagctagccggaagacccctgggcatttctcgatgctgcatgaacatggctcaactccaatggttaaattaattatagggtactagtaattacctgctccgtctacggggacagtgtgcagggtgcagatgagggcgaggatcatcaggagcaccttgcaaagagacacaacagcagcagcagaagaagtgtgttgcttcctcatctctaaccttgttgtcttctgctctcaataatattgcaactcaattggttgctgttttactgttgcttctctaccggctgttgggctcagaatttatactccctccgtttcgaattgtttgtcgccgttgactttttaagcacatgtttgaccgttcatcttgtttaaaaaaatttaagtaattattaattcttttcctatcatttgattcattgttaaatatattttttttgtaggcatataattttacatattttacaaaagtttttcaataagctaagatgaatggtcaaacatgtgttaaaaagtcaatggtgtcaaacatttcaaaacggagggagtatatagcacctgtccgtagtgttgcttggttgtggccatatgacattcaattggtggtagtagctagataacggcttgatggtagtattcggtttctgcatgcatgtattagtgatcgatgagtgggtttttgcatgcacattaatcaatgagtaagtgtgttatggatgcatgagtaagtgcatgcgttctgcttgcatgagtaacaaagtgtgcgtttccatgcattagtaagtctccgttaagtcatgcttaattcatcctccgtacaatctaaagtgacaaagagttgattcctagaagaaaaagaaattgatccctgtgctattacccaacacgtagcacatgggactgcaattcgctttcgtttaattaccatcgtcagcaaccaacaacatgccacttctgttttgtccccggccaatttggctcgcgctagcaattatattcaccatttttccccagggcatccagtactgtctctctctctctctctctctctctctctctctctctctctctctctctggggatggccatggagaaattaattagacgtggatatcatgcattttacacacgagaatcaggagcaattgatgacaactttaattaccacgactcagcaagtcgaattcgatttgcgtccctcaacccaaaaaccagacacaacgggtccctcaactatcaaaaccgatgtagattaggtccctcggcggttttgagggcggttttggctgacgtggcgcttacatggctaatttgactcggtcttcatctaacgtggcattggcgtgataataaaacccgtggaactcacatatcagtttcacacaaattaataaaaatggtgagtcccacatgtcattctcacccttctacctcgtcttcgagtacatggaccatgacctcgccgccacaccggggctgcacttcatggagccgcaggtcaagtgcttcatggcgcatatcctcgtcgagctccgcagctgccatgaacggtgcgtgctgcatcgagacatcaagggcgccaacctgctcatcgacggcgacgggcgtgctcaagatcgccgacttcggcctcgccaccttcttcacgccgccaggccgcagccgctccagccgcatcatcacgctctggtaccgcccaccggagctcctcctcgacgccaccgagtacggcgtcgccgtcgacctctggagcaccggctgcatgcctgcatcctcgccgagcttctcgccggcaagcccatcttgcccagccaaaccaaggcaaataaataaatattataacctcaactctccatctatatatcatgatatcatctatgcgtggatgaaatggatcggcatctgatttgtcattgctgatcgacgcagatcgagcagctgcacaagatcttcaagctgtgcgggtcgccgtcggaatagtattgggcgaaggcgaagctgccggacgtgacgctgttcaagccgcagcggcctaccggcggaagatcgccgagatgttcagggacttctcgccaccggcgctcgacctcctcgacacgctgctcaacatcgagccgtccgaccggggcaccgcgccaccgccgccgtagccgtggacagcgacgtaagcatgcacaccttctcccctccctctcctctcctcctcgctcgcatggggtcctctgctgctgcttagttcttcaggacaaagccgcctcccgccgctttccgccacctttcgccgccccttcctcttccgcccacagccgctggagacgtgcctccgcggctgcacgccactccctcctttcccgccggccgccgcgcaccgctgactctcgatcgtgtctggagagaggagagagagatgaagagagggaaaatggggagagaggaggaggaagaagaagaggggtgagaatgacacgtggggtccacgggccccaccggtttttttgttattttgtgtgaaaa

SEQ ID NO: 587 - DNA, 10444 bp, Oryza sativa
tgtttctgcgtgtttattaggcccgattggtgggaggagccgaacccattacgggcggcccatcacgcccatgcctctgtttatctggcccaactgggggtcggagatctattctccgaacctccctatcctgcaaagtggaataagttcatctgaggtcccttaattttacgccaaatccgattttcatgcttgaacccaaaaccagatataactggtccctaaactatcaaaacaggtacaaatgagatccctcggcggttttgaaggtggttttggctgacgtggcgtctacgtggctagtttgactaggtctccgtcccacatggcattgacgtggcgcttacgtggcaattacgtctcaaaaaaataataaaaccatgggcccacctgtcagctaaaaataataattttaaaatggcgtggcccacatggaccccatatgtcattccctctcccctctcagctctccctcttcctcatcaagccatctcctcgcgccgcggcgccgcctcacagccggcaggagcatgccgacgaagcggaaaaacggcggcggcggcggcggcaggccgcggggtcggtgcctactcccgcgccgccacatcatgttagatgctgcacagcggtgaggaggagaggcggagttcgagctcaggacagcgaggattagtgtacagatcgagctaaacagccaacaggattagtggcaggcaccaacaagcagttgctgctgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcgcctcgctgatggtctcgtgcagccgtgcaggtagtgcatccgcttcagctcgtcgtatccggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcttgctcttcccttcgccggacgccgtcgacctcgcttcctggtgccgatacacgcctccgcccgcgcgagccaacccgacgctgttactcctcgatgggacatggaagcataccaaggagatgcaggccgccagcctcccgtttttgtcctccttcgtctcgtccccttgtcattgctcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaagaggaggggagtgagaatgacatgtggggcccacgtaggccccactattttttattaattcatgtgtgaaactgacatgtgggtcccacgggtttattatttttcttagatcgaattgccacataagcgccacgtcaaatgaagaacgagtcaaattagccacgtaggcgccacgtcagccaaaaccaccatccaaaccgctaagggacctcatgctggttttgacagttaagggactcgttgtatctggttttccggttggagaatgaaaatcggattcgttgacaagttaagggacctagggtgaacttattcccctgcaaagttgacggtcgcacgcggcacgcctcattccgtgcgtcagaactcactaggacaaaggatcgagtaccaagcccaagcattttattagagccaaggcagaccatgtatgagcatggtattgatttttttttttaaaaaaagcacggtattgatcaacttaaaggagtgatgatatggtctttgattgagatatgcaccttatatggtgcactggtaagggttgtgtaatttcaaccctgagttcctgtgttcaatactcaacatgctcacaatttctttttaaaaaatatttggagagacgtctattcctccaaatctcaatttctttttaaaaaatgtttggagagatatctcttcctccaaatctcgtgtgatgattaaaagtttccgctccaacacccacatctgctcgtgtaagatttcttttccaacctcactttcctccgatccctgtgcaaggtgagcttccccaccttagagcaggtacaatagtaggctataagccagctgcaaatatattttaataagataaaagatgagagagaagagcagcgggctacaaatctgtagccagctgcagcacggattttaagacgcaatgtgtatatgacagcgggaccatatgctaatagtatagtaagtaactattatataaattagctattaaattggctatagatgaattggagttagtagttggctatactattaaccttgctcttagggcacgcgcacacatatgttcattgggcaaatttgccgttgattatacgtagaagaaaagaaaaatactgaacctttgaagaataagtgatgtcttacggaggcttgattagctcttaacgttgaacaactagcaagaattaagcagtactaatgttcatcattcagattaattacaccactaattaaccctgtctagtatagctaacatagttgcaaacattgcatgcatgcagggcagcttaattagttagttggacacggatcaaaaaagttttgatatactactgtatttagtttagtttaccctccgtctacgaaagcagtgtgcagggtgcagatgagcgcgagcacaatcaggagcaccttgcaaagggacagtgcagcagcaacggcagaagaagagctgcggtgcgtcctcatctcgcttaattaccactccactaattaattatcctgttcttctctctgactggaatgtatgcaccccctgggtttaattgttgcttcttcgatcgactacaggccgtgggtttccagaatttatagagcctgcaggcaagcaggcagggtagtaaagtatatttagtgcacttcgctatcgtttactaggagtcaatggctggccgggcctcttgattaatcccaggaccaatttggcactgatcttttccctcgaaaacattttgggtcacttttgaaaaaactgataactgattaaaccctattactagtgaagagccagaggagtgacgtcagtgacacacgaggataggcaagtttaaactagtgacatagagtgaaagggctaattttaagtgacatatgagaaaacaggctaatttgaagtggaatataacgaattatccttataaattacatgcacctcctgagtttagttgttgcttcttcgtcaaaaggccgtgggtttccagaattaatagtgcagttcgctatcgtttactacgagtcaatggctggcccgatctcttacaagttacaaccccatcgtttggtttatatttgtgaaataatccaaacgatatatttgtaaatgaaaaataatttataaataagattttcatatatgtgttcttaacgatctaaaagcaaaatctaaaaaataaattcagataaaaaactcaaaatcagcttcaaatttaagattaaaaatttaaattttagatgatatatatatataagcataagtaaaaaaagttgagcccctaatttcttccgggaccaatttggcactggtcttttccctcaaaaattttttggcagttccctcaaaaaaaaaatttttttggcactggccaacaaattaagtcttcgttttttccacaatatgagacgtctcatctggtagagtaattaatcaatagagaccttatcagctcggctacagcacgactcaggatggcaccagaatctgttgttaattccattattccatcctggagggcttgaccgacttgactactcagtacatatctactccaccatagagaattgagaggcaaaacaaggacaaggacaaacagcatgctctctgtcatataaaaaacaaaaccagcctatacttcgtaatactataatatatcatattcggtactatatggaacgaaaaaaatataccaataggtggtacaagatatattacatgtgccatattatataaaaaaaattacatgtgccatgtttcattcccagcaacataactaggtcgtttttaatcctgtgccgctagatttagtctttttctttaaataatcttcttcggtttggttggtcctatattatgtcttaggccatttcctctcgcattttaaccattctctttaataaaatggatttgcttaatagcattccacaaaaatttaagaatgaaatcttacagattttgaaccgttagatccacgttaagattcatgtctaacaagaagataaagttttcaggttggagttagagttagggtaggagggggatgggatgggggagggagaagatggaacccctagagcttagggggatagctataggtgacggagaaccggaggtgagcaactaagtggtggacacgggcgggtggcaaggcaccggtggtggtgctggagccatagggttggcaggaggcggtgggccggcgttggcggtggggaaaacaaggaggtggcgattggtggtggtgaatgtagtgtcggggacccgccgaagatggggaagatggttcggaggagggaattcagcgcgctcctttggggaagagaacggggagagggaagggggaggaggctcggggtaggggaaaagtttggttttactatttcactttgatagatttttaagcttatatcttttaattttccatccgtaggatgttacgtctaaatttgtgttactgtcgatccaacttataattacacttagttaacagagcacttatactcaggtatagtgcaccaaagttaaattttacattagttttttttcgctagatttacaactttttacattgtcccatttttttttatttcattcaaaatagattgtatccatatagttgcctcctactactgaagcagcgtgctgggtgcagatgagtgcgaggaccttcacaaattcacaagccacagattaatttatctacagccacgtattatctgtggctgtagattaatttaatgccattatctaaaaagaaagataatacgtatcttatcagctctaactctaaacgaaactagctaggtaaggttgaggtacgcagggccggtcctagggctatgcagccgaggtgatcgccgtgggcccatgatgatggagggggggcaacacctaatactagtagtctagtacctgcctatggcttacctgaagcagaaacacccgagaaacgagaggagttgcagcgtcgtcggtaactcggcagacggcatcgcatcgcacaggacacaaccgcacaggcgcacagcgtcgtcgactcgttcttgatgattttgtatcaagaaatacccgaagaagtatcttttcatgagaaatagtgggtatgatgggatgctattcttcattaaggtaatgatattagtttcaaggtacaaatatattgttattttggtcgactttattttttgataattaccagacatgttaaatttaatatatggataaatttattttcatttgcaaataaaattagcgtatatatatcataaaattttatatataacttagagagcccattgcaacgagttcacctaggaccctcaaaatcataggaccggctctggaggtacgtaacagtcatactacatatcacatatgcagatatgctgctgctgcctcacgttcactgcacacatcacactgagcagatactacttttatatatactccaatatggaacgcatacagaggaattaaaagacacctactcgatccatcgatctgcgttagatgcctgctggtttatttatttgtttgtatatataggcatagcatcgatcgacatgagtagatcgagatcgatactttaattttagataatgagatcgagatcgatatggtcttcgatcatgcagtagcactgtatgtagcagagagatggagtgtgggtcatggtcatggcgagcctgctccaggagggcatctgtagggtccgcggcatccccggccgccggtgtaagacccgccgggggtcgtcggcggcgtgtaggttggatccaatactgaacccttcccacccccaccaattgccgcagccgctctccctgcatccatcacaacaatactcagtggcggagccaggatcgtcgtcgagttagatatgactaattaatagtgttttataacgatcgactaaattttacacttattaaccgcgtagttggtaatggagacggcagtgacggagcccgggcaatggctcgacttacccgggagctaccttcattgacaataccgatagtgtaatactaccgatagagagatcagaccactgtaaagcagtggcggctccaggatcgaatcgttgggtggtcctgcttggcgtcccaaattgtcacgatgttataaaatcaagtcaaatatgtcaaatatagtggaaatataattcaaatattgaaagataactcagtacatcacaaattgatttaaaaccaacatttaagttcaaagttacgaaagttacaacataaataattcaaatatcttacaatatttaggtagaagattataatacactacttcttttctactcgccgggtcttcatagacatgaaattctttttaatgtcttcttcgctaacttgagagaagacatcccgctcaataaatgtgattaaacaatcattcaataatttgtcacacatactatttctcagcttgctcttcactacactcaatgcagaaaacaccctctcaacacttgctgttgctacaggtaatatcaataccaacttgagaagtaaatagacccaatcataaagaacatgcttgtttgtttcacaagtttaatagagagctcagcaagagtttctaggcctttgaacctttcatctcttctcatatcatcaataaaagtcccaagttgcatttctagtctgatcaaatccatggttgaaaactcttttggataaaacttggcaagcttaagtacttgttgtgcatcataagaggcaaatgaattgaatggattcaatgctgacatgcaaatgagcaattccatattaacctcatcaaacctactattgagctcttggctattttatcaatcacaccaatgtacacttctcttctaaaatgatcatcatttgtttggtccggataaaaccgtggagatcttccatgtggcacatattttccatctaaggttggaacttggatactatgtttattgcaaaatgaaacaacagttccttgaaaaaattcttcccatccttcagatcttaatttttgcattctttccttggccaaagttacaagtgacattgcattaacaatatcttggtctctcttttgcaagcacaaacacaactcatttgtatatccaagaatgacaagcatcaaatgtgcactaaaaacaaaatcaaatgattcaaaagctccaaccacagcatgtattcttggccaatcatctctttgtgtggggtcttttccaagagttatgagcacctcatgaattgtggggtacataccaataatatgcaatattgttttgtaatgagaaccccatctagtatcacctggcctagccaatcccatctcttgatttaatccaaccccactttctatttcacccaattcaagtgcttccataatcttttgagctctaacatctctaagcatgtcatgacgcttacaagaagtaccaacaatattcagtaagtgagaaacttgagtaaaaaaccatacgcaatcatcatttcccttggcaacagaaacaagaactaattgaagttgatgtgcaaaacagtggatgtaataagctgaaggagactctttcatgatcaatgttttcagcccattaatcttccctttcatgttactagccccatcatatccttgaccacgaatttgagaaggactcaagtgatgatcactaagcaaagttagaattgcctttttaagtgcagcagaagtggtactagctacatggactactccaaggaaccgttcacatactcttccaagtttgtcaatataccgcacacaaagagcaagttgttccttatgtgaaaggtcactacactcatcagcaagaattgcataatgatcatcaccaagttcttcaatgatgcgcttagtagtctcatcagcacaacaatggataatttccctttgtatactagaacaagtcaagatgcaatttccaggagcatttttcaacaccaaccgatcaacttctttattattttcagcaagccatttcaaaagttcaataaaattccctcggttactagattcttcactttcatcatgtccacgaaatgccaatccttgatttaaaagatatctcaaacatctaagtgaatatgtcaacctagccttatagtgaatttcactttcatttgacaccttcacaatgacattatctattgaaggaccaccacttacaaataggttgtatttctcttgagctttattgtgagcacttgttataccccccacatgtttgtcaagtgcatcggctttgttccaatttctccaaccatccgtaacaaaattactagttccactaccaaacaagtaacataccatgcaaaacccagcatcctttgctacactatattcaagccattggtacttatgaaaccaaacaaaattgaagtggcgcttcttaccataaatttccctgactgggaaatcatgtgcataacattggtttgggcctttcagaatatatgcacgccgaactgcgtcttgttcattgacatcatagctcgcaataggggacctcagtcctggatcatattgaagatgatcagcatcatactctggaggtgcatcttgctcttcatttgttgcctcaacaactggagttggcacaggatgtggctcaactagtggtggctcctcttcttcaatttgagcttcctcatcaataagatctgccctcttcttcgcctttgcttcatgtttccgaaaaagcgatgcaatgtctccattccttttcatgtctcactgcaatttgcactacaaattaatgagacactaagttaagttatattgactactaactaagttgctgctaaaaaaaaaatctaagtttcagttttcaatcacatttttcattcatccatgaccgatctattcaaagtaaatactaaagactaaaatgggtaactcaccatctcggtcttcactcttcagttctttcacagaggggcaggcagcagcaggggggcagggcactggaggccggagcaagcaaagccgtctactcgtgactcgtcgagcaggaggctggaaggagagggacccgactccggtgcgtcgtcgctgccgtgaggggtggccgggcggcggggcaaaatggtggccggctagccgccgccggccgggatggtgccgcacgcccacgtcgggcccgggcggccgacgggctgtcgcccgcctcctgcagtcctgctcctgcaggcgtacaggcgatggccgccggcgctggcgcctgccgcagccgcagagcgagaggacgaggatgcgacgaggcgaggagtggagaatcgggactcgggagaggcggagacgagacagaagcgaagcggagcggcgggtgtccctacgcggtgcgcctctcctctgtcatcctaaccctagcgcctgtggtgggcttttttgatttgggccgtcggggggggggggtcctcgtgggccaaaatccagggtggtccaaggaccacccggactacctgctggagccgcccctgctgtaaagagatcgaccctgagggattagaagtgtattttacctccttgcacggaggcagtgtgcagggtgcagatgagggcgaggaccatcaagatcaccttgcaaagggacagagcaccaccaaaactggagctgccatgctttgtcatctctaacttggtattatctcttcttctctcctctataactctgactgaaactgcatgcacctcctgggtttgttgcttctctacaggctgttgggttttcggaatttatagagcctggaggcaggcagagtgtagtgtagtgcagtgcagttcgctatcgtttaccacgagtcaatggacctctaatttctcccgggcccaatttggcactggccagagcaaagtcttggtcttttccacgacatgcatggaacgactcatctaatatactctcatccctaaatatt

SEQ ID NO: 588 - DNA, 10415 bp, Oryza sativa
tggagtatataataagagtaattaatcagcgatggttaattaaaggataaagagcaacttataaatcgcagacacgactcaatcaggatgacaccagatcgaatttgttggtagtccaattgttctatcctggagggcttgaccgaattgattatacttaaataattaatccactatatatctactccatgcaccatagagacaagacaagtactccctccgtttcaaaatgtttgacacagttgactttttaagtacgtgtttgaccattcatcttattcaaaaaatttaagtaattatttattcttttcatatcatttgattcattgttaaatatactttcatgtacacatatagttttacatattttataatttttttaataagacgaacggttaaatatgtgctaaaaagtcaacggtgtcaaacattttaaaacggagggagtagtatttaccagctactagctcaacatccattatgtacaaaaataaggagcgactagctcaacagcatgcatataccggtagccggtagctaggtgctacaagatattacatgtgccatgtttcattcccagtatcataactaggtcgctatgtcatctttaatcctgtatcgctagatttagtctttccttttatcttcttttgctcggtcgggcttcgttttgtcttaattaggcatttcctctcgtcttttaactattctctttaataaaaaggtcttctttttggcttaattaggcatttcctctcgtcttttaactattctctttaataaaaacggtattctttttgtcttaattaggcatttcctctcgtcttttaactattctctttaataaaaatatacggaggtaatggtaccaaatctcctcacttgtacgtagtttgtgattttcttttctatctcccttgcatgaattttaaagcaaatagaacaattcaaaattacattgtagttgcatgcaaattacattggtggatatatggaagttacaatataactacactatatgattgcactatatttatatacgtcaaatttatagaaaaaaaatatcgacaagtatatagcgcaaaactaactgcaagctttaccactaccctcaggaaggcgcctttgctacttccattggtaaggcccatctgcagaggattcaccgacttcacaggccatcactaggaatttgtttatgaggggtaattaagcctaattggtggtcagagctgtaactgcgtggagcccaacctcttacgggtggctcatcacgcccatgcctatgttaatctggtccaattggggtcggagatttattctccgaaccccccctagcccccgctcctccaaagctgaaggccgtaggcctgttccgcgtgttagaactcacaaggagaaaagatctgaagacgctttagatcaagcattggacgctaacgcaggcatcggatgcgctattccccatcttttctccatgctcactttccccatttccctgtcttcttctctccaccattccccttctctctcacctagcaacgaccaaaagtggccaagtcctcaggaccgaaggaagatgccatcgccggagaaagccgcgatagtggtggctttgggaggagaggtgtgtgcgggtagagtagaaggcaccatggccggagagaatcccaagctcgccggcggcggcaccacgaggaggatgtgcagttattgttgaagacgacaaagctcagcagcggcggtacctacatcgcgcggagattcagccatcaccggttagggccccgagctcgccggaagcagcggcacggccgcgaggaggtggcacgtaggacggagtttgagacgccatcgcctgagagggccctgagctcactggcgaaggtgaagaggtttatggcaacgtcgaggattgttgcacaccatatgttttttttttttgcacatagtgtgtttgtgatgttgcactccgtcttttctagatgtttcttaaatcagtactagatgttgcatttggtttctttgaatgttgcacgtattgggtttttgttgttgcagtcaacattcttgagtattacattcgattgaaacatcttcgataaagcgatgaaatattcttcagtgaaagatgaaacattaagaaaaaattcgtgttgaaacttttttttagcaatgaaaaattgcaacatttcttcatcaacatatagtgcaacatcgtcgagagatttgcaatctctggacatccgatgcgtaggcctctccaaaaaaaatcgagaacttagcaacatattgtgtttttatagtagtagagaaatgggtatgcaaaaatcacaaatgtagaaatggccgaacgaaattaggacccgtttttatttttatttttttgacatgtagaaggaccagttttgctgatgaagaagctggtaggctaatgcttccgtgaattgaccagataaaaatgggcccacatcaaactaaccaaaagggcccttagttttcggcccacatccgagcagcagcccagcattctaagggatcccgtgggccaaatcgtgtgggccgtggctgttggggtcggagatttcttccccgacccttcctttttctcagggcgagatgccggcgtgatcaatccgtcagatccgcacatgaatctggtagtggttgcagagacaccgacggcacggagatgtttgcagttgattatttcgtagagattggaacgatttcaagcatcgagatgcatgatttctacgtgtttttactgaattactccccccgttttaaaatgtttgataccgttgactttctaattacgtatttgatcattcgtcttattcaaaaactttaagtaattattaatttttttcatatcatttgatttattgttaaatatgctttcatgtacacgtatagttttatatatttcacaaattatttttaataagacgaacggtcaaacatatgctaaaaagtcaacggtgtcaaatattttgaaacggagggagtattatgatagtaagctacgttaccccgatacgctgatacggatacggatacgcgatacggcgataccgggatacaccatcttcccaaaaacatggatacggggatacacgaatatatatatatatatatatatatatatatatatatatatatatatatatatatatatatatatataatttaaaaaaattgagtgtggaatatggactgaaaaaataggaagcaaacagcatcaatccaccaatgcatatatgatatctcagtacgacagattcacaggctcacagcatctcaccaagtcaccatttattgaagaggcatacataaataagtgcaagacttacacagtagatgaaatcatgaaaataacatagttcttcaaatagatggtagacattagacaacattgttcacatagtagatgatgcaggatttacctcaagttctcaacgtcgtcgtcgtcggaggtgatgcaggattgataagaggcagcggcgtgacgcctcgtggaggagtctggagctcctggaggacagtgcagaggagggggcgcggagaaggctgtaggccgcggcgtggcgtcggcgaggcggcgcagcgacggcgtagggcgggccggcggcgaggcgacgcagcgacggcgtggtcggggcggccgggcggcgctgcgatggggattgggttttgcgagcggcggcgcgtttggaggggaagaacgggagatgcgttttgttctgtgtgatttagggctccccatatcatgtacgtatcccgccgtatcggaggagtatcggtattttttttaattatctgaaaaagagaaaaatgagggatacatatgggatacgtatccggccgtatcccgcacgtatccgtatccgggcgcgtatcagatactgatacgagggtcagctgccgtatcggggtgacgttgatagtaagtaacatctctgatcaaaactctttgcagtgcgtcgtcctcccagattgatttaagactgtctgcctctcgattacccaaagaaaagatgaaagaataatcagctgtcaatgtgtagtactagcagcaggcaacaattaatgcaacatggatgcaggaacgatgtgtatatagatagatatccgcttcactttatttaccgcaaaaatacaccgttgcatacatcacaattcacatcgcatatgctgctgatgctgattgctgcatacccgtctactgatcgatcgattgatagataatgtgttaatcagatgcctagttttatttgtttatgtagtactccctccgttttaaaatatttgacaccgttgactttttaggacgtgtttgaccattcgtcttattccaaaaatctatgtaattatttttttttcatattatttgatttattgttaaatatacttttatgtacatatatagttttacatatttcataaatttttttaataagataaacggtcaaacttgttataagaagtcaacggtgtcaaacattttgaaatggagagagtaattaagctacgcaggccatgagattgatcgatcgaaataacaagtgaacatgcagtagcagtagcagagtagtgtgtcgatcgtcatggtttggcagctggaggacctccatagcatccgtatgcaacggtgcatccccgtcccgggcgtgtgtaaggttcgccgggaatcctgggcaccgggtaccgtggtggattcagcgctccgttcctaccaattgcatctgctgctcctgctctccctgcttccatcaatcacatcgtacaacacatattacaaattaagtcaaccaaccaggcttaactatctcaataattataagcaggattatcgcatttatcatgcacggtagtcttttcagtttttgaaaccacgatatgtcttgcggttataccgcacggttttcacggtaaccacgtggttaccgcgggaggaaaaaaaagataaggtgaaccctgattataagtgtatttacctccttgtaccgaggcagtgtgcagggtgcagatgagggcgaggaccatcaggagcaccttgcaaaggtagctgcgttgcgtcctcattactatcttattatctctaccttaattctttttctgatctctccctcaaatatattgcacctctttgcttgctggtgtttgtttgcttctcggctgttgggttttcacaatttatagagccagtcggttgggtagtgcatgcagttcgctatcgttgaccaggggtcaatgacactctttcttccctggactaattaggcacctggccaacaattaaagtcgtcattttttccacgacatgcaatgtctcatcatatctctgtggactgtacgtggagtaatatcgcccggtgaattccatcgctggatccagaaatttttacgaacctaggcaagactagcaataggtaaagttttatacagatccatatatagatcatctcgacgtgagcatttgcgttactagtttgtgtgaaacatgttaattaagttgctagtactatacagtactactactgttgtgctgctcatacggctcaaacactgattaagcaaggtaattttgtcttaatcccaatgaatgtgccggccggtcaactatccacggtcgtccggccttcgccactgcactggctgtgttcggaagtttaatagtatagcccattactggctccaattcatctacaaccaatctaatagctaatttatataatagttgcttactatactataaatatattaatattatatggtcccacctgtcatacacacattgcgtattggaatccgcgctgcagctggctatagatttgtagcccgctgctcttctctctcatcttttatctcattaaaatatgtttacagctagctaatagcctgctattatacctgctctgatagaaaccatctcctatgcacggaaaacggagcggtctattagcgtgagattaattaagtattagccatttttttcaaaaatagatcaatatgattttttttaataatttttgtatagaaattttttgtaaaaaaacgcaccgtttagcaatttgaaaagtatacgtgtggaaaatgagaggggaatgttgggaactagctcttgcaagcgtacgtgttgggaactagccatactgtcgagtaatcaaccatagatatatggtattagagcagccctaatactacagtcaatataccagtggtgcacctatacaatagttaactatatatttataatccattattaatacttggatctctccatatagttaaaaaaataatatttacatgtggtccagcataaattcacatatacttttaagcgttaaatgcattatgcttaggaggagatggcattcagacaacttagagcaaggttaatagtatagcccactactagctccaattcatttatagccaatctaatagctaatttatacaatatttgcttactatactataatatatggtcccacctgtcatatacacattgcgtcttggagtccgcgctgcagctggctacaaatctatagcccgctgctcttctctctcatcttttatctcattaaaatatgtttgtagctggttaatagtctgctattgtacccgctcttatagagttctcaaaaaaaaagaacaactttacggtatattttactgtaaattttgtcttttaagccttctcctgtagagatgacgtggaagatactaatagtaagatgcttattctattattatccttaacctcacaaagatctcccacaagcaaattcagctatctaattggaacaatcctacgatggtccatgatatgagtaacggacggatcttgcctctaccccaggggtgccaaagaaagtgttgcgtagccttattctcctagcgtcatgggagatttggaaggagcgaaatcagttaagacaaaaaaaaactatcggcaacatacttggttgcaaagatcaaagaggaggcacagatttgggccatggcagcaccgaatggactatgtaacatagtgccttagagtcttcttttttcttttaaacctgtatagagctactcttgtacagctttttttttttgccatattcaatgaaattggcacattctaagtgccggttcgttaaaaaaaactcatagttttttgaagttcgtgttacaactggttacatatatgtagcttgctttttttttctgtcctcttctctcttaatttcaattcagtacaaatccgatgtgacgtcttctatagcccgtttacatgatcttatcatacatgcatgctcttagataatcacactccacattccaaacagattccattgtcataggtatacagaggaaatgtactcctccccctatcccataatataaggtgtgcacatatttcaatattcaactttaaaaacatttgatcaacaattattataaaataaaatgaattttatttgttaaaatttatatcattggattgacatttaaatttactttaatgtgattataaatttgttgcaataaaccttatagtatatgagaaattttaagtcaaagattagttttgaagattatgtcaagtttgaccatacctcttattatgggatggagggagtagtatacaaagttgtagttgaccattcatagtccttggaaagatatcaagcatcgagattagttcaaggttttttactgaataataatagtgataattaacgtgtatggttaaaactcttggcagccagtgcgtcgttgaagattaatttaagatcactgtcatacaactcttgtcaaacatggacatggacaacgcccaatagaaatctaatatttgtctgcctctcgatttatacagataagaaagtaagaataatgaaacttcaaattcaagaccagggtcgaatgatgccatcacggagaaggcgaacaagcaaaggagccgaagtacagtttctaagatcgagttaggtcttaagtagggctgtggagcagcataaatctagcctctatcttttttattttgtgagagcgttccattcagctttgctcttattttaatttgagttggaactgtttaactggactccagcttttgaaaagaaagaactgaaactgaaaatggcgtcaaacagactcttggagagcagactgtcatggtaagacttcttcacctggagctggaggggcgtcgcactcgtcgatactgctgcatcccacgccgcccctggagtaactgctggccttgttggaacgaggacctggatatcccacggacacacctctccctgcataaatatatccagcatatatatgtatagtccattgatttattcggttaattaattaccaacacaacactgtctagtgagtgatctacagtctttaactatttacctccttgagctgggcgcagggcgcagatgagagccaggagaatcaggagcgccttccaaatggagacagcagaagaagatccccgttgcttcctcatcttcagtttcttcgtctcactggtcgaacttgttgaaccttacctcttggtttggtgctcatcacaacttatagcgcctgcagtgctggggagtgcaatttgctgttgtatcctttactttctccgtccctaaccaaccatttttagatggacacagatatttaaaaagtagaccaaaatacttaaagatatattatgattaattgagaaaagatagtagatgatgaaatcaaaatagaaaatgattgtgattagttaagagaatgaaacatatgaagaaatagttttattttggaaaacgagattttgagaaagaaaagtgcattcaaacttttttttagaaagaaattgtgcgcgcggcggcgtagctcctccttccacggccaatttggcactagccggtagccactcacaggccacccaccacccattctcggcgtgtctcaatgtgtgtgcatggagcaatcaatcatggtggataactggatatatcatggattagtggatgttaaaagaatcttgacaatatataaggcaaagcttttatctttccttcaaaagagttaaaataatcttgacgaattgactttaccagcgtcaaatggacacactagccagcaggaataatggtgctgctacttgtagtggcggctttacaaatttttcgttggatggtcctacttcaggcctttaaaatttcataacacccaaacttagtatacatatataaaatttgttcaaattatcacacacatatagcattaatatcttattaattggccagttttcttaaagacaaagacaacaaaaatatctaccacacatatagcatattgcttataataagaagatattttgtataaacttttttctgaacgaactacccaaaatcaacttgaatattagcaaactacaaaatatgcataattacaaacatggtaaagaaggagttccaaagaacaaatatgagatataactcggatgtttacattccaaaacaaaaaaaaaatacaatcaatcatacgttgtataaaaaattacctgccattatgttctcgatcacttcttactatttctatttcttctgcttctccctcttcctccctgctgcttctgcattatgcaaacaagcaaagatacgaagggaaagggattcatgagagagagaactcaccggttaggcagcaagagaaatcaaccaatccctggatggaataaaaatttatgttctaattctaggccactgagtcggtcttggacaatgcagggtcttgagtgtggcaatcgcgacggatgtgatagcgactagcgaaaggcttgagctcaccaaatctgcaaccatgcacatatagattggccaaacaataaggcctttcaaaatttatttttcaagatatgtatctattgttcacgctagtcaaactagagtggtatttagctggcgtggtaaaacaatactgtcacgccagtctcgttgacgtgacagcgttatttggccacgtcgatctcgctaacatggcaacgttatttggtcacgccgctctcgttggtttagcgggacaaaactgtcgtacccattgcatgcgacttatcaatattgttttggttcagattttgtaaataagttttgaaagggtttatttttaaaattaaaaatttaaaaggttaaaaaataaaaataattcctgtagtaaacagtggagtagtatgtgttgtgtacaacttcctggctccttgttccatgatgtactcatgtatatgcagcacaagcataatacatgggacaaacacttgtttacttagaaaatgttcctatgtgatctgtaatacatgagtaaatttcagaaaactgtaactataataacaaaactatcagtttgctacaacattagtgatctatttcagt

SEQ ID NO: 589 - DNA, 2882 bp, Oryza sativa
tatagggagattgtttgtttcgttttccgtacgcacgcttcccaaactactaaacggtgtttttttgcaaaaagtttttccagaaaagttgctttagaaaatcatattaatccatttttaaagtttaaaatagctaatatttaattaatcatgtgctaaatggctcacctcgttttacgtatcttctcaatcttctctatctcctcctccaacacagccttagtacttccttcggttttataattcttgacgttttagacaataacacagtcttcaaaatatatctttgatcttgtttttctattataatatatagaataaataaatacatgtttatttttattatagaactttgaacgacaaatacatatatgttggtctagttcttttaaactaaatacttttaaaattttgataattaaagttataaaagtttgactacaatcttatccaaaacataaccagagagagtaattgattaactctcaatgattatgagtttaaatatgtgcatcttctgtcccataaaagccaatttctgagggtaaacttggattggatgaatgtttgttcagattcgtgtattgtagttattttttgtgagacagaggaagtatttacctccttctactgagacagtttccagggtgcagatgagagccaggaccaacaggagcaccttgcagagggacacaacagcagcagaagaagaagatgaacaaggagagcggctttgcttcctcatcatcactgactgaaattttagctcttggtttgtttgttgtgtacgagctagctgttgggttttcagaatttatagagacagctaacttagcaaggcagggtacgtagtgcagttcgctatcgtttaccaggggtcaatgcgctccttttaggacaaattaggcactggccaatatagtggtcatttttttccacgatatgcaatgcctcatcttcgtggaatgttgagtaatcagccatacaggcggattagggatccaggatttggaaaattgggcattgcactaagatctcgctggctatgctgtaaatggcagcagagaacatcgccggataaacgatggcaggggcttaatatcccaatctcccagaaagaaaagaatctggtcgcagtttccactttgatttcggtgggagatgggaatacgacgttgttctgggaggactactagatagatggaacatcgatacgctctttggcgccagcggtttatgctattgtccctgcgcgtttgtggagtcgttgaactgtggccgaggcgctccacgacaggcgttggatacgggacatttctaccgcactgggtgtccaagcaattttggagtacatcaacctttggatgacactcagatcggtgcagctctcagatgagcctgactcattgtcttggagatgggagtccttaggtgagtattcttctcgctcggcatatcaagttatgttcttgggaagaagtcgcttcctatacaaaccaatctggaaatccttgcccctctccctcccaggtgtcattactttctttggttggttactcttaataggtgttggacagcggatcgactttggaaccgtgggctatcgcatcctgaccgttgtgtcctttgcgatcaatgtgatgaaatgatagatcacctcttggtcgcatgtccgaagtcccgacaactttggtggactgcacttcaagcaattgggtatgcagtttgtttgccccacaatgaggcttattttcacttgtggctttgtgatgcccgaaagaaagtgatcaaaggcgcaccgtcgaaggttcgacaccattacggccctagtagcatggacgatttcgaagaagagaaacaataaaatcttcaatcaggaaactcgatcttggacagagattgcgagggtcatgacaaatgaagccgagctgtggtggctagctagggcagcgattcccgccttggttgttcctgtagttggaacggggtcgcaaattcagtcgtagagaataggcttttgatctttggtctttcctgtatcatgtctccgtcttcttttattttcttaggttacccttgtaaataacttttgctcatttttaatgtaaagatgcgctccttacgtattaaaaaaacagtgggcagacccatattcgaaatttttatgagtgggacaagcctaacaatagacagagtccacacaagtttatacaaaatccatagatcattttagagcaccgttacggtgctctctacctataatattctactagcactaccggtagaagtaatctgagccgttaatttataagggtacattagtattttactaattaaaggttaagggtaattttaacatttacttttctttttcttaatagaacgatcagttcgtctgtgtcaccgctcctttcgttctggcgtgcacccaactccggcggcagggcccactccggcaagtgagagctcctccatcgaacaaaactactgaacaaagctatatagtcaaatcgagcagcaagggcaaatgtgctgttataaactccgtcgagcagaattcagaattgttgctacctctacgggtccatcccggaggcttgaccgacttcactaaagtacactatatctaatccatcatatgtgtgaccaggctgtagcgtcgcccctgtgaccaaacaacatcttatcagctgtaggtgaggagaaacctaggtaggtgatagtagatatgtggtgtgtacaactccttgtctccttgttacttgtacatgtactgctaatgttccatgttgtacaagcagcacaaacaaaatacatggggcaacacttgttcactcggaaaatgtttctgtgtggatctgtaatacaatgggtacgttcat

SEQ ID NO: 590 - DNA, 3239 bp, Oryza sativa
cctttttaaaccaagtgccaggacatctagcttaaagacttaccaatcatggtatatgccaataagacctcgctcgtaaatgataccaagagtgtcttctcagatattgtgggccaacattcattacccaagatattggagaatcaataattgccgcaaaacttccaagccctgcgttcatgtccataatattcctatacctcaaagaacctatcagcttgtttatcctcttgtaagtactgacatacttcttccacaacttattatcctcctcaaaaatttcttctgtaacacctggggtgcgaccctgtagaattctgggaggggcagcaaatagtctctctgggaatttccgtagctgtgcttcttccgggaaaggtgttatacaaccttccattttcttatacctataacaataaaccatataaaaaatcattaatgaaacaacatataaatactgtcagaaatagaaatcttcagataagcatctattcttgattccaccattaagagagcatttgcatatatcagcagcgatcactgtaataagttgcccctgacaaggagtaagggcaatcacctacaaatcctataatctagtggtatatgaaaaagctagctgtttttcttgtataacaaggattttggaattatggcgattataacttagtcgagttgatatggcatgttagaggttaacagcacgcatatagtagaactagatacatagagaacacaccagacatcatctgcatcttgaattttgcacatcctgctaggatggtcatccttattatgacattcatttgaatctgcctttttgcgccaaataacagtatctcccttctcatgaatcttaccccagcacaacatttcagcaattttttcgattacattttgttctgcctctaaatcttccttggatcttttccatgcttggtgatttgtcttccaattgatgggaggaccagacaatatccaatagccaccaggcctcagaacccgatctactttaaacatgtacatcgcatctgcatgaagcgaaataatatagcatatgcaaaaaagaacagctgatagaggcactacattttgtatgcacagttgacactactaaccatttgacttccaggagattaagcagcgtgagcaatgggccatatcaaaagatccagaggggtatggtagttttatagttccaagcactccaattactgcaggaacacctcgctccaatgcaaattgaacctgagcttcatgtgagtctcgaggtgcaaatgacatggttaatacatttctgtccattaggtaagcaccccagctggcaacctacaagtggcttaaattgttattgcagctacaacaggtgatcaagaaaatactaacataaggtcaatgaaactaaatggcctaattatacacatgaaagttcagagaaattgggctaagatgcactaatatttcatgaattactgctatgaggtacatcataaattaaggaaagaagcaactaaaaagacgctaacagagaggctaaaagtagctgctcaatgtttatacatgttcaagaatgataggatctgtttagatgacataccccgcatccagtatcaagtgcagtcctaatggtgccatcagtaaatggaatgacggatgcaagctcatcaatgtaggcatttgctccattgggaaacattgtcccccctcctggaaatctaaacacatctccctcaaactggacccagttctgaacagccttctcaactgtcaaattcttatatggtgcatttgcatatggaacatagtcacggctcttgggccaaggaaaaggggtgacatagcctttgggtgctgggattagacagcgcagtttcttagtctctgtaggacaatgcctctctcggtagttcatattttctctaggaaagttcattgctcggttctgatcctgacaaggagtatagtcactgtatcgaatatggcatggctcaaagactttatcggtcatgaccaaaggattaacaccacctaagctatgatgggtctcaaagtgcaagtttggcaagattgtacagtcggtctcttttgtcaccctcaatgcaatactatccccccttccggtcccacttttctgccaagctcctagtatataaaagaagcagcacaaactcatcacaattacgatggacatcgtgctccgcgttctacggtcacctggattcatcctcgagcccctcatgaacctgaaattgttgcagggaaacaattttgaacgaatttcagaaaattattacaggaaacttagttattctaaatgaatttatgaattgaaatatttgcagaacatgcagagactgggagtttcttccataacccaaaaatgtttgcagtgtatatatgttagtagatggcaaaagcacaaacaggggaaacattgagtcaattcaaaaagtgcttggtgatgcctatttgactcctaaccaattagtatgacgttaactatttccaaaatagcatatacttcctccgtttcacaatgtaagtcattctagcatttcccacattcatattgatgttaatgaatctagacacatatatatctatctaggttcattaatatcaatataaatatggaaaatactaaaatgatttacattgtgaaacggaggtagtatgtaccaattcaaatcgaacctggcatgggaccctttcgaatgcctatatagagttttctgataatggattctcaacccccgaggcagttcatcagcagatattatgctagctaacacgggagatcgaatgatgaaacaaagcaactgaactgaaggagcgagagatttagtcgtgacaaggcataaccaatttaaccagttcccatatctacaaggtcaatggccacctagaaatgaccaaaaatcagcctgtcgcggaagcatcgggggcttcgccatacaactcagcaagcaaaaggtaagaaatcgcggatactcgctgcatagcttggtcggggaatcatcatcacacaactcgatccgcaacaacaaaaaaccacctggcaggtgcagattctctctacacagtagaactagaactagaagggggctaagctctaagctaactcggaatcccgatccccacagcccagtaaagaactacacagagaacggattggattcgagacgaggaaggaagctctcgatcggaggaagcaaaccaaacgaaaccaaaccgatacc

SEQ ID NO: 591 - DNA, 5347 bp, Oryza sativa
ggtcgctccccgaccacgtccgctccaaccgctgcctgcaaaacaaaaaaaaaaaccagaatattcttttattaagctcacagatctgagattatttatactggagtagcataattcaatgtgtttgaactggtacactgtatgactttatttttctgaactgaagttttattggttagatctagtcagttagagaaacctctttgttttttttttcaaaacatagtacaatgtactctatttttatgaacacatttgaagactagattgatatatttttatcttcagatttcatcacaggtgactccctgtcaaggggtatatcatctataaccaacagaataatatctaatcagatgagttatgctcgctttgcgaaaatctcttatgtgtttgtttacctgtgacttaaatgcattcaacttacttgacactttacgaaatatcaaatcgaggtttaattctaataatgaaaaaaatcaaacagaaacatatatatttttcatactctagtagtaatttattgttatattgacatattcgcatggtagtaactaattgcggaatagctaattgaaagtccgtttgatatctgaatgaagtcatgaaccttgcatatcgttgaatggagagcatagataatagggttttgatttcctatgttagatagatggggttgcgaggtaatggctattttatttatatacaaatattgcgaggtaaaaataatgcttcggtgtagaactacttaacaggtttcagtgtagatcatctacttagttgtgtagttgtgagtgtattcgtttgtactgttttttttataaaaaagctacataaattaaccagatccatacttctccaaataacaaatcttaaacgatttattgaagaacttcgcaaatttgaagatcaagaaaaaaccgatttctattttatgaacgatgggcttgggtttgtgctggtccatacttatgggcttaatatggcccgacccaaaagtcacagaggcccgagagagagagaacgcgcgcatctactggacttctgggcccacctgtcggcgtcagtcacaaaggcaatagaatcccgaaccgtccttcacagcgccgcttcaaaaccctagccgactcaatcccggccacactcccacccccacgcttccctcgccgccgccgccgccgccgccgccgccgcctctctccccgcaatctcctcgccgccgccaccgcagtcaacgacgccggccgtcgctgtctttctcgcgcgcgcgtggaggattcgaggttttatgtaggcgaagatggcgctagaaatctccatggaaggcatcgaagcgcgggcgcgggagcttggggtcgacctctccaccgtcgatctcgactccgtcaccctccccgccggcgaggacttcggcatcctcaggtagccaccgcctctcgatccggccccaacaaaactacctcacgccgtcgtgcgctttcgctggataccctagtcacccccttccgtttcattcagatccgattatagcatcgcgtgactgttcgatctgccttaatcaacgcggcagctagtatctgatgcttttagctcccactggtagagattttgatacggttttttagatgtgccatgatgttaatctgcatgagaactcgtaatgtgtcggtatgctaactatgtataacattataagtgacatagcaggcactgattgcatatatttgtatataccaaggttaaacatgcaactggtgtgaatgactgtatttcttatctgactaaaattgttccatctggtagcttatggcggctgatgcttaagctgactcacaattacatggccagtattgtttgcatttaacgatttttgtttgtccagaaaattttcttgagttttccttttatgtcgctgactgatttgtaatgttcagtgacgatgaggatttacttcggattgatgaccctatggagcttgaaatggggtttgctaacgttgttgtcgtggacaacctgcccgttgttccaccagagaagtttgagaagttggagaacgtcatacgcaagatctacagtcaaattggtgcgatcaaagaaggtggtctttggatgcctgtaaacccagagacaaagaagacatacggttactgcttcatcgagtataataccccacaggtactttgccacatgtcagatgcatttttccccttagagcatgacacatggcttgattcttgtctttgcaagtcatccctcagatctgtaccatttgaacatggatcacacatgagtacatgccttgagaacgccatgggcccaatcatttaaatattgttttgaaccatcattatttgcttcatccatgttcatttagcttttaatcgtttaatatgatgtaagatagaaatattgtgatctttacttatagtcaggtgaggaaaaataggaaattgaacgactctgtcggatgtttcgtttttatgttcatttttaagtctagtagggtttaagtttgtattactttgtttgacattatgtcaggaagctgagcttgctagggaaaagacaaatgggtacaagctcgacaagtctcacatctttgcagttaacatgtttgatgactttgacaagtacatgaaagttccagacgaatggatgcctgctgaaattaagccatacactcctggagtaagcattttcaactttacaccccccaaaagcgtgtttattttttaatgagcattttaattttgaaaattattaagatcctttttgtgacattgcctaatacctagattttgcacatgttttgcaggagaacttgcaaaaatggctggctgatgagaaggcccgggaccaatttgttatccgtgctggtactttcactgaagtttactggaatgatgcaaggcagaagatgcctgaacttgtgttccaaaagcaggtaccttgggtttcttgaattgaaattgaaaaatttaaggtcatgaactgtgctctgcactcccaatgcataactgaatatactcatcactttacctttttttttactcgtctagtactggacagacagttttattcagtggtcccctcttggaacatacttggcaacagtgcataggcagggctcccaggtgtggggtggcgacgataagtttgagcgtctaatgcgatttgctcatgcacaggtacgtgatttacgctgcactgagttatgtcagatatgtaatattttatctacctaacactgcttgtaacaggtgaaactgattgacttctcccctggtgagaaatatttggtcacatatagtagccacgagcccagcaaccctagagacactcatgtaagggaccgtcttacattcatttatctgctcatagctttcccttctgacttttgtgctggatgttgtagagggttgttcttaatatctttgatgtgaggactggcaaagtgatgcgcgactttaaaggaagtgctgatgaattcagtgccagtggaaatatcagtgtttctggtgtttcatggcctattttcaggtgaacacactggtttttgtatttgttattgaatgcattacctctttgttaagttgttgtacctgggggtgcttactatattttttgtgtctgaagatggggtggtggaaaagacgataaatattttgcaaggcttgggaagaatgttatatctgtctatgagactgaaacattctcccttcttgataagaaatctctgaaggttgagaatgttgtcgacttctgctggtctccaactgatccaatcatagccctttttgtccctgagttgggtggaggaaaccagcctgcaagggtaagtgcaattttctgtgcttcatcccttttgaggaagttccgtcaactaatggtgaagactaaaatctataatttttattgaaaggtgagccttgtgcaaattcctggcaaagaggagctgcggcagaaaaaccttttcagtgtcagtgattgcaagatgtactggcagaacagtggagaatatcttgctgtccaggttgatagatacacaaaaaccaagaagagtacttacactggatttgagctttttagaattaaggaaagggacatacccattgaggttcttgaattggacaacaagaacgataagatcattgcctttgcatgggagcccaaaggtcaccgctttgctgttattcatggtgatggccctaagcctgatataagcttctactccatgaaacatcccaacaacatcagtcgtgtgtccaagctcaccactctcaagggcaagcaggctaatgcattgttctggtctcctggtggaagattcattgttttcgctggtctgaagggctttaatggcaagctggagttttacaatgttgatgagcttgagacgatggcaacgggtgaacatttcatggctactgacattatgtgggatcctactgaaaggtaagcctatacttggtcagaaatttgtagtcctcaccatgacactggcactttattatgtcaaattttcaaaaaccaagtatcatatgccctacgaaaaatgttcactctaaatgaaaatttcaaaaccaactcttagaatttaaaatatttgagttttggttgcaatttttttataatacttctcactggtgtgactaaacaagttaagatggatttccttgtatgttagtggaactaaaatgatgttgggatttttttttgttagatatcttgcatctgcagttacctcagtccatgaaatggagaatggtttccaaatatggtctttcagtggcaagcaactttacaaggtgtcaaaggaccacttctttcaggtatggaggttccatcctacccttttctggactctcatgtctcattgctttacaccattgtaatcctttgtcatttactttaatttactggtacagttcctgtggcgtccgagaccaccgtcgctgctgacccctgaaaaggaagacgagattgcgaagaacctgaggaagtacagcaagaagtacgagcaagaggatcaggatgccttcaaccagctgagcgagcaggaacgcaagaggcggaagcagcttcaggaggaatgggaaggatgggttgccaagtggaagcagctgcacgaggaagagagaccatacaggatggagctcagagacggggaggccagtgacgatgaggaagagtacgacaccaaggaagttgagattgaagaggaggtagacgtccaagaagaagttccattcgagctggatcaggagtgaaaagcttatgctagcatctgctgagatctttttctgttgttgcctgtcttaagttaatttctgccccctttgcataa

SEQ ID NO: 592 - DNA, 4014 bp, Oryza sativa
  unsure (1)..(4014): unsure at all n locations
tttccaaatatggtctttcagtggcaagcaactttacaaggtgtcaaaggaccacttctttcaggtatggaggttccatcctacccttttctggactctcatgtctcattgctttacaccattgtaatcctttgtcatttactttaatttactggtacagttcctgtggcgtccgagaccaccgtcgctgctgacccctgaaaaggaagacgagattgcgaagaacctgaggaagtacagcaagaagtacgagcaagaggatcaggatgccttcaaccagctgagcgagcaggaacgcaagaggcggaagcagcttcaggaggaatgggaaggatgggttgccaagtggaagcagctgcacgagggaaaggaaaggaaggaaaccccccccaaaatttttaaaccccccaaagagggggggggaaatattttgggggggggggaaaaaaggagccccccttttttttccccaaaaagggnnaaaagaaanaacggggaggccagtgacgatgaggaagagtacgacaccaaggaagttgagattgaagaggaggtagacgtccaagaagaagttccattcgagctggatcangantttgagagcttgtgctagcatctgctgagaaccttnnctgcctaagtctgtcttaagttaatttctgccccctttgcataataggctttagagatcaagaacacaatttcttgatctttctggtttctactggttgattgtacactttgtccttggattttacggaccaatgtattcgaagatgaaaatttgcggttggcatactaattttaatgtgtcgttctccaatcctgcaaaacgcgttcacgtatttcctcatccacgcctccacataccctttagcaaaagcgcactggtgaagttttttttttgtttggtcacctacggttttcttggtttttgtcctgtagaacaagatcgaattcttaaatcttgtattttttaattagatcgggctacattaaaatcagattcagatcatcagatggtaaagcctggtgctgttcatcagatcatcagacggttttcaaatccgtcttcctgccgtctcggtatcttcctctgccttggcgaattccaagttcaggcatcccggcgttgcaagatgcaatcggacgcggtggcgcggagccccaggcaaacggtgagagtcggaggccggcgccccacggccgatccctcccgcggctcatcggaggcgtacggcttcgtgggatccatcgccgcggtggccgccgccgccgcctacctcgcgtgggcttacctgccggagccgtggctgcgtttcctcggtgtcacctactaccccgccaggtcggtacagcgtagtccatactcctcacgtttcagttgtttgtttgcttcgcctggacgagtgatttgagtctcatggcgatggcgttgtgcgcaccggtgtcggtgtggttttctttcaggcattgggcactggccatgccgtcgctgctgctgaaagcggcggcgcaggggatggtgctctacatggcctccaactttctgctcgctcctgctccgactttgcttggccactatctccggtgagacttttgctgtgctcacttcggtagttccgttccaacattgttgcattagtggtacatgttcagatattttttgccttttgccagatgaatttgcccgggagcctgcggcgtgtggtactgcaacaggggaggagaaacccatcgaggacatatcagatattagcattgacaagataaacaatctcatgtttggcaatgcatcatcaagctgatgcatttactacttctgatgaagctctcaactgatcaccagttgaccacaaacatgttttttgctttctcttggtgtgttgatggctcactcgtttgcaagctagcattgtgctattcacttatgattaacatggttatatgggttcttttaatgaacatgtttctgtactggactcatgcttgcagcaactgcatgcttaacagaacttcaattccactgctcaccactagtatgaactgctgttggttgtgggtataccacaacatagatccgaatgctaagaaaaatactatacgtacgactaaacttgtccgactttggaacgaccttaacgccgtgagctcgtgacgttaatctccgtatgaccaagccatgttgccaccatactaagtcacgtattgagttgttttaccgtttgatcgtacgctgatcggacatacaggtcgtacgtatagcattgttcgaatgctaaatatcaagtaatgcgcagtgctttaatttggcgaagcttcgttttattcaaatttcaaagaacacataatgtacaacacacaattgcacgaataactacgtacaaacccgcatatcacaaacttccagcctatcttctcattcttcccctccctaagttgctggtgcacgttgtaacaacatgttcttacttctcctcaaactccacatcaataacatcaggccctgagcttcttgaactgctggctcgtccagaggacctattgtttggctgccacactatgttttggcaattcatgcaccgaatcacttggttgcggtaacccacaaacctccgtttgcacgctgggcatgtcccctggaattgaaacacattaaatcagtaactacctagtattttgaaagcatcccaggttttgcttgactacgagtagtaccccacaccaaagaacaacagattaacaagagcaagttgatgcattatgatacccttgtatcactatgtgatcagggaaattaatttcaagccagagaaagccacttcaaccataaacaaaaatatacaacaaactcaaagtaaacacaaacatcaacagagtagagcactgtgctagtggtgctgcatatcatgtggctgatagtagcagtatacttgcatacaggttaaagcctcttaaaacccatttaattttagcatacaatatacttaacaattagtcagcaaaagaacagtcttagcacacactcgccggtggctccaaggccatttcaaaactgagtacaataaacacaggataacagaccaaactcagaaagatgagtattacctcaatggcgacccgattaccaaatgtcccaaggagaagtggcgcagcaaaaggcaggacaaatgtaccaaaaatgaaaactctgaatagccatcctgacagtgcaaaccaaatgaaaaagatcgtctacataaaaaaaaagcagctagtgagcacaaaatctcttgaaagggattgattatcatttgaagcagataatactacatacagtatctacaggctgttaaaaactacggtgcatacaattttgatcttaaaaaaaaatgtatgtgctacattacatggtttcatggacgtgacaacatgcaaaggtgtatatccaaaaatgataacagagagtactaggcaaaatgtctagcatttttttctcaagcaccagaaatctagtcacaaatgaaaggattggcaatgtgaaaatagagtcatctctctcttctttctaatgtttttagctccttcaaatcatagactatatatactaaagaagcacaaatattcaggcagctataaagggcttaccttcacatttcatgttttcaaggtcttatgatcatcttgtggttagctaagcttaggcagtagaactctactaaacaatctaaatgatcatcgtgatcaccaccatggcactgagttaaaaatgcgaacattttgggacctttggtgataataaggttatcttgatcatattcctttcatttggggtatagctggtggagtcctgatcatgttatcagctttggacaacgtgtggagtatactttcaggttcacttgcctgctctctattgtgctcattccaataacatcctgaaatccttggttgtttcaagtattggtctggagcagagcagggtgtcatgtggcatagaaatggaattctttatttgaattgtgctcacgttgc

SEQ ID NO: 593 - DNA, 8244 bp, Oryza sativa
tgcgggagaagtcgacggagaaggagcgccaccgccggccgatgccgagctcggcgtcgatctcgacggcgcgcgcgcgggcggcgcgcgcggcctcggccaggcgcctcgatatcgagaacctcccgtccaggcgctgcgcggtctggcgcacctcgaacgcgagccgctcggcgccggcgttggcgccccgccacgcccgccgcacgaagccgtcgaagtcagcgccgccgccgaacgcgcgcggggagaccgtggcggcccggctccgcctcccgtacgccggtcgaagggacacgcgcccagctgccgccggcggcggcggtggacgccaccgcgcgaacgtttccattccgggagaggcgagagagcgtcgtggcgtcggagatttttcgtgcggatgtggtggtcttccttcgtccgtgggccgtcttggtcgctttgtttacttgggctttttattctactgggcctaatattaattagctcgggcctaatgatcctttccggattcggaaatccgctctaatcattcatacgtgccgttgaaatgccatagaaaaaatcacacgggagatggatagcaaaatcgtcttttcaatggatgttttgtgttaattactctctccacgtacttgtttataacatttctgagttatttaagcagaagatgttgttgatgataatagattttttttttggcggatggatggaatagccaaagaggatatcataacgggggatttattgtattgttccttccatgcaaaacatgtatttttcttgtttacaaaccacaattcagtagatgcgtttccaacaaaagatagcaaattcaactgataaactatatagccattttcctgcagctgtttagttctatcaaaccatgtaaacatacattacagttattttcggcaatatgcatactgggagttttttacaggagtttttacagcaagtcacatgcacagatgatggtcaattgacaaactcaaaagtcctaagacgtgtgctgaccccggccccatctagaaatcagctttattttgttaggatagacagatgtataattattccagtattcatgttccatctgcaaaaaatgctccatctagtactccagaattccattgctccatctgcaaaaatcagacttgctcgacggcggcaaccgtaggttctatctcttcaagtatggacagtagctttgggtcctggaaatcttttatcagcaagcttgctcctgcatcttgcagaactttctctggattcctagttgtcagaccaactacaggaacatttgcagctacaccggctcgaatccctgacgcggagtccttgacaaggatgaacaccatgttagtactattttaacatgaatatagttagttctcaaaacaaaacaaaaaaaaagtacatgaatgtagttgatgataaaactgaagataactattttgtgaacaaaagtacaaaactaatgtgtacctcaaaaatgaatgtgtgatcaggtgatgcaccaataagctcaagagccttgaggtaaggatcagggaatggcttggctcggtcacactcgctcccgattacgagcaccgggaagaattcagtgagcccaaggagtgacagcatgagctctgcatttgaccttggagcatttgttacggcggcgcgtttcagcttgtgatcttttatccatctgcacagatcatgcaggccttctactgccaccaactgttctggagccaacctgcatagttttcggcttaaggttatcaggatgaaccaacctgcctgctagttctgaaaccgaatgactatgttatgttaggaaaattcagagttgtcagtgcgttggcattagcattgtgtttaggtttacagctgaatttctgcagaaaaactaaaatctgcaattagttcatctaccatatcatgctatagtatggaagaagataagaatttatataccttctgtacaatgcttccttgtcgtccatgaacttcattgccttgtcatgatccaaatccgggaacaaggcccttgcgaggtcatcgttgtgccccccgctgatattggcgctgtagaactcctcggagatgggcacgccattgttgaaaccaacctgtagtcattacacacatagaaacgcgaaggttcagaattgcagagtatgcagagaagcagagcataatcgcaagccatgagaaagaaggaaagacggagcaagcagaacctgctgcagcagttcgcggaaggcgcagaaatggataggatcagagtcgcagagggtgccatcgatgtcaaacaagatcgcctccagtggagcaagctttgacagcgcactgctgcttaattcagacagagagacacatagaggatcagttatcaatttatcatcagtatcacagtatgtttcggcgtttctggtttgttagaacagcatgaactctgaacatatgcaaactgaagaacgattgatcaattgaacagcacgagcagctgaaccagcaatataatcaatcgatcatctccctcccaactcccaagaaaattacagtaggatgctctcctatttcggagtataaaaaagaacaaaaaggaacagcgaaaatggagaatccatgatccatcttgtcagaactcagtaagaattcacctggtggcggctgccatgttcaccgggacagctgctctcctcctccaacaagtgctcgtcgtcttaatccttcctctcctcccttgtgaagctactgctgttgctgctgctgcaacgtggagaggaagagacggtgcaaatgcagacatataaaggagacgagattgagcgaatcgatgcaaagcagaggaggagaggcgattcccgaattggattcgacctgtgcagagctaattgtttaaagatgagtggcgaggctgtagctgcctgcaagcagtccctgcaacgtacgccggaggcagagcgcgaatggaggatgcatacgtggcgtgtgcgcttacgtacgtgtgggcgtgtggctgagagagagcaggcgaggcgtggcaacggatagtcaaaagggtgactggtgtgtttgttgctgtagcctgtaggaggctatgggcctaatttttcgcttatgtttatacttatcaattaaaatttaatttttaactataaatttgaagttaattttgtgatttttatcgaagtttatttttagcatttgtttttagataaccgagaatatgcatataaaaattttattcacaaattatgttttatttgtaaatatgatgtttaacttattccccgaaggggaataagcgatacgacgaaaaaatacgcttctttgactgggatagatataccaacggtcaaatgaccatccttccaagaaacttcatgacttcacgcaaaaagttgatcgcttgcatgtgaagtccatgtgagtctcacttattatattaatttaaaaccggccattatgctgataagagatcaaaattgatatggataggttatatctgatatttaggttcagggttctgatttagcgataaaatgaaggacctcaagtgaacttattatggcacgtaattccatcccgtcattaggccgcatgaagtcgaaatattagttcagcccaatcaacttttacgataaaagttgacaaggaagggcgagtgggcgactcctgctcccgacgagaggttgcacaatggagatgtgcgtggatgaaggaggtttcgaactttcgacgggttatactcacagacagacggtatttgtagagtatatacggtcgttggaataagggtatacacgagattaagataaaagagaattgcgactgtgacttttatacaggtttgagccccttaactaacatgtaatagccctattcctattggtcgaagctggtgttgtttttatatatcaatatgtcataagtgcaatatttgggatggcctaattaatctagtctctgtcggtttggcggcacagagctctcacatatagtcgagagctaatgtagtcttctttgtcgaatatgaactcgacgagattggaggtagcgctggatccttcatgtcggcctttgtgggtcctacgttgagtttgtttatatctgtattggcttgtcttgtgttggcgtgtctagatctgtctagacgtgttagcgagttgcatgtgcctccttttcctaggggatcttgtatttatatcctcgaatgttcccttattcaagtagaactaagagacaagtatggatacaatctaagcagtccttgtagtgtatgagtagaactttgcttttccttcattatccggaacacatttcgtataagatttggtatatggtgagtcccgtcgagcccaacccaaaactattagatatgtcttctgtataacactgccaggagcgcttagagatcatgacgtgctaccctctgcagacggatttgaaccgtattagagacttgacaggcaactggactaggatcttcatgaccatctccttcaacgtctatatcgtctaaggctgtgttcgggagacaaagttgggaaccttgcctcccaacacggaaaacaaagtatgcaattatagtgagattaattagtattagcctaaaaaacttgaaaaatggattaatatgattttttaaagcaactttcatatagaaaacttttgcaaaaaaatgcatcgtttaacaatttgaaaagtgtgcgtgtggaaaacaagggaaataagttaggaaagaggggaaaagaacacatcctaatatcctctagcttcaatctataaacaatgtttaaatacattattttattaagcaaattatataacacatgttgtctactccctccataaaaaaaactcaacttatagagtttgaattttgtccaacagaaaaccaacttctatcatcatacctaccctcagaacataaaacgagaagttttattcctttataccctttacctgcctatcaccattacattttattcaataataaggggtgttttggtcattttcatcctccactaattttgtgttgggatgctaggattggattttatgtgggacagagggagtacaatatagatgctcaaagctacatggagtatgctcactataaggatataggtcaaatcattgattccacccattagctttgtgtcccaaggtggtgagcagagaatgcagcatgggttgtaggcttccaccagaagagtcctctgttacaacatctttatgaaacgattgcaaactgaatgcccgattttttccaaaaaaatcgggcgttgtttcatcacttgtgaaacaatgtttcagcacttagtataagaatatttcaattcttgaaaatagtggaacacaattggatcaccagatgaaacagtttggttcaacatatgaaacaaatgatttaaagccattgaaacatcacaagatccaagtgaaaatcgaaaaagaaaatgaaacaccaccaaaaccccaatctgacaagtgaaacatctatatacatctctactattataaaaattgaagatatgtttgccggtactattataaaaattgaagatgtgtttgtcggtacttaggtacgtcattcgtgtatgagtcggtttttaagttcatttgcttttggaaatacaaatccgtatttgagtcggattttaagtttgttctgttttggaaatacataaggaattgtataaataatctctttaaaaaaactcgcatgctaacttgagatgatcggacttttaattatagctcatgattttctaaaaaaatatatatccaaataaattctcacagtgaattttatcttaactaaccatataacaataataagattaaaatagtctttacccgttgcaacgcatgggtattttctcttgtatattgaacaatattacatagatgctcaataataagatggcgatgtggcgctgccgcctttgccgttgcatccgctttaccccgcggccactagcgatggatccactagtcccactatcgtcggcgctagatccactcaccggtcagcgcagcgtcttccttgagaagggtggcgcgatgtcgtccgagtcatcggagtcgtctctgtcgccatcgttgtcgtccgtgccacgctcccctcgaagtccaacgacccccgccttcctccactgctacttgcggcagtcgctgtccccgctgatgacccctagctatgccccctcccctgcccttccccgtgccctgccgctcttccctgcttccgttgtccaccccgccgcctacagcagtaggtcctcaccacgagatagcaacagggggcgtcgggatcgatgtctggaggcacgaggagacggcggtcgaagggacagaggaggagaatgagcatggttagagcaagttcaatagtatagccaactactagcttcaattcatctatagccaatttaatagctcatttatacaatagttacatactacactattaatacatggtcccacctgtcatacacacactgtgtcttggagtccgtgctacagctagctacaaatctgtagcccgctgcccttctctctccttatttatctccttaaaatatgtttgcagctagctaatagcaggctatagcttgctattgtacctgctcttagagagcaagacagtggagcagtgcccgatattttctctttgaattggtctactgatgtggagcgtttttgacatctttatccaaagcagcaacatgtggacatatgcagcttgagtagtttataccttactaaaaacatgtgtctcatcgaataaaaacttttggaacggagaaaatagtcctccctccgtttctaagtatttgacgctattgacttttttaaatatgtttgaatgttcatcttattcaagttcctatcatttgatttattgttaaatatacttatatgtatatatatagttttatatatttcacaaaagtttttaaataaaatgaatggttaaatatgtactaaaaattaagtcaacggtgtcaaatactccctccatctatttttgatagtcatatttcatcttggcatacagactaaggataagtaattctacttatcatctatttaagcatgctactagtcattcttcgtaaacaaacgattcattaatatttatatttctcgatgtccatatagccaatcacgtattaaatccgagaaagtcattaagatgataggttgttgaattgaaatatggctatcaaaaataatttttttagatttggaaatataactattaaaagtatatggagggattatttagtaaggtgagggagtattagtttggcgtgggatatgtacatgcacgtatcaaaagataaagaaaaatcccatgtatatctcacccacgaagcttcgaagcgacatatctcacctctgtcactagaccgtgaaaaaaaaaaaggagactcgcacgtaagccatcatgaaagggaaagtccgaatggtcaagtctcagacacgctcgctagttctagttcctgcgagcgctcgctcgttagctctttcgcatcgagaagcatctattgtttacgctgcaaattgttcttgtgttgcgtcaatacatgcgtaagccactacctcttgcatgtatggctacagacgccgaacgtgcccaactaacatgcatgcatgcagctaactaattgttaacttgcccgtactcaactaaccacataagctaattaattactcggtcaactaatcaccaaacacatggctgttactacaactgagctaatctcctagtacatgcatgcatgcatgcatgcaatgtatatgcagaactccactacgtgtatgacacacatacacgactggttaatgcagatattctaaaacatatgcgagtcattattagtgctaacagagagatcgagcgggccggcgtggcgagcatggagatcagcgcggcccagtcgcttgtgagtatagatggccatgccggcacggcccaggcctggccgtgcctgggccaaggcttgtcgggccggcacggcccgaccgacgcaccgggccgtgccgtgtcagcccacgtgccgcactcacagcccaggcacggcccaacacgcctcgggccgtgccgggccggcccgaaggcacgatgggccatcgtgcttttcctcagaataagtctaaattttctccctcctattgggctgtgacattgtataactaaaaaaagtctattttacctccctcttcttt

SEQ ID NO: 594 - DNA, 27229 bp, Oryza sativa
  unsure (1)..(27229): unsure at all n locations
ccaggcacggcccgacggtcgggctgtgccggcacgggcccgacccaagggggttcgtgccgtgcttgggccgggccaaaaaggcgtgccgtgggccgggccttcgggcctcgggccttatggccaactatacttcggagcgaaggtcctccttcgaccgttgaggagtatctcattctccgccttgacctcaacgacctgccgaaacacgcgcttgagaagctccatgaggtcactgcggcggtccctgctggtgggatcgaacgcctgagacacggacacgatcgctcggtacgggaactccatctccagcagccggcacacttcctcgcccagcgtcgacttgccgacgccgccgaaccccacgatggagaacaccttgacatgctgctccccgacgagctgctgcttgatcagcagctcgaccagggcgtccgcctagcccttgatgccgacgagttggtggctgtcatggcggtgcgcgtgcgcagccaccggagcagcagttaaagaatatgactgataagaagggaataagcggcggtgctacagggcgtcgcggttgacgccgtaccgggcgtggcgctcgctgatggagagggcgcttatctcggcggcgaggcagcggcgctcgcggtaggtctgaaggcggtgcttcaacctgccgcgcacgccgtcgcccgggcggcacctgatgcggagccaatagaggccgacgcagtcctcggcgtcgtaggcgagctcgcgcacctgcttcatccactcccggatgaagtggtccacggcggcgccgtcgtcggcctcagactacatccggaagagcgcgttcatggtggccagctcgtcccgcagctccgcgacctcgccgcggacgccgctgagctaccggtactcctcacccagcagctgcccaaccgtgctcacaagtatagttggccataaggcccggcccacggcacgcctttttggcccgacccaagcacggcacggcccgacttgggtcgggcccatgccggcccagcccgaccgtcgggccatgcctgggcctccccgccagcacgctgggctggcccggcacggtcgggccggcccggcacggtcgggccggcccggcacgatgggctggcaggccagacccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggaaaaaatttagacttattctgaggaaaagcacgatggcccatcgtgcctttgggccggcccggcacggcccgaggcttgttgggccatgcctgggctgtgagtgcggcacgtgggctggcacggcacggcccggtgcgtcggtcgggccgtgccggcccgacaagcctcggaccaggcacggccggacctgggccgtgccgtgccgggcggcccacatggccatctatactccgaagccaacaaacaactcaaccacgacgatgctggcaagatgaagaaactcctggatggaatcgacgattggaaatacgagaaactggacaaggaactccggtcctatctcaaggacaagaggtacgtacgtacgtacggtactactaccgctccatcctaaaataattgtattttctatcctttacttgagaaaatacctgtacgttgctacggaaaactaaaattatatatgataattttcatgatccaagcccttttaagagaatatattcttcatgttacgcgcgcacataatttttgtcaaggtctaaacaacaggtaaattcttttttcataacagcctatttcacattacaccagataaattattctatttgtataagaccgtgacacaaaataattgaaatccgatcttgacacagacttcgtgtcacacacgaacatgatctcgataagatgtatagaaaaagttacaactttaatgtacaagtctcaacattcgtacctatgagattgtaatatcgcatatgcaccaacattaaaaggacgaatccaaaattttaagtaccatatccgaatgtataaaagaaataagaatgaaaactaaatgatgcgggatgagagcataagttacatttttttacacatgcatcgactaaacttagaaaataaataaaacaataagtttttttctaaagatttcagggaatcaataatcactaaattgactcaaaaattaaaaattctccacggataaatctactcggtctagtaggttccaatagcctcgatgaacatatcgtaatctactcggtctagtcggttccaatagcctcgatgagcagatcctttgcccaactaatttttttgtacacttatatagatggtgtaattcatagtaaaaaaagaactacttaacttttttagatagctcccacatataagatggaaagctcgtgggggtgtgttagtgtaaaagaattactatcagggtgcaggagggggcacgtagtaaatgtacgtagccacggtaattctcacgttgtcggtctttttttaataaaatgaaaaatgtctcacaactttgacacttaattactactctctccgtttgacgtttttcttagttaaactttaagtttaaccagtttgtacaaaaatatactaacattttcaatacaaaacaaatatattatcaaaatatattcaatgttaaatttaataaaactaatttggtgttgtaaatgttaatatttttgtgtataaacttggtcaaacctaaaaaaatttgacttaaaaaagtcaaacgtcctataatatgaaacggatggagtagtttgtatatgtctaaattatgttttgaataccaggtctgttttttttatagaaaatgtcttactaaaccatctcacacatttggggactcagggacaatttcattttttttaataaaaaactaaatggggcaatttcatcttggatctaatacgacgcatcatttttaagtgaatgtacaacaaatctaaacatactctacatacaatatatactaagagcaattttatggtccttgagaaggtactatgaggtaccactttttctagagatttgctccggtccaacaaaaaatacctcgaggtaccggtacctcccggtatcaaatcatttacgatcgttggatttagctagacaagatggacatttatagatccaatgattggaaatgatttggtaccgtgaggtgctgatacctcgaggtactttttgctggaccagagcaaatctcatttttctattgtaaatttggtacctctttgtacttaagtactagaaggtactaaattttacactaaatttttggtacctcacgtatctcctcaaggaccgtaaaattactcgtataataatgcatacgactagttaactgcaggtacctcattatggtggatgacatatggaccatacgagcgtgggaggcaatccaatccgtgttgtgcgataacaaccgcggcagcagaataatcgtgaccactaggatagaggctgtggccaaagcatgcagtcctgctattggtgggcaccatattcatcatacgcaacccctcgagtttgaagactccaagaagttgttcctcagcagaacatttgtcaacaaggagtgtcccgaggagctggaagatgtaatggagaatattttgaagaggtgcggtggcctgccattggccattgttagcattgctagcgttttggcaggttacacgtcaccaggaagcaaggacaaatgggaatcaatctacaaatcaattggttctcatatggagagcaacccaacccttgaagggatgaggcaaatacttgcactcaactacaaccacctgcctcatgagctcaagggttgcatgatgtactttagcatcttcccagaggattatgaggtcaacaagaatcggctcttgtggagatggattgccgaaggattggttacggagaaacggggcttgtccctaatggaggttgcagagtcctatctggatgacctggtcaataggaacatgattcaattgcgtgaagatatcgagtactattggaaggcccagatgtaccgtgtccatgacatgttccttgaggtcatggtgtccaagtccctggaatctaattttgctagcctgctaggagggcagtatgcaacaatgtcgtatgataggattcgtcgcctctccattcagggcgatgatgacaggcttgagaatgcagagcagcctaggaaaaatacggcagcatccgcaggcgtagatgatgggatactggatttggagcatgttcgatcactaagcatgtttcagcatacagggaagaaattgctcgatcaacttggcaaattcaggctgctgagggtacttgacctggaaggtttcaagggcgccctgactaaggatcatatgggctatatttgcaggttgtacctgcttagtttcttaagcttaaagggcatagaagtcgaggaggttccaagtgaaatcgggaagctagaacatctgcagacacttgatgtacgtcagacgtcagttcgcgggctgccacataccgtgacgaagctgtataaactcgagcgcctacagatctcctataacggtgatgccaatctaatgtggaagctacccctggagcttaagaagatgaagatgctgcgagaggtgggcttctcagtcctcggaaaccatctccaggttgcacaagatgttggtgagctagatcatcttcaagagatggttgtctacgtcgacgacatcaccttcgacgacaatgttctcacagagttcgctaattctttgagcaagttatactcactccggcgcctcatcatcggagacgtgggctacggcaagactctgaactttctcgaccagctcccctcgccgccacaacttctccggcaccttatgatcgccggtggcatcgataggttgcccagctggatcatgtcgctcacataccttgttcagttcaacatgtcgtgggggaaagttgctggtgaccagctattcgatgtcctgtgtgagttgcccagcctcgagaccatctgcattcacaattattgctacgagggcaatgttctagttgcacgcactagacacaggtttccggagctcatcactttaagaatagcctctggatcaaagcttcccaatgttattcggtttgagaatggaaccatgccaaagctcgagaacctgctagttaacttcactgacaatgatgagaagaagattattggcatcaggcacctgaccagcctcaaagaggtacagctctggggtaacgagagcaaccttgcactacatcgtgcactggagcatctcaagagtgagaacaagaggcgcctttttgagttcagtagccagtttcaaattgtagtgaaatacgagtgatttctcttgtggtttccttatttgttagtttctaatttctcccagatatcaaagtaaactatcctattatacgcaaggatgaggaatgccatcatgttaattaagatgccatcttgccgattggagagcacgcttatggagatattcactagacatgggtggcggttcattgagggaatcgatgattgaacaatgttgtccatgacttggcattcgatttttttttcttcttgttgttgcttgatttgtcacgttttgttttcaagtttgtaataatgtacggctatgtgcatcatgcatatattgaagaggctgagatgcatttgttttttttcttcttggctggtttctcatgttttgtttacaagtttgtatgatcattcttattcctttaaaaaatgtattactaacttagtaggtgggcgatttagtaaagaacttaagaatcaaacatcaaagtgcaacaacttaataagtggatgtgttctagtatgagaacttgagaattttgtattttggtgcagcaagttggctagatatgtttgttttggttaataagtgtttggtgagattttttacgaaacaaatataccatcacataataatcttgcggatatatattaccttaccatcttggatttaatctataggctagaattatgttgctcatccaatttgcaccatcagtttggagtttcttattcaacttcttaaatctcaatcgaaatacaaaatttatagaaaatttagttgacttttagttactagaatgacaaattttaagtatacttatacaaatttgtgcaaatatatcgacaaaataagtacgtcaaaactaaatgagtacataaaaaaatcaaaataattaagttgttgcgcatcacttcttaatttattatagcaaaaccacacccatcttacaagttgttgtattcatgcgctcacttattaagttcatatactagatttcacccacctattaaattgttgcactagcatgcttacttctcgagtttttatactaaattgtacccacctattaaattgtgccaccggcatgcttacttctttaagttctcgtactaaattacacccacatctaagttaatgtaccatgaatgtaatttaattatagctcatttacctttttttaattaggtcgcctaccactgaaagtctaagttaatgtaacgtgaatgcaatttaattatagctcatttacctttttttattgaattacgtcgcctaccactgaaatcacaacgccgttaaatccagaaaaatccgctcccatagggagtcgaacttaggacctcaggtgctactgaggctcttgtaaccactatgttacaagctctttcgtatagcttatttacctttgaactgtgtatttattccaatcccaccctacacagatattttattcacgagaacaccagctggtcggttatttcgaaaagaaaaaaatatatttatttctgctagcaataaagggaatgactaaaatgttctgctagcaacgaagtaagtatgtgatgataaaattaacgaaactaattggctaggtttggcccagaagcaagcaaagaaaaagaaaaaaaggacattaaaggaagaggccagagcgaggcccatcaaaggagattttttttaggaaaaagtacaccgaaggtccctcaacttgtcatcgaattacaaaattatccttcaaccgcaaaaccagatatagaacatccctcaacttacaaaaccgttcattttaggtctttcggtggttttaaccccggttttgtctgacgtgacggctgagtcagtgtggaacccacgtgggtcccacatgtcagactatccgcgtcatcacctcactctttccattgtttcctcactatagttggccataaggcccgaggcccgaaggcccggcccacggcacgcctttttggcccggcccaagcacggcacggcccgacttgggtcgggcccatgccggcccggcccgaccgtcgggtcgtgcttgggcctccccaccagcacgctgggctggcccggcacggtcgggccggcccggcacgatgggctggcaggccagacccggtacacaaagtatagggactaaaaatagacatataaatgtcaatgtctaaagaatagggaccttaaatagacttattttagctatttatataccatagcacaaagaagagggaggtaaaatagacttttttagctatacaatgtcacagcccaatagaaaggaaattattttgttctttttctgagaaaaagcaagatgccccatcgtgctttggggcggccccggcacggcccaaaatgtgttggcccgtgcctggtctgtgagtacggcacgtgggctggcccggcccggcccggtgtgtcggtgggcctgtgccggcccaacaagcttcgccccaggcacggccgggcttggnccgtcccgtgccgggcggcccacatggccatttatattcctcacctcctctctctcactcttcatctcatttgggcagggcggcggcaagtggtgaggtggctggcgggccggcagggtaaggcaggagagcaggcggcggcggcgcccgagcagggggagggccagctgcccgtctgccccaacgccgccgcggcgcgtcgtcgtggttgcgggagaggctatcaaagacgaggaacagcgcggcacggggccgaaggcgagcacggtggtaggaggaggagggcggcggccgccgggcaaccaggacgacggccatcgcgccgcggcgggatccggcgggaacgagggggacgacgacgccgacgaggaggagaggatcccgtcgggaggagcgggcttgggcgaatgatatacggtggcagatcggtggaggtggcggcggagcaggggaaggagcgggcgagcgtggcagcgtttacccgatcttgcccctgacgtcgaagccgtcgagcgagccattgccgcagaactcggcgaacggcttcccgctcgcgccggcgtagaccagtgggtagaaggtgttcagcgagtcgttcggctggtacaacgactcgccgtcgaagtagaggttgttccctaagcgcaccgtcgtgcgtatcgaccggtccatggtgctagcggcaacggtgagcatccacggtgccattgaagtcgcaggctcgcagcaccccttccacttggctggcggcggcggcatgccggcgtcgctgaaggagaggtggtctgggaacacgccgacaatgacgccagagccagctcccgagccgccgtgggatgacgacgaccaccgcttcccctgcggtggcggcggtggcgacggagcactcagcccgaggaactgcggcgtgtgcgtctncacgctctccacgctgtctccgagacgcaccgttttcgcgctctccacgctgtccgccggcgcctccaccgttgcggagctcgggagcccccagttcgagctctttcttcgccgccaccggcctccacgtccaccttctctgctgggaggacaacaccgcagttgaggccgacgtcacgcacgcgaagaagagcgcgtcaccgtcacgacggggagcgcgaggatcacccaccgaagctgccgctccgccattgccctcgcccgccggaggtcgaatgccgtgtcggcgagggacacgccgctgccggagcaccgcaaagatcgtgtggtacctgcgcgccgcccctccgtcgcccgcgagcggctccttcccccgccacccgcagctcctccccccacccctcagctcctttctcccctggcgccactccctcccctccctcctccgcctggcgctgccccgattcctcccctctgtgccgcctcccagccgcgcgttgccaagccgccgcgccgcgcagcctctctcctcccgcacgcaaccgcgccgccaccaggctccctctccctgccgccaagctctaccccttccacgctgccggccgcctcttccccaccgccgccggccatcacctgcgtctccggcatcctccctctgctgcgcgctcgtgagaagtaaagaaaaaaaagcaaaaaaagagataaggacagaggggagagatgacgtggcagcttgacatgtggggcccacgtgggtcccgcgctgactcagccgccacgtaggataaaaccgggttcaaaaccactgaaggacctaaagtgagtggttagggatatactatttctggttttgtggttgggagacgattttgtaattcgatgacaagttgagggaccttcggtgtactttttccatttatttaacacagacgcaaacgctgatatacatgtatgcatactcaccccacaaacacacatacttggacccctagggttcattgtgacctggtcctttgttccctaaaaatatgtgggccgacccacaaacttttggtgccaaatttttagggtcggcccgcgaatctaatgggccgctccgccccctttgcaggctagagccagagatgaagcgggaggacgcgtcatcgccgacgagcaaggctttggtatccatgacaaacctcgcatgacggtggcgggagcagtggtggatctaggatttaggatatggataatccgatctatttttttctaaacacaataaatctatcgatactaatatatactccctccgtttctaaatatttgacgccgttgacttttttaaatatgtttgaccgtttgtcttatttaaaaaatttaagtaattattaattattttcctatcatttgattcattgttaaatatacttatatgtatacatatagttttacatatttcacaaaagtttttgaataaaacgaacggtcaaacatgtgctaaaaagttaatagtgccaaatatttagaaacggagagagtacaatccaagtatagataatagaacagaccaaattactattatatattaacaaaatatcttaaaatatataaaattagtaattaagtaaaattgaaaaagatagataagtagaaaacctagaaattgttgtcttgttggcgcgggcggctgatcggctcgacgacggctccccgcggcgacggcacacgcacagcaggtcagcaccagtggcagccggactgcagagcagcgcagcacagtagtggccaaggcggcggagtgcgggactcgcgcgcggcggcgtgggcgtgggggcgcgggcgccgggtcgcgcgtgggctggcgcctggcggcgccgtacggctctgtgactggctgatcgcgtcgcgtgcccgcgtggaaggacgacaaggaaggacggctatgctgccaacgcgaggtttaacaccggagatgcgcgcggatgaaggaaggctcgccaccctctgcagacggatttgaaccgtactagcgacttgacaagcagccggatcaggatctccatggccatctcggcatctccctcggaaggttggccgccgccgcacgccgtactcctatatatatgcttcctctccctcttgctcctcgtcctcacgttcatgccgtcgtcgtagatgctaggtgcatacagtacttgcagccaacactttgctagtgtcacatcacacgtgctagtttaattttattgtgaatatacgtttattggttgatgaggacatcaataccatcaatacatccacgtccccccaagtacaacttcatggtcctattacccactctcgtgcacgtcaactcaataatcatgtgagttctttcttaagttcattttcctcttctttatatcccggagacgcgtgcactcttgttttactcaggaacgatgatggagaggatccaaaagggagaggatttccacgggttggattcggaccggtggacagcaccaacttctaatggtcgccacaacttcatgcgaactccgatttaggcatgcaagtacttcatggaaagcttatcaagtctactttcaaatggatctagccacatgtccgtatctgttctggagcagccgcaattatcattttagtcccgactgctttctgtccatggtgctgcgtcacctcctttgcccaatgggctgtgtatcaagttgggcccattaggggcgcgtttagggttggagcacgaccctgtgttgttcttccccttttcttatagctctagtcgccgtaaagaacaccggggttttgatgatggagttagctacttactaccggctcgcaacgcgcgtgttggctaaaccgctcgtctgcttgtaatcagaaccctaccatattgtgtttttgattgtgaaaactttcatcttcatctagcaattcagtgcttgttctacttgttcttgcttgttcttcgattgcttgcaggacgagtgccctcgtggccgggttgacgcgcaccacaagttcacggtgaccattggagacggtgtatcggttgctaaggcgcggtgtctttggacggttgtagtcagaccgtgaacgtcgtcttcatccaatcgagttatcccccacctctcatcgaaagattgggccacaaaccctagcgggttcacatcattggttgtagtttaatttgtcttttttattgtaatatgtaaaagttaaattttaagttgcatgtttatgaagtagtataccacgtattaacacgttttgtcaatttttttaacattttcgtaactacttaagtgatatacaaacaacaggtagacgtcctttcgagagtttagaatagtttctctgttacttattcacgaacgattttgctatccatctctcgtgtgattttttctatggcatttcacactttattttggccgcacgctatgcaccacttgtgatgtgagctgcagctcacggcctgtgtcagctagcccatgcgtgcaccatgatagagaaacacggtggcaaggtggcctctgaccggcgagccggccgccggcagtacggccaacgctattcggcgagcgacaccgtccctctcgtcgtcgtgaaatataaattacaatactatataactaaaattacatttgtaaatttaattgatatgacatgtaagtgcactgtaatttttgataaaaataatgtgtaagtaaatatgcatttgttattttctttaaaatataaaattacagtcctatataactaaaattacatttgtaattttagttgatatgacatgtaagtgcactgtaattttggtataagtaaatatgtatttgttattttctttaaaatataaaattacagtcttatataactaaaattacattttaaaatataaaattacagtcctatataactaaaattacatttgtaaattcagttgatataacatgtaagtgcactgtaattttgataaaaataatgtgtaagtatatatatatatatatatatatatatatatatatatatatttcgttggatgtaaatataaaggtagaaaaaatctgggtgattttttttgttagaaatcacacgacaaatggatagatagttccttgaaaagattagagaacacatgtagaaattggggattgaactcttgcattgcgatgagctcaaagagcaaaatatttgtgtacaatagatggaaaattaccaaactacccatagacacatatactaattattactactcccctgtttcatattataaatcatttgactttttcctagtcaaactttgttatgtgaccaagtttatagaaaaatttaacaatatctaaaatatcaaattagtttcaagttgaacatattattatatttttctataaacttggttaaacttaaacaagttgcctcctgggccaggtccacgagtctccccgcctagtcctttggaaactctgtggcacttgaacacaacgctaccgcggatacactgaaaactctgaattttcctaagataacataacaattcggcttcagaactagcagtgtgtttcaagcacagctcattgttctccaattccaacagaggatgttaatttcaattccaatattgatttacacaaacactgaacacagctaggtcgatacaaaagatgtccgtactgctgtttgattcatcctgactcctgagaacctgaagccataaactatgcagtagaaggcctgaaagtatggataatttgagcgtgttctggagctctgaatctttaaagacagaacatgagaatccgtcatcccaggaatctagaataacagagcctccagaatgtccagttctccacattgccaatctcaacgcaatgccactgtgcttataacaagcatgaagctgctgagacctgaaaggcatattccctcttcatgccgaactgaattccttgctgcagcaagccgccatggaccgaaaccttggactcggcgaaccagcctcggtgttctatgtgggtacaatggttacatcatgcgtttttttgtttgactgtttccatttctggtaaccacatgatctgcagcagagcccctggccggctgtagtactaaacatacttgctacaaggatacacggataagtatattatcatatattttaccgcctcgacttaaacatttggatgaactagttgacagaaaaactagtatgggtcattgataattgaatcttgctggatgatctgtccttgatcacccaagcaggtagtgatcagtattcagtagtcataactaaagaggtagaggtagatgacaatagaccggtccagtagtactggccatgtgggcccctgtctctgactatcccagcaacggccatcaggaatacgtgccttaaatccagcgattaagacagcaattagtaattattgttgttattagcattcgccttatgaatgtcaatgatcaacctgtctgctggccctgccttgccgcttgcatcgtctcagctgagttcatctcagctcagctcaatttcacagcaaagaaaaagttagcatctgattcatctcttcttctctctgaactctgatgccgttgtcgttctgtatcaagtctgtccacccactgtcattctgacgaagagatggacgatcaggagcagatgctaatctgcacatgttgaccatgagattcgtgatgagcgacgtgtcgattagggataagctgcatgtgatgatccctaattcaagaatcaaccattgcacatgtagtgtcaaattgacagtacatttctcttccactcagggttagcggcatcagtacacttgaaagtactaccagtttgctttctgccaaagctgtcgttatggtctccctctctcttttgttcatcttttggctacacactcattcccaatcactgctaatcctttctttgtttcggcattacaatcattgttatctcttcctgtctagcaagtaatttctgacgttggccaattcactgttcagagaaaccgttttgccatctgttagatactttctttttcagatatgcaagatgcagtgcaaattttgcacactcacgcgccataagtggtaatcataaaccatgccaaattgcaattagaagctggaccatctcctcgagctcatccaagcgcatcaattttgtgatctctgagaagatccatccattccaaatcagcatagtgcacctgctccttctcacagtttactaatctaacatgagcagcacaagttcctgaagaggaaagactagtctaaaagacgatatcgaaacgaaaaccaattcggaatatagtagtagagaggaggagagattgcgtggggatagcagaattataataataccgaattgatgatctgactgcgaatgcattgtaaacgccgcatgcttctgcttttttggtatgtttcctccatataaagacctctacccatgcaggtgtcactacatcagtgcatccaggacttccttctaaggtaaagtcttttctttctctgaagtgtttatcttcagactagttactacttactctctcttgttctaactactctagttttttttctctatgtccctagcttcgctttccttctttctctcttgtctagctatctttctttgcatgtctttgcattgagaagaaagaactctgtgtcagtttattggagcctgttgttttagacttgcacagcttcagtgatcaatggtcaggcatcgcgaatgaaaatgccaaaaacacaaactgtagctttttggagcttccacgtattgttttttcatgtgtggagtggttcatctcgcctgaaacgaaacgaggttctgaaatcattcagcatggacagtcaatagggcgatgcctttaaaaccaataattgctattgttctctagctgttgttctctagtgtattgtccatagtaagaaagacgaatcgctatacagttgcggagttatactgtaggtaggcttttgatgtcacaattagtggacgacaagaacttgggggagatcatcactatgatttttttcttcttcttcttcttcttcttcttcaaagatcagatcactataaataggcattgtcattctaaaaaacatacttgaggcaaggcaatgccatgacaacatcttctcatcgcaccacttgattctttcatagtagtatttctcaacgcagattgatttgatttgatctgatctgaacagtgtgtaaatggagcatctcaagaaaggagtggagtttggggtggcctccctgcagagatgccattctctgtcgtgtcaaatggtgatgctttttttttttgcaaatctttcgcgctaaaaatttcttttcttgttcacttttatgcaaaatggaccatacatgtcggctaatgctagtactatgaatttggcataaccatctgcatatatatatacatcccatgacaaaaaggaaaaatcagagaaaacctcagctgttgctgtgatcaacttggtgactgaacttatatataacttcaacaacatatataattcagcttgtatcatgacttagctaccatggtggttttgctgaatgtgcaaacaggcagagagcacgcagatcgacgagcggaagacggggaaccgatgtagcaaggagaaatcacggcgtccgaaatgctgccatcctgcagagatgccggtcatccccgagcaggcaatggagttcctctctcggacatggagcccttcctcctcggatctcttccaaatcctctctcccagtgtatgtttatatgcacacatgcatcatctgctctggaccacaccgatgattgattcagttccattttacaaactacaaaatcaagggtgttgacatatacatattaatatattccaactcaattatcaacatgtcatttccattttcatgttttatacaggttacaatttcagttctgtcaacagcagcagcagctaaaattaattatattcttctttttttaatgtttcttttgcctgaatctatagagcctgggaacatcaccggtaaaccgtcaggaagactaggtgatcggagacgaagacgttgaggtacatggggacacggttcgatttgatggaggcagaagccaagtgttcaaccagacatgggtaagccaagtgtcagccactacatgatgtagcttattatttatgcaagagacatctttctgatcttcctatgaacgatcaatttcttgctttaccttgacagggaattctagccagtgggaagtctagctcaggacagcacaaacataagaaccaacccacctgggtaagggcatatgtagcacagggagatgtgacaacactaagagtaaggtcaatagtatagccaactactggctccaaaacatctatagccaatctaatagctcatttatataatagttaactataaaaatatactacaccattaatacccggtcccacctctcatacacacataacatcttggagtatgtgttgcagccggctataaatctgtagcccgctttcttctctctcttctcttttcttctcgatatatggttatagccggcttatagcctgctattgtacctgctctaaggccctgtttggttgcagtgtattgtagtccattccaaaaagatcttatttctggctatgcacatgaataaatatttgtccaggtgcatagacagaaataaaatctttttaggacggtggcagtagtattttgtcagatttttcatttcaagacaaggccatcatgctttgtcggatctggcacagtgaagtgaattgacgaaagcttttggtttccactgaaaatgagcagctgaacatgggacacatgagggcaattctgagaggatacttgatggacagcatccccatcgccgggagtcggaggaagaggcgcgacgagctccggctgcacacggcgcaggcccacgccgccgtctcggtggcccagctcgcagctgcgatcgccggcgtcgtgtcagcttgcgagctgaggagcagctctgggggtgctggggctgacaggaagctgagcacggtgcttgcctcggctgccgcgctggtggccaccgtctgtgccgagttcgcggagtctgccggtgccgacaggtcccgggtcacctccgccgtgaaggccggcctcgacagccgctcccccgccgagctgctcaccctcaccgccaccgctgccacatgtaatcaacacttcagtggtgaaactcaaccaagtgatcgaagctacaaactcactgatgctatgatgctgagcttcttgtatgctttttccaggtctgagaggagcagctgtgctgaagctgagagcagacgtcagcagagggatcagcagcagcaccagcaactccatgatgatgatgagcaccaatacagctagcattcagaaaggcacaattctcagggtttgcctgccttgtggtaagagaccaaaccaatgatattagtaccttaaaaaatagcatcactactagtagtactacattgttatgccctagtacaaagtactaagactctgactatgaggagtactaagatagtactactcctaagtcctaagagattatatttccttccccaaaatattaaaaaaagatagtaattctaagagattttgtttcttaaaaatgaagatatatagtactcctaggatattttatctgttataaagaaagaaggtagtactagctcctaggatctagcattgagcatggtgcagcaagcaatctaatgataatatgatattggggtatttgggtggcattacaggaaggttgcggctgaggacggtggccgtcttcccggagtgcggcacggtggctctgaggctggggaagaagcgcctgcatggagcattcacaacataccagcactgtaataattaaaaaaatttacctgcatgaaccagctgaactgcttgccactagtgtattgatcttcgttctgcttgtcggtgatgatgcctgaaccctgttgtttgtgcttggtccagatgaggtgttggcagtctctggcggtggcgaggcggtggtggattgtcggaagttcttccccgtggcgctgagcacggcagcagggacggtgcagctgctgctggacaaccagatgcactgcaaggtctggaaggcttccatcgagagcatgctgtccggtcgaaagctcaagcacaccaaatgctgattaattagagccaggaaaaattgccttgcttttcttaccatgttgcatcacccctgtacatgcaatgtatgtgatgtgagttcttaatatacaggtaaaacataaacaactgtatagtataaaattataatttctttaaacatcactttccatgttcaccagataaccaaaccttcctcattatgataaccctttcttcctcgctaagagaagagaaaatattacaaacaatcaaaacagagcaaacgtgttcctaacttcagctcaccagtaaaagtatgatactaagcagcccactagcatcgatcatatgaaaagaatacagcaaaaggtccttctccataaaaaaagttacactaattcagatgtgacttgttatgttttcatgcgatgcacaggcttgcctgaaacaaaggtttggcagatggtagcaagacaaaacaagagaccagttctttctttttccttttcatattttatgttgagaaaaagaggcaaggaagaaataatggattcaccagctgggcaggttgtcatcagcattcagcagtcagactgtgtgataatgtcatcaatcttgagaatcattttcaccacctgagttgtcagcacgatctgctgctgcttgttttgttctctgatgccgtttgttcgaatgcaattgcagtcaataccatgatgaggattgctatcttgcaaaggtagttcaggaggctgggaagttacccacaatattacacaatgcttcaaaataactgatgtgcgaggatgctatataatagaaagaacataggttccttagcatatcatcctataactagagggttctctattatatagcattctatatattttcttgcatccaccagattaactaacagatagtaggcgtatgtgctggttgagttgatggcatatgaagcattttttatgagcccaaaacatactaggagtggggcgacctaatcagactaaatgtagtcaattaatgtcaactataagtctataactaaagcaacagaataaagtttaaggattaccaaaaaaaaaaaaaacttcacttgctgaggatttactgcagtcgacgtatcaaaagggggcaaaccactgttttcagctagggctagtgggatcccatccaatgcacctcaaatggcatgagcgatgtgtgggagagacgtctcagggagatctgcacgtacagttttcaggtatcagataatgatagcatactccaggtacacagacacaatcagaagacaggcagacattgcttcattttgtaacttaaatgtccaatgtcagtacttacttggtcaactccaggctgttgatctgctgcagttttaccagcaactagcatggtgacccgcgcagattgctcggctagcatcattatattttctctcatataatagcatatatgttttctcattatattattcaaatatattaaaatgatatcataattttaaattttgcaataactttacgaaactacaaatgagtaatattcatattgtattttatatacgtgttggttagtaattatttttaatatcaaattttagttatttgtaaattatatatattcctatatggactctagactcgtcttttaatatttctttttttaattccgaattttctgtaaattgtatttctatatagactttaggctcttcttctaatattatttatttttatttctgaatttttattatttttaattgtgtttctatgtggactctaaactcatctctcaatattatttaatttttaatttcgaatttcagttacttctaaattgtattcctatattgactttaaactcttcttcccatgtttttcttaatttcgaattttagttatttgtaaattgtatttttatacggactcaaaactttacttttaattttactatgtttattccgaattttagttagttttaaattcttatatggactctatactctacttctaatatttcttattttttaattccgtatttctattttttttcttaattgtattaattgtatttttatatggactctatactctacttctaatattccttatttttaattccgaatttctattgtttcctaattgtatttctatatggactctatactctacttctaatattccttatttttaattttgaatttcagttatttcctaattgtatttctatatggactctagtctcttcttctaatatttcttatatttttaattccgaatttcaattatttctaaattgtatttctatatggactctagtctcctcttctaatatttcttatttttttaattccgaatttcagctctttctaaattgtatttctatatggactctgctttttctttttctccgattaatgtgagaatttctaggccatgagagcgaacgtggaggctcctttttctattcctttaataatataatagatttataaatagatccctgaaaaaaattatttcaagaatgggttcttttcgcaatgccaacatcattagcgccgtagatcaatgtgatggtgccagctatgttggcgcccctccccttttgccttacacgcaggaggctggcattccaaatttaccatttttcatgcaaatttataaagttatagttagttacagtaaatttctatcgtgccaccaaatttgtctcctccatataatacatagctacaaatttaacttaaatcaattttttcatacaaccatccattcatgtctcaactaaaaattatcattaccacatatatgcactccaaaaaatcatagcaccaacgagcacattgtgtacatgtaacactacaatcatcaaatccccaatttcaacggtcagaatcacaaaatcgggaaaaaaaagagttctagagttaccctccgatctaaaacgcaaaaaaagagggagaatggaggatataccttgctctttgattttcccaataaatcttgtaaaaaaaatggctccaaaccgaatggatttaaggagaagaggtgatagagagtgcacgagatgcactcgagctcgggcggaagaggagggggcgaatagccggggagtggatgtacggggtggggctcgtgtgcttcccccctccacgggtagagcgtgctagggctgttggtgcacggggagggtttggcaatattgttggcgcctagtacctcctgccacgtcagtgccgggccgccgtgtggtgccatggtgacggcgcaagagaccgtccagttggacctcgacgccagcaattctagcgccaaaaaggatcattccttaaataagttttttctaagaatctatttataaaataagtttgtgaaaatgaccaaattgtaaaaaatcaaggagagtacatgacaacctcgtatacacatactggatcttgtgtttgtagacgactataaatttgtatccctctcgtcttctgtcttctccacccaagtacaaatttgaagtggcaatttttaattttcactcacaacacttgttatacttgctctaacacataagtatctgatatacacccaaaaggtatatgcgagctacaagagtggattattgggtgaaatcagtcaagccctccaggatggactaatggaattagaaacaatataattaattttggtgccaccacgagtcatgctgcagatggtaaggttagttgttcctgattctctttaattaatataactagtattatggctaattacgtacacgtgcatgtcgtggaatcaaatcaacgacaacttttgctggctagtgccaaaccggtcacaggaagaaaggaggacatggcattgacccatggtaaacgatatggcaatcgaactgcacgcactactcactgctacttgctccgtacaaaaaaaaatcaaaaactggatatgacatatctatcatagtacaacgaatctgaaaagaggactgtccagattcattatattagaatgtgtctctagtattaggttggttttttatgggacggagggagtacgtaacatgcctgctgctagctagctagctgtgggtctataaatcgtgaaaactcaacagctatgtagagaagcaacaaattaaccaaagagggtgcaatttcagtcagagtagggagaagaaaagagttagtttagaaatgaggaagcaacacacttcttctgctgttgctgctgttgctgcgtctctttgcaaggtgctcctgatgatcctcgccctcctctgcaccctgcacactgcctccgtggtcgaaggtaaatatatactccctctgtttcaaactatttgacactgttgattttttatacgtgtttaaccgttcgtcttattcaaaaaatttaagtaattatttattcttttcatatcatttgatttattgttaaatatactttcatgtacatatatagttttacatatttcacaaattttttttgaataagacgaacggtcaaacacgtgctaaaaaaatcaacggtgtcaaatattttgaaacggagggagtatttactagtactccgttcgatcgagttaaattaactttgtgggtttgtgcatgctgcatgttatttataaaattaacgagtagatcgatcagtgacatgctatacacagtgttaattgggtgaatgaagtgtattgatcacatgatatatggatgcagggagatcaggtcctccgaacgggccgccagctcctagtgccaacgaagagcggcacaatacaccggcctttcacaactagctagcttgatataacagctgcagactcaccatgcatgacaacctacatacctgcagctctctatacccatgacatggcatgtaataatatgtgtgtgtgatactacgtatgtactgtttctgttgccggatcggatgatgatcgatgttcaacttactctcctagctgagtagtcccttaatccttttcatctctttgtgtaactagtgagcaaaggaaaattaaatatagggatctcatcgatctggggcttctccatgtctgtcaagagcttgtgtagatcgagctgtgtgatggtgttaatcctgggaggcacactatacatacgaagagttttaacagagatggtaaagagaaggcccggcctggcctgactaatgggccgtgcttgggcctattagcacggcacgacccaacaatcaggggggaccctaataggcgatcgatcgccctgaggatggggcagcgatcgatcccctccccctcccttcctctacctgattttcttttttggcaccgcattactttcctattttagtaaatttatacacttaaagtttatacacttcaactttacacatctaaagtttagtgaccaaaagtttataagtcaaaagtttatatatccgattcaaatttgaattttaattcaaatatttttttatatatagtatttctatacatctaaagtttatacatctaaagtttatagacctaaagtttatataccccgtttcaaatttgaatttgaattatatcttattcaaatttgaatttgaattcaaatattttctatatatagtatttctatacacctaaaagtttataagtcaaaagtttacatacccaattcaaatttgaatttgaattatatccgattcaaatttaaatttgaattcaaatattttctatatatactctttcttcccataaatgtttgacaccattgacttttttaaacatgtttgaccgttcgttttattcaaaaacttttgtgatatgtggaaactatatgtatacataaaagtatatttacaataaatcaaatgatagaaaaagaattaacaattacttaatttttttaataagacgaacggtcaaacatttttaaaaaagtcaacggcgtcaaacattttgggatggaggtagtagtatttctatacatctaaagtttatacacctataaattatagatctaaagtttataagtcaaaagtttacatacccgattcaaatttgaatttgaattcaattttttaatatatagtatttctatacataatttttctaacttttgtttttttaaaaaaaattgtggtgtaccgtagtaggaagagaagaaggagagaaggaagggggagaggagggaggagtatagggggaaggcacagcgcggggcgatcacctgcgcattagcatttcccaacaatcagggagacaaaatagatttattccagccatgtagacatggcccaaagaaatgagggactcaaaataaattattccaacaatataagacacggtctaaagagataagaaaagcaaaataaacttattccaagacgaacacgatgggccagtcgtgcttttgggccggtacggcacaacccacgccttattggactgtgcctaagccacaggtacatcctgtggcctagcctggcacgacacaaagagtatgccaagctgccagcccgacataccttaggccgtgccgacccgatatgccttaagctgtgctctagtcgtgtccgagccgtgccatgtcagcagctcatttagccatctatataactagccaagccaagccaagctagctcattattttaacgagccatactgagctaagctagctcgacatccatctctatcaatggtcaagtgcaagatctctcggtgtcagcaaggggaaaggctcatgcgcgcgggtggggccgaaaactgcgtggggagtgagtggagactgattgagagtgacggattgtaaaaaaaaaagaagagagggacccaccacggctgagaaaaaaagtactcccttcgtctaacgttttgactttttatttgcacgtttaaccattcattttatttgaaaaattagtgtaaataaaaaaaagataagtcatatgtaaagtacttttgataataaagcaattgacaaacaaaataaataataatttcaaaattttttgaataagatgaatgatcaaacattaacaaacaaaaacttaaaaagacaagtaatatgggacggaggtagtatgacgattggaaaattcggtatcttttaagttgggatagatgtaacagtgatgtcggtcaagccttcacgatggacctatggaatcgaagtagcaacgacatttctgaagtttggcgccacgcaataatatcttgcttgaaatttgtttactgtccatttctgatcaatttttccatgccagcgcgcaccactggagaagaaggggacccgctagcaagtgccaaattggagccggaaaaagagtgcccattgacccctggtaaacgatagagaagtgagctgcagccgctataaattctgaacccaatatccggtagagaagcagcaacacagcgagagagtgcaataatttcttcagacctaccgacagaaaaaaaaaagagaaagatgatgaggaagcaaagcagcagctccacctctcgtgctactgctgctgtagtgtcgctttgtaaggtccttctgatggtcatagggctcatctgcgccctgcacactgccaccgtagaaggaggtaaatcaaatactccctccatttctaaatagcttgacaccgttaattttgtattacatgtttgatcgttcgtcttattaaaaactcttgtgaaataagtatatttaacaatgaatcaaataataggaaaagaattaataattactttaatttttttataagacgaatggtcaaacatgtttaaaaaaatcaacggcgtcaaatatttaaggacagaggaagagaaagtattatacatacatatccgttaatagttaacatttgtgttagctgcatgttgttaacgaccacatatacggtactagtatatatagagtaaattaacacagctaactaatgaatggagtatatacatacatatatatatatatatatattatatgtactatttaaaatcacatggtgcaggttagatttcagatccagcctatatatgtttagtagtgatatagatccgttgcaatttgtaatgtatctaacatatatatatttttacgagggatgcaggaagagcgctagcggcagcggcagttggtggtactggtgtggacttgccaccaactgcaccaagctactccagcaagtgcagatatccctacaaatgcccccctgcaggctcaccatgacaacctgcatatgctgtgctctagcgc

SEQ ID NO: 595 - DNA, 7901 bp, Oryza sativa
  unsure (1)..(7901): unsure at all n locations
acagcttttcaacggccacccgggccaacaactttttaaacggccacccgggccaacaacttttcaaacggtcacccgggcctagctgatcccatcagctacagatttttcaaacatggaacccttttccacaacagcaatttcacaagcagtagtcaaacaaaactacgctaggaatcacctcacatccgcccatgaccgtgggcacggctgttcgaacagtttgttaccctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaattcacatgtctctcggcatcaaggctcccctgataagctagttactcagctaggggtgtcccattccacccatgtggtcgtacttgtcttatgtttagatgaaattccaaggaaacggtccttaagtgcaagagcgggaaaccgtacacccggtacgttccctggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtacacgaatatcgagacgcaactagatggttgcaagggggcatggtatcacaattaacaaaggaaggatcaaatgcaacaaattaggtagatctgccaatctgccttgcagacgggacaacagattaagtgcggtcctatcaatgcataatattttttaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcttttttttggaaaagaaaagaaaagaaaagaaaagaaaggagggagggaaaatagacttttctcgggcggctagggcgtggcccgagagagagtgcggctcggccgagcttaacgggccggccggcccaaggtggcccagagcggcccaagacgcgcgcgcgggagggaggagagagcgagccggtggaccgggctcaccacgcgcggtcccgggtgggaccatcttgtcagcggctcggctcaccgtgcggagggagcacgtggcgcggcgctagggtgggggagggacgcggtgcacgcgcgcggttcacggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccacggcgatacaagcaaaagcgagcacaccgggtggttgcacgtgacgaggggagacgagccaacggctcggattcgccggagggagcttgacggcggcgaatcgcggcggcggcaaccggcggcgggaaaaggggaaaacggcgacgaggtcacgaggggccaattcccgacggcgagagcatccacgcggctacgggaatccgttgctagcgtcggattgggcggaactacgccgagcgaggccggcgacgagcgggtgccacggagctcgggcggcgacggcggcgagcacacggcgagcgacgacaacggtcggggcggcgccggctagctacggggaggctactcgtgctaccaccgaaagctaagggggagagatggagcgaggaggaagaacggagggaggcactactgtgcggcggggcgcagtgacgagaggccgacggcgcgggagtaatctctccggcctcgggccggggaagaggaaggagagggcgcgcccggagtccccttccgcgtccttgctcgtgccggctcctccgacacgcgcaacgacgaacggcgacgacgaacagagcacggggacggcggcaatggcgcggaggcgaatgggagaggaagggaaagggaggctggggtttataggatggcaatgtcggtttgggaaccggcttagggcggtcaaagcgcgagctagcgctcggcgctcacgtccaaatcggcgacagggcggagggaggaggatgacgccggcgggaggaaaaaggagaaaaagagggagagaaaagggagctcgtcccttgcctctttgggaaaaggaggaggggagcgggggcgttgcggcagagggaggagggctctgcctccgtcccttggcggcttgcgcgcggagaggcggggccgaggcgatgacgacggcaatgacggcgggacggtttggagcggcgcgacgacacgagcgacaggcgctgacgacggcggcgaccaggcggtcggccaccacggcacgcgcgcgcgcgggaaacaacgggcgacgcggtggattgagcggcgcagctcgggcacgcgcgctggctgcggggccgagcggctgcgcggcaggtgtcacgccctgaagtttccccctctccttgctttaaaaattggctaaataaatcgtccgaagaaattatcttaattaacctagagctaattccctaattaataaatgcaattaataattgaattcggcgtggtggaatttttcttgagttccccatgctccaatgcattaacaagattttagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgctggagccgaagctccaaccgctgccgccgaaaccgccgcgccgccgtcttcttcgctcctcccgcgtccacgtcgggccttcactccgagcccgcacctcgcgcccacgtaggccgcctctccccggatattccgcgcgcgcgcgcccgcaagtggtgggggatttgaaatcccccaacaccctctctctctctcctccacctctccacgttgccggccaaataggggccatccccggccgtttccgcccctccctcgcccataaaaaccctcccctgagtcccctccctcgtttcccccatttgccgtcctctcccacgccccctaccgcgcccacgccgtcacacccgagctccgccgcttgccgccgccttcggccgcgagccgccgccgctagagtcaccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgccgtcttcatccttcgcgccggccgccgtgctcacagtgaggagctcctctcctccctccttccctctatcccgcacgcgttgccgctccctgcgctcgccatcgccttcgtccgccgccgccggtctgtgcgccgtctgccgccgcctcccgcgccgtcgcttgccgttgccggcgttcgcgcgccgccgccggtcatcgccggtgaccgcgcgtgtcaccaccggccgccatggctgccggtcggctttgaagccgagccgtgcctagccgctttccccgcgccgtccgatcgcctttgaggccgatccggaccgtcggtcccgtggaccggcggtggaccacccgcgtggtcccggtccacggtggaccggccaccttgtgccgctgacccatggggcccgcttgccggcgcctctctctcccctctcttgaaccgctgacccgtgggccccgcctgtcggcgccgccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgttttgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaacatcatgtgggatgggtcctattactcagccatttattgtttaccatatgccattgataacctgggtatcaaaatgattagatgttggtttaggaaatgcttagccatgcttagttcaactagtacacaaatggggatcacattattacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaaccgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacagctgttttactgctttcaactactgctttgaaatgcctgctttaggcaaaagaacccctagcttcctttggttatatcctgcatcgtacctcctcttccggtatgacttgctgagtacagtgggtagtactcagtcttgctctctttttcccccacaccagagctgaagatcttcctagttggagctgttttgtcaaagttggtttcgtcgctgccgtcaaggattgcctgtggagtggagtcgctcgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacagcagggcagcggggtcgggcgacgcggacggcgcggctttcgcgcacgcgcgcgcggcgcacgggcggagcggagggagggagagagagagagagagcgccaggagggagggggagatgggccgaaagaaattcggcccatcgaacccgggagaggcaagatagaattttgcggaggaatttgatttggagggatttggattcggaattgaactcgacgatagatcgggggatttgagatcttgagatggcacggacgctagacaacaagcaaggaagcaaatttcgcaattagggtttttaagagataattttcccgctaggcgccacgacggaacgggcgctacaaatagctatacatttatcaacaaactttttttctaaaaatttgatagatgaaaatatatatacaatcgtaatatgattacactataacctgcatttaactatgatacgatttgtatgtaactttcaaaaattctacggtaacatgttcttttttcgtgaatcagagttcaacaagacccaatctcatcatccacgcgcattatgattttttttctctttcccacttgcacgaatcttaagttaaattattttaacgatttaaaattatgtgaaagttacactgtagttatatataagttacaatataattatactataattataatatacatacatctgataaatttttgaaagaaaatttgtcaataataaatatataagtaatatcaaaatatagtggaagaaaaactacagcccctaggggcgaaagaaaaatatatttgcagcttaattaattaatacgtttaactgcaccttactgcttcagtgctgtcgaaacatgaattcggcaataataaaacggggtagcgcacgaaacctaaaagtggatggatgtggagacaaaggatttagacaggttcaggccctctcgatgagaggtaataccctactcctgtttggggatttgaatccgccgggtgtattatagatctgacgatctagttgtctcatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatcttccgaatacttttaccaaatatgaagactgtggagggctgaaaaataaagtcagatgcatcgaatagatgtacctaatagatgcaccaactgagtggttttgataattgtagtcaaccaagtgacttaatattaatatatagcatatgcggcgtgaatccctgaataacatgatccgagtgatataccgactgctttgtaaaatatgatgcgtgcaacctaaagctgactacatcattgaaagttcacatagcaaaacaactataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 596 - DNA, 2872 bp, Oryza sativa
ccctggctggtcctggacagggatttaatgcacattcagcttagaaattctggtttgagaatttctgggcgtgacaagttggtatcagagccgaccttgaccgtaggacaagccaactggaaacctaagagccctctgaacccctttttcatatgcatatgcccttttgcacttggattttgtttcgggaaaattttggggtttgttcttttgatttgtgggaaaaatcttggtcgcttatttaaattggatttctcgactagggacagtctagggagttagtaaaagtttattcagaatttattcggcagtcggtcgggaattgtcgggtgatatgcattaggtcgcgtctatgttcggaggggtaagtttatgcgtatcagtatgactatgcatctatttcatgcattaagtcattgtttagtcagttgcattagcgtcttttgtctcggttcgtgaaaaatgttctatgcataaaaatcatcatgctccgcgagttacttgagtcatttgttgctttatttaatttggttttgagcatgtgttggttcctatccctctgtcctctttagatgtcagtcctatccctcgtttgcaagcgccgccccgagcttcagagtcgccgcccttagctttatcgtcttcttagtctgtttgcttgctagttttcgtgtttaggtttgttgcttgagggttagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagcagcagcagcagaacctgcaatttggtcctccgcctcctcagtccaaattgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagctgcaaggtcccgcttctgtttggtgggacaactacatggtgacccgtccaactggggcagaggttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgacgggaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaacagtgagcagcacagcctcaaccctactctgagttcactaaagattccagctcaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaactcattccttcatttccaagcgttttgctggtgcacatgggttatctttagtgaagcttaagataccaatgcgagttcatactcctggaggtggcatgaccccaactcactactgcccatctgtgacagttgaaatacaagggttgatttttccagccaacctcattcttctagaatccaaggacatagatgtcatacttggaatggattggttgacaaggcacagagaagtgattgattgcgccagccgcaccatcaagttaaccaatgcaaaagaagaggtggtactttccagtctccagtaccgcggaagccagggattagtttaacccaggctgctggtgaagaacaagaggtagcagtggagaaaaccactaagaagctggaggatattcccatagtcagagagtatccaaaggtttttccgagatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaacccaagagaatgtgcgttgactaccgcgcactcaatgaggtcaccatcaagaacaagtatcctttgccaaggattgatgacctatttgatcagttg

SEQ ID NO: 597 - DNA, 991 bp, Oryza sativa
atagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagattgtcgtggtttttatcgatgacatacttatctactccaagtccgaggaagaacatgagcagcatctccggctggtacttgaaaagttaaaagagcaccagctatatgccaagttcagcaagtgcgacttctggcttaaggaagttcagtttctcggtcacatagtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcagtaaccgttgtgaggtatatacagatcacaaaagtctaaagtacatctttactcaacctgatttgaatctcagacagcgaagatggttggagctgatcaaggattatgatatgggaatacattatcatcccggcaaggctaatgtggttgcagatgccttgagcaggaagagctactgcaatgttgcatggg

SEQ ID NO: 598 - DNA, 642 bp, Oryza sativa
caccagcactactagcatccacaaagacacaactttcagggttaggctgccttttggtgagtgatcaaatcaaataatcaatacgaggagtattaagataacacaaatatctatcactgagcagagtgcaccaatgacaatattggtgttttggtgtcatgcagggagcgtgcgactgaagaaggtggctgtctttccacagtgcgacagagtagtactgaggctggggaagaaacatctgcacggggcattctcaacctacaaaaattgtaagaagcacgcccaactcgtaggcacaatatacttgcgctcaatctggggttgttttgctctttttatgtcactatataaacaaaaaattaagaggttataatttgttttacatattcacaacgtagtaaaattattgcttccgacacagtaaatctaaaagtagttttttggggcgcaacacctgaaaatagttacaattatcgagattatcacagtctaacgaaatgccaatggttatcatacacaagaacattcttctgctctacttgcatgagtacacttgtttgtctcgatcgatcgtgccacaagacagtacccaccggaagtccggtactgcatcatgtcacctgaagtgtctgccttttgctt

SEQ ID NO: 599 - DNA, 753 bp, Oryza sativa
cgaatataccatgctatttcactaaatatagtgggaatagtgtcacgccccgaactagtctcgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcgaaagccaggactaggaccaaacatcacaggcgcgacttgggaactaggccgaaaccctaaaactcatcgtagccggcttgctcctggaagaactcctcatcagccggatccgcttcatcttcttcagcaactgggggggaaattatttatatagagcaagggtgagtacgagagtactcagcaagccaggggaaataagtgtttaatgcaggcttcaaggagaggctggtgtttttgcaatttattttatttgaactcttttctgaaacaactaagtgagtgcttctcaaacgacacggatgagacagtgcgtctcgtccggtcagagtatgtgcaatgtatcagtctttagattttgaaacaaggttggcacccggctaacagcttttcaacggccacccgggccaacaacttttcaaacggccacccgggccaacaacttttcaaacgggcacccgggcctagctgatcccatcagctacagatttttcaaacatggaaccc

SEQ ID NO: 600 - DNA, 336 bp, Oryza sativa
cgctgagggccatctctaaagagatgtacggcaacgccaatcagtacaacaagattttcgaagccaacaagccgatgctgtcgagcccggacaagatttatcctgggcaggtgttgcgtatcccgcaataacgcgtcggtctgccatagcccggttgcgtaccgggcttttttttgtcctctgcaataggcgtctcttatttccctgcgatcttgatgccggttacatttcccctgtgtacccgctcgcttccggcaggcgcggtgttgaccctaatggggaaaattgatagcgtcatcccccggttgagccggaacgaccaaggcggcaacgttg

SEQ ID NO: 601 - DNA, 664 bp, Oryza sativa
  unsure (1)..(664): unsure at all n locations
atattgagagatgagtttagagtccacatagcaactcaattagaaatattaaaaattcagaattaaaataaattaatattagaagagagcngtaaagtctatatagaaatacaatttccagaaaattcggaattaaaaaaagaaatattaaaagccgagtctagagtccatataggaatatatataatttacaaatacctaaaatttgatattaaaaataattcttaaccaacacgtatataaaatacaatataaatattactcatttgtagtttcgtaaagttattgcaaaatttaaaattatgatatcattttaatatatttgaataatataatgagaaaacatatatgctattatatgagagaaaatataatgatgctagccgcgcaatctgcgcgggtcaccatgctagttttttaataaaaatctaaaatgtaaaaagtctacgatgaagagtcgcacgagaggagcatatcgatcagctgatgacaagtacatatagatcatacatgatacatcacacatataggagtatagtacgtccacagtccactgcatattactgtacgtaggtggctgtgcctgttcggcgctgtaccagcagatagaatttcatcaatattagctggccatgtttattcgtgtaaccatattatttcatgg

SEQ ID NO: 602 - DNA, 5020 bp, Oryza sativa
  unsure (1)..(5020): unsure at all n locations
nnnnnnnnnnnnnnnnnnnnnnnnnnnnnnnnnnnnnnnnnnnnnnnnnnnnnnnnnnnnnnnnnnnnnnaatagcatcagatgttgctatatcttgattggcaggagatatagcaagtatgatgcagtttggctacaaaagaaaatacaaaaatgtcactgcataaggtacacacaaatgcacacttcatagtctcctgcaatgttgttaagatatggtcatcttggagctttagtttgcagtataacttaatgcaacatacaaaataaagcactagtgaatataggaattaatttcaacaaaggaaaggcacaatataatcagcaccacatatgtacttccgttggatgtagaggctgggtttaatccattttctaaaaaaatagccccatattggagtacttttgtctaaccctggaaaaaatattatagccaactagcccacttggaaaagaatggctgtaagaaatatgctataaacgggcagatccaaggaacttgcttacattttttaaaatactttgtagaaggcatccaagcaaacaatattaaatgctaatgagaccgtgagacatgcaaagggtacttaaatctatcagtcagcattaactgctaatgagactgtgaaatataggtgtgggagaccaatcaagctagaattgtataagtgaatattgatacgaggaaatattgcacccttattttaacaccccagagatgtaataagtcaagtggcactgaatttatttttaaggcgcatcgaataattcataaaatgaaaaaaatacccagtggtagtactttaataagaatgtgtaggcctatattctatactgaagtaatataccttgtcaacatatgagcgcaccatattttcaatatcctggacaatgctttcaggctgtccttctgaaaggcaatgtagtaagtgaaaattctctggttaacattgcttaagtccaagtaagttcaagcatgaaaatcggtacacatttccatacctactgcaactttagttagacccggcagatcaatcaatgtcaagttgaccactgcaatagttcattgaatagagttatgttaagttaagaattctggagttacatgaagctgcgatgtactgcatataagtaaagtctatgcctgtgtgagaaaaaaaggaaattaaaggttgcacaagtattgttgccaaacagaaaacacagtcttatttatataagatgaaaccggaaaaataaaatttgacaagtaaaagcagctgtgatccttcattaaaaaaaaaaaagaagcagcataagtcaagcaaagggtgtgagtaccatgtggtgagtaaatgctgagatgaattggaacaggtgatatttgtttagtcttccctgtcagcctatcagtttcatcttgaatttccttccgcacaagagctgcagaaaacaaatatcaccattcaccagcatgtttgtaagaactatctgttcaacttcagtcatttccaaggtaacaagacgctgaaaccacacagaattcattacaagcaaatgtatcctctatatattttgcaaccatttgcattagttaaataaagtaattttaatatgtctacagccctagtaatgacaacagattgcttctccagttctgcttctctcgtgacaatttattgatcgtttaagtgaaagtaaatttattgatcgtgacaattttatggagcattacctaggcagtgttatacctgtatagctgaaaaattactgccgaattttgacattaaacaagaggatacatatgtagtagcagtgtagaaaccgaacaatacagcatctgctgctagcaactgctaattgcagggttaattacactaaacatggccaattgtgcatttcattaaagcaatttgcctacggccactaagtaaaccagttcaaagcataaacccataaaaccccccaaacaactgcaagacactgaaaatgtctgagcgcgcgcgcccatgcgtatagagagagtgagtgagagcactcaccaaaatcgttgaaccggcgcttgggcatatgcaagaactcagcgtactcctgcaccccgtcctccgtcttgtgcagctgcaaaaccagcggccttctcgtcacgatacctgtaatcgaagacacaaacctcgtggccgtaaaaatcacagcacgggtactcgaaaattcggacacaggcgcagaattcccgatcaaacctgagcccctaggcaggaagtcgcggcccacgatgctctccagcaccgatgacttgccggaactctgcacgcatgcaaccggcgcaaataaaatcgagcgttcacctccgaaattgagcaacgacgcgaaaccctaggtgggggagcagaggcggtatagggcgggggggcgcacctggccaccgacgacggcgacggaagggagcgcctcccacagcgtggggagggaggcggtgccgtcgccgccgccgtggtccccgaggacggtgcaggctcgctggatgcggttcacgagcacgatcacgttctccatcgtcgccatctccggcgaggcggagggaggcggcacctccttgcccggacgaggagcgggagtggaaggttctagaaggaggcggaaggttcgagagggagaaagcactgtgtctctgtgggcgaagcgaagggagcagagaggcgtcactgtcgcgacggcatcggatagggacgaaagcgtgcaactgctcccattttacggttttgccccttgcggcaaattccaatttccaagtggcccggcgggaacaagttccccgaaattcgaaattcaaatattcgttttacttttcggatgaattgaaatttcaaaaggattttcagtatacctttttactcttgaatttcgtaagagatccaaagcaaatgcaagcaaattatttcagcaacttgcagcagacaaggtttggagtaaggggcagtttgggaatcagagggtggataagggaggtgggccagaatggacaggacagaatggttggttcaaatgtctttcaaaattcctcgcccggatttcaaattctctggaatggtgggccccggatgatgcgcgcacgcgcatattccttcgttgtatgccgttgggctatggcccatgaaaaatggaccggaaacattgaggcccacttaggaaatgaaattgggattaatttaggccattgtaggttggaataagatcactttgactccctcaactgagcaccgaatctaaatcgtatccctcaaccacaataccaaaaatcttgacccccgaacttacaaaaccggtgcaatttgactcccttggtggttttggaggacagtttcgctgacgtggcgcacacgtggcagtgttgacttggtatttgtcccacgtggtattgacgtggtgcttgtgtcattaaaataaaaatatatatgtgggacccatttgtcattcacacaaaaaaatgtgggatccacatgccatcttctctctcactacccttcttcctcctctcccttatttctctctctctctctctccccttcatatgagccggcggcaagcgggggctaggtggcggcagcagcggcgatggcgcccgggtgggtgccggagcggtggcgccggtgggcggtggacctcgggcgacgggcgcgggagcagctccgctgcaaccacatcaggccgccgccgccgcccagcagctcgttcgtcgggtgaaggagtccgaccagtgccgtctccagcaccggcacggcgaagttgatgtcggggaagatccgtcggtcggtgatgaacaggatgagctggtagttgtttccctgaaagtccaccgcctctctgctggccaagaactgctccggccagaactcctccgacgagttccatgccgcggggtatctccccattgcccacacgttgatgaacaacgacgtcttggccaggatctcttagccttgtacgaccgccgtcgccgtcgactggcgcgggacaaggatcggggcgggacgggcttcccgtcggccgctcgactgatctcgtcctgcagcttcgccatcacccgcgtgttcgccgtgagctccgccatgatccattccagcgtctctgtccatcgcccgccgccgccgccgccgatctggacgccgctccccacgcacgaagaaagagagggagagacagcgaagggaggagagggaggaggaagaggatgacacatgggacccacatgtcagtgggtcccataatttttttttgtgtgaatgacaaatgggtctcgcatatattttttttattttaatgccacataaacgccacgtcaatgccacgtgggacaaagactatgtcaacactgccacgtgtgcgacacgtcagcgaatccgccctccaaaaccactaagggagtcaaattgcaccggttttgtaagttcggggagtcaagatttctggtattgcggttgagggatactatttagattcggtgatcagttgagggagtcaaagtgatcttattccttgtaggttcactgaggcccaggatacttgcagcctcggccgacaatatgggtctgtctaatgggcgtcgaagtgttgtacaggcccaagcaccaaattagtctgattacttgcattctaaccattttactgttgatctcatcaccatcatcgtggaaaacattaggatatccggcgcgttgctgcggcgaatggtaaaaacattaaaggttaaaggcatcctcaatgtctaagatgcatagaggttataaggtgagactcaccattatatggtctttggctaatagcatatgctacaatgtttatagtttttttatcgactttacggttggacccactcgaaaaaattttgtttcacccttttacatgcaggattcaaagacccacatcatgctacaaaggtataaccatagcaacattctcttcttttatcttctcccaatgcataaagcaataacaaacatattactttattccttaatatcatatttgcatgcacattgtggat

SEQ ID NO: 603 - DNA, 14242 bp, Oryza sativa
cttctcccaatgcataaagcaataacaaacatattactttattccttaatatcatatttgcatgcacattgcggatgccctaacatggagtatgaaattatattccttttaggggcatagaagtttacataagatgcattcttgtagtacgtaagaagaaacttacaactcttcatacatgcatatattccaccatgcatcacatcaagccaggcatatacttcctccgtttcacaatgtaagaatttctagcattacctacatttatatagatgttatgtgaaacggagggagtagctaataaggcattccttaccaccatatctgaatcactaccgccgttgccgttgtataggctgtatgttcatctgtttgtttggttttccctttcacttgtttaattcattcttagcacaaagaaccaacaaaaaaaaataagaagctctcttatcattgtcctgttggatatatcatctcagaatttgacgcagatgagatcacagctagtctatttgcatatagcccaagaagcagacagaacaatctttttcctgctcctcgaattagctgtgctccagaatccgattcttttttttgtttgtttttggtatgcagattccgattcggactatgctatgttacgttccgttaataaatatatgtgcactatgcaatctcgagttaagcatcatttgtttgtgtgtttgctgcatgtaggacgacaccatgaacatgaagaagaggaagaggacggtaggaccagctgcagcagcagctacttttcctgagctgccggaggagattgtgatggagattctggctcgtctgcccgtcaaatccctgctacgcttcaagtccgtctgcagagggtggcgtgcaatcatctccgagccctccttcatcccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtaggggtaggttctggttctggatcaacaacacagccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaatgaacggaattctgtgataaggggatatattgcattagggccatgccaaccacgcagccacagttttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaaactattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagatccctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcagcattgaaactcttcctcactgagatgcgtatagatgaaaggtttagaaaagtaaaaaatcttgctaatctttccattatgattgttgaaacaaaattgcacaatagacatgagattgtttacaagcttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgttagacgggaatacccaactttcaaatcctggctccgccactgcttcatccgaacccaactccagtgctcggcttccagacggcagcaggagccatccatcctcatcagcccccacttccgccatgaccggccgaccaaattctccacccacatcagcttctaccagtgggagcaaggtgcctcctcccttgcgaggatcatggatgccaaggacttccctgtcggccacaagttccgcttaatcagccactacacccactgtgatggcctagtgctcgccccgactatcaccaagctctacctcttcaacccggcaacaagagaagccatcacgttgcctgacggccatggccacagccacaccgcagggctggggctggatcctggtaccggcaggtacaaggtggttcggtccttctaccgctccccctccatggatcctcccgtctccatggggatggaggtgctcaccgtcggcgagcccggcgcgcggtggagggagaccgccgttgatcctccacaccccatcacccgatggcggaccgcccttgccgtcaatggtggctacctgttctggtacatggacaggcgccgctaccccgacgatgctccccggggactcctccggttcagcctgcgagacgaggcgttcgccgtaacccgtctcccggaatcgatggacccgacgctcgacgagaacgtcttgcccgacgtgctgcacggggagctgtgcgtcgtgcaagctctgcccgacaaggctggggtgcttatctggacaatgtcgtcgtcgtccatggacaacgacgatgtccacctcgacgacgggccatgggaactgcgatattgcatctgtgtcaacgccctttgccatccgttgggggttcttcctgatggaggaggaatcttgttgtgggcgaatcgcagcgtccatcgctacgacttctcggctaggaagctcgctggtgtggtgtgtaacctggatcgcatcaggtatcagggtggtaggccagcgagatggaagagtgtcgtcgacttcaccttgatgccctacaccgagtctctcgttagaattaccgctgcttagcttcttcggtcttgctactttttatcccatgagaatcagtttgtatgcactgcttgtatttccccccctctgtttatcactacaagtactcctgcaaatgacaaggctatttatttgaatgctctattattaatttattttactcccttcgtttcataatgcggggcaattttttactttgcattgttttagtttgatcactcctattttgtcaacttaacagaaccagataaatgtgaatggagtgctgcggaaagatcatcctgggactgcctatttatatgcaggggcaagttgttgtcgttcaccagatgtgatatcataagattacctacagtataacacctttttcggcttagcgattcacatttctttcttacttcctacttattttaattttaatgtatgacgccgttgactttttatcaacgtttgaccattcgtctaatttaattttttttgtgcaaatataaaaatatttatgtcatgcttaaagaacatttgatgataaatcaagtcacaataaaataaataataattacattttttttataagatgaatggtcaaacgttagtaaaaaaaatcaacatcgccatacattaaaatatggagggaatagtaccgtgtagtatggacaattcagtagagaacaaccactagagaacaatatcaattattgaatcaaaactaaggcccaactgaccgtacatacagaacgattaagtcattagaaaactttgtttcaggcaagacaatgcttcctcatgttaaaattgagtgggaagtaaaactgaaactatatgcagtattttcatttcttttgttgcatggtgactgatcactgagacttctataataagtacagaacactatattctgctgacaaaagagtaagaatgtctatactaattctacacataaagaaggagaacatgcagacaaagaaaggaagaactgcggcagtaagtatatctgtatatgaagcatctctctacaaaataaaagtgcacaataagcatttcaaggagggtattgccttacagggaaccttgatgcaccgatcttgtcacacttgcatgagtgttcggtacaatattgccagaacttgcctctacacgatgcattagcagtcaggtactcttttggagtttggaccagtttttcccctttcaggtcatctgttcatcaagtcctgtaaatccaaaatgctttaggagatggctcatcttaaaacaagccaaataggcatatgctcgctgcaatgcatcatcattcatcagcaaaacagacgaacaggttgagaagtgtcatattctggtgatggaattgcacaaaaagccttcaagtgagaacatgacaaatataacaaatataagaagattgatcgtctcaggcgtgctttcctttggaagggagacgaccttgaaaatgtgagttcaggcagcagtctttgtcaattggcagaacgtttacaaactcaaatctttaggttggcttggtattcttaacttggaaaagttctcatgtgcattgtgtctgcgctggttatggttcggttggaaggatgaaaacaggccttggcaagagatggaacttccttgtaatgaattggaccgagtgttgtttagagctggatcagtgattactctgggggatggaagaaaatgctctttttggtctgataactggcttctcgaaaataatcattagtttgctattctaaaccccatcacctctttagaggagatcgatgctttggtgcgacttggaagttatttacgggcttgttcagattatagccaaaataaaccttaccaaattttggccaaaattttggcatgatttcttatgtatttaacaaatttgcaacaaactaaacgtagacattttttaggcaactttgtcaaaaaaaaaaaaatggtatggttgaaaatggcatcaatgacaaccctacaagaaattacactcatagagctttcaaaacaggctaatggctaattcttcgctaagtcttcccagtcgtctttcttttattctgtaattgacgatctgaacggcttactccctctagacgttgtttttacttttgctcgctgattgtaacggttggtgacctttattccttctaatatatccggcagagctcctgccatttaatgtttttttaaaaaacaaatataacaaaatgcgaaaaaatgtggtgagctggtgcaactgcaacaggaactaaagcaagcacacattataaaatgagatggcaaatataaataagcgcgtaagcacatcttcataaattaattacttggggggtacagatgctgtttcatcgcaaggaacaacgatacaagtgatgccaaagcaaaggatgcaaggttcagattgccaccgaacgaccaccggatgatccgcgagcttaggcaagatgatcgcctattccctggatgcagtgggagaggcagttgacgaagctgtatggctgctgcaacatctgaagaaagatgcagtcgaggtggcatggctcgctgcttccatctgcaacactgtaaccgtcctgctgcgacatctcacggaagatggagtcgaggtggcatggctcgctactcccatctgcaacattgtaaccgtcgatttcgttcatctgagtcttttcacgacaatcgaatcccaggtagagagtgtcagctgcgagcctctgcaggtagtagagtgacggagcggcacaggcccaagaacacagctcgcccgcccaaccccttgaccgggatcaagtccccggcgtcgaaatccaccctgtaaacatcatacttcatctcgtatttcgcagcaccttgccgcgattcatcatcaacattgctctggcggatcttacggtacaccagcatcaaactccccaccattgtccacaaggtgaatagttcctgacatccgggagaaatgcaagggcttgctcggctgagcggtggtgaccagccgcggccgccctctatgatctgatctgaagaaggagagctgtccagcaccatgacactgccgccgatggcgcagtagaagcgccctgcgaagggcaaagccgagtcaatgtaggggcggttcttgtcggcgacgacgacggcccagcactcatcgccgggtttagcgacggcgatcaacttggggcggcagaggaagagagccactgtggttgcggatgcaagaccgacgccacgcgccaatagcggatcgtcttctaaccccccatccgaatgccaagatcgcagttgctccggcgtgagcagcgcggtgaccggcgggaggtcggtgaggtggcgggtgagggggttgagcaggcggaggaggagggtgcgctggtggagcagcagcaggaggccctccggggcgagcgcgaccagggtgtggctctcgagctccgggagatccgtacggatgcactcgccggtggagaggtagaggaagcggcggcagcgggggggcgccgccttgtcgagcatgatccaccgccgggggaggaagcggcagtccagggcgcgggagaggggatccaccgagcgcagccgccacagccggcacacggcgcggaagcggatgtagtcggcgtcgtcgttggcgagcacgcgctcggcgatgaggccggccggcccctccccgccaaggttcgaccagtccatcctccacctcctccttccccgcacgctccgccgccgccacttgagcagggggtcacggagatgccgccaccgatggcgatggggaactcggctcgccgccgccgccgccgccggtgggagttggagacttggagtcggagtcggccggtggccttctgatgggccaagttgccaaccctacccatttcggcccatcgagacctatgtccgggtaggcccacgaagccgtgatccgcccatcgaagctcgccgccaccgccactagctgtgcgttgcttacttggaataagttcactttaggtcccccacggcctaaggccgaagcccaagagagtttgattaattttttcctgacattttatctgttgtcgatatcaaataatcatcaccatcattatgtgaattcatttgcatgattgaaatgagaacgaaactccatttatcatttggtaccggaaaccggaaatctgaaaatataaggagtacacctcttttcatgtgtatatatacttataaaatacacacataaataaaaaaagtgaaaaacttataacatccaatcatccataattttctcaaaagcatgttggtgtacaaagtaggtgaggttaggaccgaagaatggaaaaaaaaaaacagcccatgcaacctatattacagaactaaacctcaacaactggcgactggcgtacattgagtacacaatgcaacccaagacctgtagtgcaatatagtagtatactacacctctgtatatcatgtgaagtgtacataatttttttttataatagaatgaaacatttcggattttgctaagagctacagctaattattaaaaggttcatatagaagcaaactcacacagtgaagtgtatagctgcagctaaacatgtacgtatacgtgtgcctgacgacgacggctcagagtttagcgtgtttgacgttttggtcggacagaatgccctcgatggcattcttccagaccttgcagtgcatctgactgtccaacagcagctgtaccacaccagcggccgttctgagcaccagcgggaacaacaccatgccgtccaccaccacatcgccgccgttgctggagacgtcaagcacctcatctgaacagggcgcaggcagagccagcggccgacaaaaaatgaagccagtgatcaatacaaccaggttgagccaaatcacaacagttagcatatatgcagcgatgcaaacaaatgtgatatgaccagaccattgtgtggctaagcatgcaagatcatcaaaggggccaggagacaagcgtaacgaagcaaaaaggcagacacttcaggtgacatgatgcagtaccggactgcaagatcatcaaaggggccaggagacaagcgtaacgaagcaaaaaggcagacacttcaggtgacatgatgcagtaccggacttccggtggtactgtctgtggcacgatcgatcgagacaaacagtgtactcatgcaagtagagcagaagaatgttactgtgtatgataacttttttcatttcgttagactgtgataatctcgataattgtaactattttcaggtgttgcgccccaaaaaactacttttagatttactgtgtcggaagcaataattttactacgttgtgaatatgtaaaacaaattataacctcttaattttttgtttatatagtgacataaaaagagcaaaacaaccacagattgagcgcaagtatattgtgcctacgagttgggcgtgcttcttacaatttttgtaggttgagaatgccccgtgcagatgtttcttccccagcctcagtactactctgtcgcactgtggaaagacagccaccttcctcagtcgcacgctccctgcatgacaccaaaacaccaatattgtcattggtgcactctgctcagtgatagatatttgtgttatcttaatactcctcgtattgattatttgatttgatcactcaccacaaggcagcctaaccctgagagttgtgtctttgtggatgctagtagtgctggtgccaactgagttgttgttgctaccgattcccctgacgtctgccctcagtttcagtgctgcagctcctctcagacctgatgagagtgcaaaaccagaacagaaagaaccattaacaccggttcaagtgatttttccttctttacctataatttgcaggattacatgtagcagcagtggccgtgagggtgagcagttcagcagaggagcagctctcgactccagttttcacggcggaagtcacgccggacctgttggtcccagcgagctctgcagcctctgcgcagacggtggccaccagcgcagcagcggaagcaagcactgtgcccatcttcttgctgtcagcagcctcgacatacttcaggttgtccggcctcagttcgcacaccgacacgaatgcctgcgattgctgcggcgagctgagcaaccgagacagccgcgcgggcctgtgctgcgtgcagcctgagctcttctttcctcttctttcgctggcgtccagtgaccgaaacagcactcaagaaatgacctcgaagaattgctttcatgtagccagcgttgagttgctaatatccaaggaaaacaaagcattcattagcaaatctgacaagataccaactacttcctccgtttcacaatgcaagactttctagcattgcccacatttatttagatgttaataaatctagacatatgtatgtgtttagattctttaacatctatatgtatgtgggcaatgctagaaagtcttacattgtgaaacagagggagtatactatactgcagttactgtgtaatttgtactatcctgtggatgtgccatgttattgttgttatactgcttgtgtcgtgtccttacccaagttggttgcttttagcttatgcttgcgcttatggggctaggcatctcactagctagaacacgctgttagacaagcaagaattgaacatatataggaaggcaactcctgtgttggccgagagttaagagttaagagagtctgagaccattcactggcatacccatgtctggttgaagaattggcttttgcctccactgaaattgaccgtggacagatgtctctcttcatctttttcttcatttccctcttcgtctttgattgccttctccggctgacggtgttcagatgatgttctaagggtctgtgtgcataaaaacaaaacataaaatatctccatgcttaatgattaagcttacgaaagcacttttgtgcatgtgagctctaaaatactccctccatttttttttaaaaaaatgacgttggctaattcaatctcgattttcaaactaaccacggatacatagaaagatatggagataataatagagtaactctacaatttagtaaatgctgacaccgcgttggtaaacggaactgaaactgagtgagaatacttggaagaaatctgatgatgaggggctccatgttcgagagaggaactccattgcctgctcaggaatgatcggcatatctgcaggatggcagcattttgagcaccgtgattcctctttacactggatcactgccttccgcacatcaatctgtgggcgctctgcctgtttgaaaattaagtaatttatcacggtcacagcacaaaattaagtattcaacacagaaggggcgtaaaaccatgttaaaagagagatgcaacgtcatgatgcagaaatttataggcacctggccctgataacgacaaaatcaaacctttctcagaatttgtcagaatctctaaccatgctaaacacaataagtaatacaaaaacttcagttgaatatggttatagtagccttagccaaaactatgcctcgtttcctgcttctgttctataaatcaaagaggagtatgaatatgcagaagcatcaccatttgacatgacagtgaatggcatctttggatggaaggcatcccgagcaccactcctcttgtgaaatgctccataaccaccaacttaatcaggttacgttgagagatatataacagaaccagataaatgaatggagtgctgcggaaagatcatcctgggactgcctatttatatgcaaagtcaagttgttgtcgtccaccagatgtggtatcataagactacctatagtataatacctttttctgtttagcgattcgcatttcttactatggacaattcagtagaaaacaaccactagagaacaatatcaattattgaatcaaaactaaggcccaactgactgtacatacagagtgattaagtaattagaaaactttgtttcaggcaagacaatgcttcctcatgttaaaatcgagtgggaagtaaaactgaaactatatgcagtatttctatttcttttgttgcatggtgactgatcactgagacttctataataagtacagaacactatattctgctgacaaaagagtaagaatgtctatactaattctacacataaagaagaaggagaagatgcagacaaagaaaggaagtactgcagcagtaagtatatctgtatatgaagcctctctctctacaaaaataaaagtgcacaataagcatttcaaggaggatcttgcttgacaggtaaccttgatgcactgatcttgtcacacttgcatgagtgttcggtacaatattgccagaacttgcctccacacgatgcattagcagtcaggtaactctttttggagtttggaccagtttttcccctttcaggtcatgtgttcatcaagtcctgtaaatccaaaatgctttaggagatgactcatcttaaaacaagccaaataggtatatgttgttgcattcaaggtcaaggaggtggcttttatgattgccacacctcaaccggaatatatgctgcaatttgcatgtacggaaaaagaaaaaggtgtatgtgatcatatgatagatggcaattcgtccactagcatgaacaaataaaatttacatggctggagaattatcctgataccagaagaaaagattggaactgattaatgacatgtttgaatggttaggcaaaacaagataagagcaaaccacagggaagggataaattgaaagcttaactagcactactttccagcatgctacatgcatggatcaccaacaccaagtgggcaaatgtagggtcaagctt

SEQ ID NO: 604 - DNA, 1424 bp, Oryza sativa
tgattgctggcacaagccaccgcgtcatggttgcttgttgccccagccacgctgagctgaggaaacaataactatgccaaggtaccaagccgctcgctgcaatgtatcatcattcatcagcaaaacagacgaacaggttgaggagtgtcatattctggtgatggaagcggaagcagccgacggcttggggcgccgccttgtcaagcatcatccaccgccgggggaggaagcggccgtccatggcgccgctctgcgagcagcggggatccaccgagcacagccgccacggtcggcacacggcgcggaagcggatgtagtcggcgacgtcgttggcgaggacgcgctcggcgatcaacccggcggcccctccccaccaaggttcgaccagtccatcctcctcctcctgcttccccgcacgctccgccgccaccaccgatggggaactcggctcgccgccgtcgccgccggtgggagtgggagttagagtcggccggtggccttctgatgggccaagttgccacccctacctatctcggcccatctaggcctctgtccacgaagcctctgatgggcccatctagccttctgatgggcccatgaagcgtttttttttttcctcctcggctcctcgcgccgccgcctaatggattccccaactccgatgcttctagaaccttccgagcctcgcgcgcgccgccgccgccgcggccatggtgctggcctccgacgagttcggctggtcgatctcgttcaccatcctcgaggaggaggaggaagaaggagtagaagacgcgtcacgcgactgtgggggctcgactcgacgcgcagaaggcgggccaatgtcgccgccggcgaggccgtggcggcgcgcatcctccgcgcctacctcgacaccaagggagatggtccagttcccctgacggcgaagccaccattagtaaccacctgctaacctcctctcctgtcttccctgtttggcttgcttcctgtttgttgggtgagttgcttgcttccatgggatctggagttctggacattgcaagccggtttgcttttgaagcttagtgcctttcccttagatcaacatgcttgtttgattgttgattccactggagtgttctgtgcgaggtgttaagtgtagcccgtcgtttctgcagttgggttaattgccgccctagtgagggaatgtgcaccctaaagattaagatctgtttgatggatcagttcttgtcatacatgtgtctttgtggggatctgggtttgtggttttagcagttgatcgtggggttatgcatataggttacttatctgaattggtgtttcttcgtacagttgttgacccatttactgattgaacacctttacctatgaattgcagcaaatgctggagcaatgatgctggtcagctgtaggcctggagcaaa

SEQ ID NO: 605 - DNA, 681 bp, Oryza sativa
  unsure (1)..(681): unsure at all n locations
nnnnnnnnnnnnnnnnnnnnnnnnnnnnnntacggattaaggcccttccgcgaaaaggggaaataattttatgaacctttcttattttcgttaggttcaagtctgacgagaataatattctacgactaagaactcatttattttcaccatttactaaatattattttatttactagtcctttatattggaatgagtcactagtcaaatgttttggcaattcctcgtgggcggatgatgcaatagaattttgaatcagcgttttgatctttggttatccttcatagtaataatatctcggagtttgcaacgaaaacttagtatatcgactagacgaccgtgaaataaaatatgtctatctatggttaactaattgcctggctccgggaatggtcgaagccatacccaatcgaaaaaggatgttatccaaacgcatttcaagtagttgtagtcaaacccgacctgttgacccttttgcttttccagcaatatgtacatatctaagtaattgtcgttctgtcagaccatcatgaaaacgaaatttccgtttttcttctagacgaatacgatattgcgatcttttcccagaacgcaattggtttttaaagatactaggatnnnnnnnnnnnnnnnnnnnnnnnnnnnnnnnnnnnnnnnnnnnnnnnnnnnnnnnnnnnnnnnnn

SEQ ID NO: 606 - DNA, 585 bp, Oryza sativa
tcttgctcgatcaggaccctagctttattgcgagccaaaacagctgcgctattctgttctacaggtagtatgaaatttccccttcctccaccactttactagtctcggcaggttgttcttcctctaggtctctccattcccaaggaagcttgcttcttcgtgggctataagacattaacaactggctctcgagtattcctatcatcaagtttttctatttccattataaagttcgcgggtataagtcaaaaggttagctcgcttatttggctaaaccatccaaacaagaaaaagaaatacggcaccgacatttccaatggtagtcaagttcactggaataggttctttgagctatgatccaccactgtcgaatcagcagtaacgaagtaagtgaattattcatcgagaacttcctatggcattcagccttttccttcagcttagcgccctcactgctacttctctctattaagctgctctctgggtccgtccataagcatgcatactggcgctctcttattggctaggcccctatctaattagcgggttattataacaatataaaaataagataatgtttggagt

SEQ ID NO: 607 - DNA, 824 bp, Oryza sativa
  unsure (1)..(824): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcatcacaaagaactggatttttattatttcatatcttcaaggcaaatcgacccaatccagtggctgatgaagttaagttttgaaccttttttttctaatatccgttgaaaatttgtgtgtttctgcttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgacttttgactatcgcccaaccgttacagaggctttttcctcggttcaatacataatgaccgaggccaactttggttggttaatccgatcagttcatcgatggtcagcaagtatgatggttctaatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 608 - DNA, 1039 bp, Oryza sativa
  unsure (1)..(1039): unsure at all n locations
tagctccatggcaccgaaaatgtctcagggctcaagtgattcaccgaagcgacgagaccttgaaagctgctttttcaagtgtcagtagcgggacgttctgtcaatcggggaaggtttttggtgacaagacnnnnnnnnnnnnnnnnnnnnnnnnnnnnnnnnnnnnnnnnnnnnnnnnnnnnnnnnnnnnnnnnnntgccagtggaaggctttctgcgttcagtcaatctacgcagagtgaatcggtccctaaggaacccccgaaagggctgccgtccgatgggtacacgaaagtgacgaagttgctttgactactgaaccatgcctggatcgtccgagcgaattggatgatcgggccgagggctgccccctcttcccctcgctctcctttccttaatattcaccgtcgagtcatcaaagccgtcaactaattcagaggggctcggctggcccggtcgccctacgctactggcgcttccaaaggcgaagctctcgtctttggcgaccagcaaactctgggctaaaacctgtagttttgaagcaagggatgagcgcgaaagccgttgcgcttccgtacacgcgcatacgttttcttgctccgtcgcgcgttagtacaataacgcgcagccgttttcttgctggggcggacacggatttctctctaaaggcgaagactcagaagtgggcgaacactcggcccagcgggcgaacatgccggctccggctccgcgcacctgctgacacctttcgaagcactttcacgtgtgaaccgaagtcgtcttgccgaactccttcctttctcatttcagtcctcgcctttttcatcttccgtaggggcctttagtcttttgattagagtagaggtcgcgagagagcagagcgtaccgccctgccatagtcgcgaggatcttaatagtcggtcgcgactgttgtcatagtcaacgacggttgaaacttccaggaaaaaacttnnnnnnnnnnnnnnnnnnnnnnnnnnnnnnnnnnnnnnnnnnnnnnnnnnnnnnnnnnnnnnnnnnnn

SEQ ID NO: 609 - DNA, 709 bp, Oryza sativa
  unsure (1)..(709): unsure at all n locations
accagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggttcttttctttatggtacagaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaannnnnnnnnnnnnnnnnnnnnnnnnnnnnnnnnnnnnnnnnnnnnnnnnnnnnnnnnnnnnnnnnnnnnn

SEQ ID NO: 610 - DNA, 974 bp, Oryza sativa
  unsure (1)..(974): unsure at all n locations
agctcggtacccattttgatattttctatttgttagtagtgaacggttctaaaatgggtattgtatccctttttcctcgatcgtcaacgagcaagaaaacggatgcgcgtgctaacgctttcgcgctagtgcgctcaatccggtgcttgtttggatgtaagagatctcgtttgctggccgggcccttccatgagtttagatctctatgtatgaatctcttattcaatcccatactttttctcatttcagaacgatcagcatactgtgtgacttctgcgtgacagttcttgcatttcgtttgttgctttgcatgaacatttagatattggaaagcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacctgttctgccggagctaatcatgcaaagctagcgtagcgccagccgtcgaagtgaatgaattcgaaagaacgaagaagtaaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatccctctgttgtttccctttcctcccgaacctttttctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatggnnnnnnnnnnnnnnnnnnnnnnnnnnnnnnnnnnnnn

SEQ ID NO: 611 - DNA, 458 bp, Oryza sativa
gttatgaacgtgccaaacttattggatttattcttggaatgctcataaccacctttactctttttttcattctttactcagaggaagccatgccgtttggagaagagcaccaagtggggggagtgtggagtccccgaaagaggagctttctaaaggcaagagaaaagctccgatggagcccttggagctacagggaccaccaacccttcgcagcttggacgatttgattcttgtgccactcagccctgaggagggcgcctgctcgacccagtcaggtactactccgccgccggccccgagtaactctgcgggggtcggtgcagccctttcttctattccggagtgcataaacaaggatcctcaaaaagcgaaatcatttcgttaatggcatttcagaaatgagtcataggcgcctgtacaatgacagaatagagagtcctttttttccagaatgaatc

SEQ ID NO: 612 - DNA, 310 bp, Oryza sativa
aaaacgaattaatcgcacgagaataaagagagagtcccattctacatgtcaatgccgacaacaatgaaatttatagtaagaggaaaatccgtcgactttataaattgtgagggttcaagtcaagtccctctatccccaataaaaagcccatttactttcctaactattgtaccaacctctatttttcattaatggttcaaacaagattcactatctttctttttctactctttcacaaacggatccgaactgacttctttggattttatcccattcatacaaatgaacatattatagtataggcaagtaa

SEQ ID NO: 613 - DNA, 696 bp, Oryza sativa
tgaataagatttttctcgattttagatcggatttggcggcatggccaagcggtaaggcaggggactgcaaatcctttatccccagttcaaatctgggtgccgcctgatcaataaaatacttaggcttatagtactgatccaactcgaaaaattcgtaccccgcataagttggggcaagagaataactaggcccggcgatacttgattttgagaacccacagttctttcctcaaactagggtttgttttggcagtagtggcccaaaccgctaccaatagggatgagatagcgtttccttattcttttattaatttgaattgattcttaattgattcgattcgagaatttaaaactaggaggctaagatgtcagaaatcttggtgggcacctgagcacaagactttttagaaaaggcctgcccgggatgtaccgaaagatagagatgctgcatcgaaacagtcagactaccgaggaaccgctactccataccacgctgaccaacacacggccgcgagagaagaggcaaaccacgcgatcagcaccacgacttcagctacctgatcaaactatgaaagcaggaatcgcgtcgtctgtatccctgctcaatatcttgttttggccacatggattggatataaacaaaaaagcctacacaagactttgggttcactttggccctcgtggaaaggacctatg

SEQ ID NO: 614 - DNA, 600 bp, Oryza sativa
  unsure (1)..(600): unsure at all n locations
nnnnnnnnnnnnnnnnnnnnnnnnnnnnnnnnnnnnnnnnnnnnnnnnnnnnnnnnnnnnnnnnnatggtgtttcacgatcagtattgaaaatgaaagctgaagaagttatcgaaactcggaaccacatgttcaatctttttttagcggtttccccagagatctttatcattaacgcaaccttcattttgctcattcatggagttgtatttagtacctctaagaaagatgattatccaccgttagttagtaatgtgggttggcttggattacttagtgttgcgcgcctaggagggcagcgcgcttggggtgcggaggagctattatcgcccagctccctaacctaatgcggccggaccgcagggaaccttagcatggggggacgtcctaatccttttgccgccgcaaggctggctaatcgtacgcagcaggagcaagggaactcccctggttcaggaaggcacatgagtccgaacgctattatgaatgtgcgaccgacactacactacgtaggtacctgtgcatgcaggtgaggcgtcggtcggtcctaaaaacggcggcagctagcgaggagggtaccgagctcgaattcgcctatagt

SEQ ID NO: 615 - DNA, 706 bp, Oryza sativa
  unsure (1)..(706): unsure at all n locations
ccttgaatcagataggaaatcctcacttttccaagacaaaagagaggcaagcacgggatggagcaactagcgcgaaagaacaaggaatgagcgctttgttgctaaagcgcatacgttttctggcttgatttttatacgattttttgagcaactagccgatcacgaaataggctcatgctcactcgtggtccctactgcttatgggactgtgatcgaatccgatctggaaaacagtgctttctgataactaatcactggaagcacccgattctctctactctgtttcacctctctttcttttggcttcttcttgagaatattttcacgttggatgaagggatgggctttcttttgagttggctttgatcgattgcttggtgtcacgctatttactactacggttagctaaattcgtttatgacaccgattcatttctagttgatccattcgtaaggtcgttcagaagcaaaggcctactactatactatacaagtaagctggtcaagtcaaaagaaggttcctgactatctagtaaatgagtgcacgaagaaagggaatttcatgtgtgagcaccttgcctcttttagggaaggctatttaccaagtgagtctgcgctgcatgctacgaaacataagaatcattttgaatnnnnnnnnnnnnnnnnnnnnnnnnnnnnnnnnnnnnnnnnnnnnnnnnnnnnnnnnn

SEQ ID NO: 616 - DNA, 873 bp, Oryza sativa
  unsure (1)..(873): unsure at all n locations
gtacttgctcattcttgtgatggatttcttactttacctgaatccgatcttgaaagaattagcacagcgggactgctgagatcacctctccagggcattaagccatgtcttctctatgcggatgatgccccccctcattttcctagatccgaagccgctgccattgctattattaaaggtactaatgaagctcttttaccaaggaaggtcaacctctccaaatcggtgttgttagtgactacggcttgcaatagcgagccacttcgtgtggctttactgcgtcattcagacacaggaacacgcgtaagaaacgaattaattgtactcaaaccatacactatttcctctttatctcatccctccggtgctgccttcatagcagcgcttactcactctacagtgaaatgtgattcttcgtcatgggacttctcgttaagtggttggcaatccatcaggaaactgcgatcttgcccggccccaacctgccaataggaatttcactgtcttcccgcaatccttctacccattttctgttcaatggtttcaatacaataaaaaaagaaaccatgatactgaactgaatcaatggcattccccagctttgtttttgaactctggtggtggcgatgaagtgttgtagccttgtagcacccttggatgcactccatgctctttcttatatttattgctcataaatgggcatggccaaacctgagatttccttcccaagactgattttatctttatttatagccgtacgtagcttcttgttcttactctcaatcgcttgagtcggtctaagaacaaaccactaaannnnnnnnnnnnnnnnnnnnnnnnnnnnnnnnnnnnnnnnnnnnnnnnnnnnnnnnn

SEQ ID NO: 617 - DNA, 1169 bp, Oryza sativa
atattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatattggaaaatggattggttatccataaatgaaaataaagaaagcttgattttggttccgcttcttgctctaagcagaaagacttgtcggaaatcgccggttgggttggtccgaccaagaaaggcatgggagtggagaggcggaagtgaaagactggctaccaataaagatccctcactgcacactttatatagttctgtatccaggatcggctgcatgctctagtgttgaatctggtatagaacccaggatgcttggttacaattccgaatacgctaaaccatgtttgttttatttttttttctcgactggccatgggtaatgagtttcgatgtattgggcgtttccgtttagaaatataagctttttcgtgcttgcttgcgagcattggaatggcctgaatggaatgaatattaagataaataaaagaaagaaaataaacaattgagaaagttattcattcttatattaatttcctatacttgaccgaacaacttccaattccgttatttcaactacaccaaatgatctttcgaattggtcaagactctcctgtttatggccccttctatatggttgttgtttcattgaatttgcttcaggctcgcgattcgactttgatcgttatggattggtaccaaaccaagatcaagtcctaggcaagcggacctaattttaacagccggtacggtaacaatgaaaatggctccttctttagtgagattatatgagcaaatgcctgaaccaaaatacgtcattgctatgggagcttgtactattacagggggaatgttcagtacggattcctatagtactgttcggggagtcgataagttaattcctgtggatgtctacttgccgggcttgccacctaaaccggaggcgggtatagatgcccta

SEQ ID NO: 618 - DNA, 2088 bp, Oryza sativa
tcaggatatatggattgtgaattacttacttaataatagggattacttgcctatactataatatgttcatttgtatgaatgggataaaatccaaagaagtcagttcggatccgtttgtgaaagagtagaaaaagaaagatagtgaatcttgtttgaaccattaatgaaaaatagaggttggtaaaatagttagaaagtaaaatggctttttattggggatagagggacttgacttgaaccctcacaatttataaagtcgacggattttcctcttactataaatttcattgttgtcggtattgacatgtagaatgggactctctctttaattctcgtccgattaatccgtttttcaaaagatctaaagaatgaatgatttgattactcaatattcgattcttctttcaccttcgattggaatggattcacaataattctgaattttatcctaatttattatttcataatcattcataatttatttatatatttatataatccagatgttgatacaattcattttttttagtacttcagttgattttgctttgtttatcccagttttaatttggattttgtgtgaaaatgaaaaaaaagaaaaaaaaggagtctttatgtctcgttaccgaggacctcgtttcgaaaaaatacgccgtttgggagctttaccgggactaactagtaaaagacctagatcctgaagtatctttaaaaaccaattgcgttctgggaaaagatcgcaatatcgtattcgtctagaagaaaaacggaaatttcgttttcatgatggtctgacagaacgacaattacttagatatgtacatattgctggaaaagcaaaagggtcaacaggtcgggtttgactacaactacttgaaatgcgtttggataacatcctttttcgattgggtatggcttcgaccattcccggagccaggcaattagttaaccatagatagacatattttatttcacggtcgtctagtcgatatactaagttttcgttgcaaactccgagatattattactatgaaggataaccaaagatcaaaacgctgattcaaaattctattgcatcatccgcccacgaggaattgccaaaacatttgactagtgactcattccaatataaaggactagtaaataaaataatatttagtaaatggtgaaaataaatgagttcttagtcgtagaatattattctcgtcagacttgaacctaacgaaaataagaaaggttcataaaattatttccccttttcgcggaagggccttaatccgtattttctcattcatgtatcacaaatggatctacagtaggatttttttttattgccgtaccaaagtaattaatttttaataatgaatttctatcaaataaaagtcttattgctgaaatctatttgatttgatacattgtggtcggtggtgaattaacagaaacggaaagagagggattcgaaccctcggtaaacaaaagcctacatagcagttccaatgctacgccttgaaccgctcggccatctctcctacataatcttattattgaccagaaactgagtgaatagcgagttttcgtatccctgcaagtacaggtacaaccacaaccgctcgggggttccatggttctaaaggaataattcctttcccatttccatggatacgagcgggactattacttactatttcatctaagctatttcatctaagtggaagaatcctggatttatttttactaggaattccgctaactcgaaaagttttagtttggtttttctccctcgagaaaaagaatggaagaattcttcttattccataataaccctagaattctgtttgcataacgtacgctacgccatacaatcgaaatagaaaatagggtaatgggacaattaatgactttgaaaacgcgaaatagctgatgagagaagttgttgttgagaaataagaaagtggaatgaaatccaatctgattcaaatattgaatatctctccttgtccaagcagaaggaaaagggacaatttgagcagaaagcccatatctattatctatttttagaatcgaattagtctggtttttgctatttcg

SEQ ID NO: 619 - DNA, 630 bp, Oryza sativa
  unsure (1)..(630): unsure at all n locations
tttttcccgtttgctgtccccgttattagttctcgttggccgcggcctataggaaccaggctacccctggcttttaagccggttgcatgggttagggcacagttttgcgttcaataatcctgggggctttcattttgccacgtgtttggttcgtgttcgctttaaggccccttttccatcaataggtactcccagggcgtcgtccaccgggcctaccatggcctttcctgcaggagcttccccaatagatccagtgcgcttgacaagatgtccttctttaatagcggtatctcttccaaagccaccaatacttactttctcattctcaagattcgaggttattcctttctctccgctggcaaattccaccatttctccagcgtgtatctcgttctatccatcaacacgtgcaattccatctccaactgagaccactcggccgatctcatccacttgacaattcgtgttaaagttggtcattctactttctaatagagtcgtcagttcggcagctctgggtgagccctccatacttttccgtagccgatggatgatagaagggagaaatccgcttttnnnnnnnnnnnnnnnnnnnnnnnnnnnnnnnnnnnnnnnnnnnnnnnnnnnnnn

SEQ ID NO: 620 - DNA, 726 bp, Oryza sativa
  unsure (1)..(726): unsure at all n locations
nnnnnnnnnnnnnnnnnnnnnnnnnnnnnnnnnnnnnnnnnnattcttcctagtatggaagaagtaaataaaaagtactgcgtctcgatctatacgaaagggcactggttttttctttcggtttcattgatagcagaagagtacgctagctagcggagcctgaaaacgcttgcttgcgccccaccccgtaagctgactctattgcctatgcttgctgctcgctcagtgtcagtagaagggaagaaaagatggtcacttcttttaggaacacggcgagccttacttacgactgttgcacttcactcgcagctcgttcattcacttgctcatgaactcgctgcttcgccagaagcgactagtcgcctcctttcctccgccgaaagatgcttagccagaagcgacgaaggaggggagctggggaaggccgacgatggcaatgagggggaagctgtcgtagaagctttgccccttgctttacagaaattgttatgaacttactaaatgaccttatttattctcccggaacgctagcaaatctaatagttcccatctgctcttcttaacttaagaacgaaggtccttcttattcaggaaccctttgtttgaggggggcgtatccccggggaggggagagtggccgagcggtcaaaagcgacagactgtaaatctgttgaaggttttctacgtaggttcgaatcctgcctctcccacttgttgtagacttaa

SEQ ID NO: 621 - DNA, 732 bp, Oryza sativa
  unsure (1)..(732): unsure at all n locations
nnnnnnnnnnnnnnnnnnnnnnnnnnnnnnnnnnnnnnnnnnatctttccccttcttgatgagcgcactacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttatcaaaggaaagggcgggtggacatacgttgcgggtgtccagttggcatgggtctgggttccgctcatcaactcgaacggtcaatgctggccagatacctgcatcgttatacgtcacaagttggggtggttgaacaggaaaaacaacaacgctttccttttatggcactgctcaatccgaataccagctactatacccttttcaaaatactagctttttcccttttgccttcccctcacgggtaagatattttatattccctggactagtacgcgtacgctatttatattccttgcgcaagagctattnctatcctttcagccaaagctttctgtcggaaaacaggtacgaatcactagaataccctacctcatttaccaacaaagagagaaaaga

SEQ ID NO: 622 - DNA, 511 bp, Oryza sativa
  unsure (1)..(511): unsure at all n locations
nnnnnnnnnnnnnnnnnnnnnnnnnnnnnnnnnnnnnnnnnnnnnnnnnnnnnnnnnnnnnnnnnnatctttgggcttcgatcatcgaggaatagagactttacaaataaaagcagaggattgggattccattgctgtcattttatatgtatatggttacaattatttacgttcccaatgtgcttatgacgtcgcacccggtggatctttagctagcgtgtatcatcttacgagaatacagtatggtatagataacccagaagaagtatgcataaaagtctttgcccaaaaggataatcctagaatcccatctgtcttctggatttggagaagtgccgattttcaagaaagaacgcgaatcttatgatatggtgggaatctcttatgataatcatccacgccttaaacgtatcctaatgcctgaaagttggataggctggcccttacgtaaggactatataacccccaatttctatgaaatacaagatggggtaccgagctcgaattcgcc

SEQ ID NO: 623 - DNA, 36737 bp, Oryza sativa
  unsure (1)..(36737): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagtaaagccttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaagcctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacgtggtcccgtggagtacgaataaggcttgaaagttttccttcatattgtttgctagcttccttctccttgtttcctgcctttcattctttatgaaattcttattgattttctttgctgactgacgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctttggtcaagagttggcaagggataccaatgttgtcgaccacctacctttgagcatagcttttaccatattcctccctcgattcgccattcattccttcacagctgagtcaatagctgtgtcaactgaatgtagttcttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtggtaattatataactgctttgaggaggaagagggaaattgtcaataactgtttgcaagatccacgtatattaaaagaatatataaataaatatgtgcaaacgcactatgaaatccgttatagatattatagtcctaattggaataatatgtgcttattccacaataatatcgaattcaatcaaccaattgtgaggtttcattataattatataagggatatgctttctttaaggagtctctctcctatgaaatttggtgaactctctatgcgaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccagaagattatcatgtctttctcaatgagagggcaaatgtgactgattatagtaaggtagttttcgtggaaacgaaggatcttactccagtagtgctgtctgcctttcaaaatgattatccatttaatgaaatgtttggtcctataccggaaacagagagtcctcataaaagaaaatggttactatccatgggtttaggtataatgatcactttccgcttatcggtaggtgtgctacctgacataaacgaaattctactaaattgaaaaaatgaagatgaaaccaaatactatgataggattgattggattaaatagataggaatgattggattgaatagaacaactatgaaacataatagttgattgaatagaatgttggtctcacaagtcggtacggtgtgcatatccatccttggaagaagtagctccgtcccagtctttgtcggaacttgaatcgaggtaggcaaaagaatccttactcggaacgagcccaagataaaaggtctagtccaattttagtcttggttgtacatcggtactacgcacggtaggcatttcttcccgttatcgggacttgcacttgcccggccttagtggtattttaatgattttcttccccagcaaatcaagtaaatagaagtaataattcaagtccctccgtggatttgaacatacttcgcttcgtggagccgaggattagatcgatctgaactttcatttcttccattcgcagtaatcgttggttttgtccaattccttcaatcatcactgttttgttctgtaattccatttcattttatctattttcttcaagaaattccattgatgtgcttttctattgctctcattcattcctattcaatctattcaaaactacgggtactggtctcaatgggaaagagccctaattcgatatgtcgtttctagagtatcagcaagtggtaagcggattacaagcaagcggcgaaggtttgaattgactagcttgatccctactattaacaaggaagaagtaagcaagcaagaaagaaagtaagttcagtctcttatttcgaagttcgctgtgctcttgttcaatagacattctgctggaactcacctttatctttagagatgatgatgaatattctttagagactcctctaaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttccttcgataccttggcttctttgatttagtgattaagctacctctacctatatgtttgcttcaacaacgttctagcttgcgtattctgatcacacaatggaattcaggtggaccagggtttgggacactaatctttaaattatagatgcattataacatgtcaagggaggcgccgagatatgatatgaccaaaggccttgttgttgttgcgagccgggctcgaactgacgaggagagtggagaggaatacagtagtagtagtcgggccaggggcttatcttattccttgtattcattggtctgtataggggtcacatatagttggtgtgctttgtgaactgcgatcttgacggtgagactgataggaaaatgtctgaaaaatggggagaagccgagtaggataggactcgaaagccgagctattaattgaatcatgcttttgattgaacgacaaaacatcgatctgttaaagtcgataattctgattcgtcttcggggtatgccgtaaagatagccgagaccgaggataggtgccgatctgttttacgggcagtaagtaccgttgttcgaaaggaaaggttggcattgcctaaaccaaggataggtttgaccctaggattgggattttagaaaaaaagggatagcgctcgtcttttctctactctagcgtatggactcgtcccaggattgccggagctagcgttaggtgagattcctttgattgaatttagcttgccatcatgatacgctgcagttagattaggaaccgtataggcggcctcatatacccggaagctttggattcacggatccgaaacaagacatattcactgctactgatatccctccctttgctttgaagccgaagataacgataggatttccggaaccgaaactattattaattataattagattgcgaactcaggagggcttagtaccagctacaactatcaaatccgttaaggagcagatcaattggcttagccgaaaccgtgcccttatcttttctttgcattagccgaggacaatactagggatgcgggaagttccgagaataggattcgattccccgatcttctaattgagttggatcggcctagtccagagggagaggagcaatcaacgctaattcgtattgcgataaatcgtagtcatattattattattggcgtacgtaatttctttactacgtctatcgctcgtaggaatatctctaaataggaatcgtagtcctcgtatgtacatgtttcgtattgtgataaagcacctatgccgctagaaatagtagcgccttaaagaaggcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgtgatctgtttacggtattcttgaagctttctttcttggtcaccggacagagtgagaactgctctgctttctttccctagcacacacttagtagatagtaggcacaactccgctaagagctcatcgaacttgagttctagagtaagaccacagctcgatatggctcattcactagtatggtttaccacatgccagtgatagatctctctcaagcgaggtttggtatcggtgaagtcaatcattgaattgaagtggtagagtgcatagcggggcataaggccccatgtatttcttatcagtgtgtttataccttgaattcaattgatgctgttctagcttgttttaaacaagttatagagtttgttttggttccaggtggtcatcccaactcgtattagctatcgaaaagccgtacttacttgagtttcccgctttccataacgaatcccccgctgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggatcggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacatagagaaaagaattgatagctaaagtttgcttttagtagtttagtcaccaatcaaaaaagtagctaggctgaagccgaagcacattccctagcgtactagcgtacgagagaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccgagaagcttcttttagttagccaagcgggtcatgtggatgggtcaagagatgcgtaaacgtgcccaacaaggggtaggtgtggtaaaagggtatgcgggttgatgtgtccttcaccttgctagtaagagtggtatccttattggcagcaataccccatttcagtttctggatttgcggaatgatttgaacccctattttaaaaaccaatctatttggcccggtacggttttccttcaataccactcctacgatagaggctgatatgactacgagcgagatatgactattcctatccttaagcgaatgctggaacgaaagtaaggtcttccctcgaagtgaaatgaaagcaaagggtattgcaaatcaactaattgttctctaataccacctcctcctgtatctactattggttgactgaaaataaaccaaaagcaagggtggttgcacatcttctgaaaagataagggctcggtatcggctcaatcgaacaagctgaggtatatagggaatagtagaacatattgattatcctattggattggttccgctcagtcgagatatgatgagtcaatgggcattgagagtttcgattcaatgtgggaatgactaagacaagttaggcgaaacagatatgcaccatagaggtttatccaccgtaggtttgtagacaagaatagtagtcacagcgagggatgcacataaataagatctgcactggtataagtgataggttttgggtaagctcgctcatatcgaaagaagaattcgaaggaaatgaagcataagctgtcaccactaggataaatcaaattgaatcctaggctgtttcgatagacaaaagaaaatagaaaaaagtagtgagtgagaaagaaataagtagcggcgctttgcttgcttggaaacgaagtagcagatttttgagtagtcttttcttggctggtaactattcaaacagagctagccctctttcttgatacctatgtactgtccacatatagtactgtttcgtgaaaaaccaataggcattctacacagagaacaattcaaagctgactaccatatactactgtccctgctttacctgctgtccaagtaagtactaatttcgaatgcgaggttgcgtagcaaagctacaagccgaaagtcaagaatgaactgagttaactagctggtagcactgtcctacttgtctattcgttccaactattctatttgtttgcttgctggaacaagggaatatagggctgctgagctgtccaagtagaagtagctttcctactagttgttccaactaaccaacaagcaccggattgagcgcactagcgcgaaagcgttagcacgcgcatccgttttcttgctccactcataagtccaatctggtaaatcaagaaatgaagaggtattggtatatcaatgaacacactccatagagtttctgctcaaatcagagtgttggaaattaagaaacagtttcatcccgccttccactcatccccgcatttcgctcaaagctgctctctcatttcttcgcccttaggaaggtctctactgcaactgagtttgaaagcttttactcatcaaatatttttggcaagtaaagtaggtatcaatctgcttgaaagcctgcagagtccaattttgagtattttcagttagaatctagagtcagcctattcagttcttagcccttaagggtaaggcagggggtaatatggatagtctctgtccctgtattcacattccaccttcaacaaagtgttgatttcccgtaaagctaactgtagtcctttaagtaagtagatatcttaggcaagttagcaatctcgttatattaccaaggccttcccttctattgtagaaagagttctcagccatctaattgcagtgccagttgccagctatccagtttcatttgaagttgctgggggtccaaacgagctagttgcttttattcgtcctataagtccttccacaagcgagtcaatagggtgctggctagttgtagttgttggcgtgcctttcctttcatcttgaatattaataaatatttggataaattactttagaataagaagttcatgttttatagactagtaagataactaactagttaagtaatacgaatccatactaggaaaatgaaaatgtgagtcctaggcactggaattggttctcttctccctaatccctataagccagaaagggtaataggcttcagtgtaagcatttccttcaagcaagtcatctcaagttttaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggcatttatgatctagtggagtgagtgattgtgtggtgttcagtctaaggctttttgaaaagcggatttctcccttctctcatccatcgtctttgttaaagtatggaattctcacccagagctgcggaactcacgactctattagaaagtagaatgaccaacttttacacgaattttcaagtggatgagatcggtcgagtggtctcagttggagatgggattgcacgtgtttatggattgaacgagattcaagctggagaaatggtggaatttgccagcggtgtgaaaggaatagccttgaatcttgagaatgagaatgtaggtattgttgtctttggtagtgataccgctattaaagaaggagatcttgtcaagcgcactggatctattgtggatgttcctgcgggaaaggccatgttaggccgtgtggtcgacgccttgggagtacctattgatggaaaaggggctctaagcgatcacgaacgaagacgtgtcgaagtgaaagccccagggattattgaacgtaaatctgtgcacgaacccatgcaaacaggcttaaaagcagtggatagcctggttcctataggccgtggtcaacgagaacttataatcggggacagacaaactggaaaaacagcaatagctatcgatactatattaaaccaaaagcaaatgaactcaaggggcacaaatgagagtgagacattgtattgtgtctatgttgcgattggacaaaaacgctcgactgtggcacaattagttcaaattctttcagaagcgaatgctttggaatattccattcttgtagcagccaccgcttcggatcctgctcctctgcaatttctggccccatattcagggtgtgccatgggggaatatttccgcgataatggaatgcacgcattaattatatatgatgatctaagtaaacaggcggtggcatatcgacaaatgtcattattgttacgccgaccaccaggccgtgaggctttcccaggggatgttttctatttacattcccgtctcttagaaagagccgctaaacgatcggaccagacaggtgcaggtagcttgactgcgttacccgtgattgaaacacaagctggagacgtatcggcctatatccccaccaatgtgatctccattacagatggacaaatctgtttggaaacagagctcttttatcgcggaattagacctgctattaacgttggcttatccgtcagtcgcgtcgggtctgccgctcagttgaaagctatgaaacaagtctgcggtagttcaaaactggaattggcacaatatcgcgaagtggccgccttcgctcaatttgggtcagaccttgatgctgcgactcaggcattactcaatagaggtgcaaggcttacagaagtgcccaaacaaccacaatatgaaccacttccaattgaaaaacaaattgttgtgatttatgctgctgtcaacggcttctgtgatcgaatgccactagacagaatttctcaatatgaaaaagccattctaagtactattaatccagaattactaaaatccttcaacgaaaaagggggattaactaacgaaagaaagattgaacctgatgcttctttaaaacaaactgcgaaggagattaattagatagacctttttatttttcgtcgttcgatcacgaaaacagggattctggaacggccaaaaatcccagcggttgttcgggtcgaaaaaccgagaannnnnnnnnnnnnnnnnnnnnnnnnnnnnnnnnnnnnnagagcctagtcctcaacctcttcttccccaaaaggtagttatgaacgtgccaaacttattggatttattcttggaatgctcataaccacctttactctttttttcattctttactcagaggaagccatgccgtttggagaagagcaccaagtggggggagtgtggagtccccgaaagaggagctttctaaaggcaagagaaaagctccgatggagcccttggagctacagggaccaccaacccttcgcagcttggacgatttgattcttgtgccactcagccctgaggagggcgcctgctcgacccagtcaggtactactccgccgccggccccgagtaactctgcgggggtcggtgcagccctttcttctattccggagtgcataaacaaggatcctcaaaaagcgaaatcatttcgttaatggcatttcagaaatgagtcataggcgcctgtacaatgacagaatagagagtcctttttttccagaatgaatcattctattcaaatctcacaagttctctttacgcgtcttctaggggcattgttgaacgcaatctgcaggaacaagaaatgattctttcttattttgaaacagaattcaaaataaaggaggatttaattcggttgctttatgaaggccgacgccgtgccgatagatacgttatacacgaaacgaaaatagccagtacggtggacgcgttcctttccaaaaagggattatcaggagctcccagtgccgagggggtagttcaactcaagaaggagcggtactttctggaaaatcccgggaggaatggagctcctttgtatagggaactcgaagaactcttctaagggggccccaagccgaaaaaaagcaaatctctttcgtgattttgtaggtgtaggtatatagtgaagtgataccgaggccctctccacaacctagtagttgatgggtatggggaggggagagaagagtgggtatgagggcttctctcgccatccatagccccctttctttaaaatgcaaagtggacgttcccgcacgaatctccggaattcggattcctgatattgatcactagaatcaagctttttatgaggctctctgcccgctatgtaaaataacctgactctgagtagttacatactactctatataacatagaaaaagcaggctacccataacgggagaaccaaatcctcattgaattggatttatcaattcgaaggggggtcgtacaaggtcagcagtaccccctgtgaatccaccacctgtatgataagttcttaatgttagttgagtgccaggctcttcaatagattgaaccgcaataatacctacggcttcccccaattcggggggggccaatctttgtttaaggatgttggataggtgattcatcaatgatgccgattgggaatctaaggagggggctccgccctagtaccgctatatatccatcttctgatagtgggtggttttcgtacgcgtagcgccttgctaccaagtgccagtagtgtaggagatccctgcaataagagttgtgagtgaaatcggttgcttgttgctagcgggaaggaaggaaaggtcagattaccaaaaaagccagctgcatgtatactcgtaggaaagacaagatcagatagaaccgatagaaagtaagaagggtaagcaatcctctgattctatttttatagtcgtccgtcattcgatcgatagtgcaagcctaaaagtcagctatttaaatagtcaggtattgaaatagcatggtattaaaagggtaccgaacttctatactataatagtaccgaaggccttttcttgtctcaccggatatgaaatgcaaccttctactaaaagtatgggggataatatattttatctaattagtaccctaaggatactcttttttctgcacgaacgatatagaagtactatctatgtatttggttacctatgacctattaccaacttaactatgttggtctttcccattgaatgtcagtcttgaaacattgccttgtatattcagaacagtaatgaaatgtctctgaatctggtatccaaacgttgtaagtcgtacccggttatacgtatcacccaacaacacgtcaaggatggtatctcttgaataggcgtatgaaagatttcttgcttctttcgaggaaccggacactggcgcttgggtaaggcgttctcgcagcaaaatccttcgtgaggtctatctactgggcttgagtttgaggtctacatcgtaggtagggtcttctaaaaaccacatgaaccttcactcttctgtctgaggagggcaaatataggtataaagcctgggcgagtgtctttgtccagcgcgagaaagctcggaattgaatgctttgaatgcgcaaaatgaatgctttggaacagttggtactttcagatcggaagatgctctttgactttcgcctctattgttcatacttatttatgtgctgccagtcgtactcctgttaaaaatccaatttttgatacaagataagaaacgcttcgtgcctcgcatttgacgggcggagttcaatggatgctatttctcctgagcttaatctcggaagtgagttagcgaataataaattatttccattcttccagatcattctttcttttcccacgactccgtgttggttttgcagtagaatgagctgcagactcccagtgttatttcaaccttaagttccatcgacttaagcgtaagcgccccacctctcttttgagagtgcgagagatttccgcggcctgtaaacacatggtttttccagccgtgaccctaatttacttactgattttaaaacctacctccggccgcccattggttaggatcgccctttggttggtggaagcgagaatcatcttttgatttttttaagtttcccgaaaaaactgaaaaagcttatattatatatagtatctggcatgcctaaaagagatagctggcttaaaacacgacagaagtaggacgcactgaggccgagctttactgcttgagtaattgtctttccagtagagctttcccttgttaagtagagaattactgtccttcactcatattttgagaaacagtacgcagcacgtatggaaaagtcagcctaggcagtcaaccttttcttgacttcacgagtttcaaacctgtctgttagaggggagccaacactctctaactacctatactacgcccctattgattggaaaccctcggggatcccataaacaaaggaattatacagtacgaaatagcaaaaaacagactaattcgattctaaaaaatagataatagatatgggctttctgctcaaattgtctccttttccttctgcttggacaaggagagatattcaatatttgaatcagattggatttcattccactttcctatttctcaacaacaacttctctcatcagctatttcgcgttttcaaagtcattaattgtcccattaccctattttctatttcgattgtatggcgtagcgtacgttatgcaaacagaattctagggttattatggaataagaagaattcttccattctttttctcgagggagaaaaaccaaactaaaacttttcgagttagcggaattcctagtaaaaataaatccaggattcttccacttagatgaaatagcttagatgaaatagtaagtaatagtcccgctcgtatccatggaaatgggaaaggaattattcctttagaaccatggaacccccgagcggttgtggttgtacctgtacttgcagggatacgaaaactcgctattcactcagtttctggtcaataataagattatgtaggagagatggccgagcggttcaaggcgtagcattggaactgctatgtaggcttttgtttaccgagggttcgaatccctctctttccgttctgttaatcaccaccgaccacaatgtatcaaatcaaatagatttcagcaataagacttttatttgatagaaattcattattaaaaattaattactttggtacggcaataaaaaaaaatcctactgtagatccatttgtgatacatgaatgagaaaatacggattaaggcccttccgcgaaaaggggaaataattttatgaacctttcttattttcgttaggttcaagtctgacgagaataatattctacgactaagaactcatttattttcaccatttactaaatattattttatttactagtcctttatattggaatgagtcactagtcaaatgttttggcaattcctcgtgggcggatgatgcaatagaattttgaatcagcgttttgatctttggttatccttcatagtaataatatctcggagtttgcaacgaaaacttagtatatcgactagacgaccgtgaaataaaatatgtctatctatggttaactaattgcctggctccgggaatggtcgaagccatacccaatcgaaaaaggatgttatccaaacgcatttcaagtagttgtagtcaaacccgacctgttgacccttttgctttttcagcaatatgtacatatctaagtaattgtcgttctgtcagaccatcatgaaaacgaaatttccgtttttcttctagacgaatacgatattgcgatcttttccagaacgcaattggtttttaaagatacttcaggatctaggtcttttactagttagtccggtanaagctcccaaacggcgtattttttcgaaacgaggtcctcggtaacgagacataaagactccttttttttcttttttttcattttcacacaaaatccaaattaaaactgggataaacaaagcaaaatcaactgaagtactaaaaaaaatgaattgtatcaacatctggattatataaatatataaataaattatgaatgattatgaaataataaattaggataaaattcagaattattgtgaatccattccaatcgaaggtgaaagaagaatcgaatattgagtaatcaaatcattcattctttagatcttttgaaaaacggattaatcggacgagaataaagagagagtcccattctacatgtcaataccgacaacaatgaaatttatagtaagaggaaaatccgtcgactttataaattgtgagggttcaagtcaagtccctctatccccaataaaaagcccattttacttcctaactattgtaccaacctctatttttcattaatggttcaaacaagattcactatctttctttttctactctttcacaaacggatccgaactgacttctttggattttatcccattcatacaaatgaacatattatagtataggcaagtaatccctattattaagtaagtaattcacaatccatatatcctgacatttactaagtccaattttagaatactttttgattttttagtccctttaattgacatagatacaagtactctactaggatgatgcacaataaatggtcannnnnnnnnnnnnnnnnnnnnnnnnnnnnnnnnnnnnnnnnnnnaccagttcaaatctggttcctggcacagaaaaaaggatctaccgaataggtattgatacaaattactcgagatggattgggatacatattcgttaaaaatatagctagagtatgatttattcatctaagtagagaaatctctaaatagagacacttctttttagagaagggtaaaaatctctggtccttttctttatggtacaaaaggaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtatttttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcataagattcgcgttctttcttgaaaatcggcacttctccaaatccagaagacagatgggattctaggattatccttttgggcaaagacttttatgcatacttcttctgggttatctataccatactgtattctcgtaagatgatacacgctagctaaagatccaccgggtgcgacgtcataagcacattgggaacgtaaataattgtaaccatatacatataaaatgacagcaatggaatcccaatcctctgcttttatttgtaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttctgcataaagagcccctcctaattcactaatttgtaggaagatactggacttttggattttcaaaaagttgaagaagatatgtctaaagtagatggtgattgatagagcaattcttgctcgtaagttccagtatgagtactgcgccgaacataaagcttgtgactggtagtaaaacatcgatttctcttttgagatagagttcgatcctcaactatttctcgcgatatcttcttatgaagttttgttagggcatctataaccgcctccggtttaggtgggcagcccggcaagtagacatccacaggaattaacttatcgactccccgaacagtactataggaatccgtactgaacattccccctgtaatagtacaagctcccatagcaatgacgtattttggttcaggcatttgctcatataatctcactaaagaaggagccattttcattgttaccgtaccggctgttaaaattaggtccgcttgcctaggacttgatcttggtttggtaccaatccataacgatcaaagtcgaatcgcgagcctgaagcaaattcaatgaaacaacaaccatatagaaggggccataaacaggagagtcttgaccaattcgaaagatcatttggtgtagttgaaataacggaattggaagttgttcggtcaagtataggaaattaatataagaatgaataactttctcaatggtttattttctttcttttatttatcttaatattcattccattcaggccattccaatgctcgcaagcaagcacgaaaaagcttatatttctaaacggaaacgcccaatacatcgaaactcattacccatggccagtcgagaaaaaaaaataaaacaaacatggtttagcgtattcggaattgtaaccaagcatcctgggttctataccagattcaacactagagcatgcagccgatcctggatacagaactatataaagtgtgcagtgagggatctttattggtagccagtctttcacttccgcctctccactcccatgcctttcttggtcggaccaacccaaccggcgatttccgacaagtctttctgcttagagcaagaagcggaaccaaaatcaagctttctttattttcatttatggataaccaatccattttccaatatagttgggagattttacccaagaaatgggtacataaaatgaaaagatcggaacatgggaatagatcttataccaatactgactacccatttccattgttgtgctttctaaaatggcatacctatacaagggttcaagtttcgatcgatatttgcggagtggatcatccctctcgaaaacgaagatttgaagttgtccataatttactgagtactcggtataactcacgcattcgtgtacaaacaagtgcagacgaagtaacacgaatatctccggtagtcagtccatttccatcagccggccggtgggagcgagaagtatgggatatgtctggtgtttcttccatcaatcatccggatttacgccgtatatcaacagattatggtttcgagggtcatccattacgaaaagactttcctctgagtggatatgtggaagtacgctatgatgatccagagaaacgtgtggtttctgaacccattgagatgacccaagaatttcgctatttcgattttgctagtccttgggaacagcgtagcgacggataattccgaatctacataactagtctagtccaggagacaaatcaataggaaatgctatttgcttcttaagaagaagaacttttttgaaatgaaagagtttccacgggcgtcggatatcatttcttcaaataaggaagaagtgttatcgaaggatttccttccattcttcctagtatggaagaagtaaagaaaaagtactgcgtctcgatctatacgaaagggcactggttttttctttcggtttcattgatagcagaagagtacgctagctagcggagcctgaaaacgcttgcttgcgccccaccccgtaagctgactctattgcctatgcttgctgctcgctcagtgtcagtagaagggaagaaaagatggtcacttcttttaggaacacggcgagccttacttacgactgttgcacttcactcgcagctcgttcattcacttgctcatgaactcgctgcttcgccagaagcgactagtcgcctcctttcctccgccgaaagatgcttagccagaagcgacgaaggaggggagctggggaaggccgacgatggcaatgagggggaagctgtcgtagaagctttgccccttgctttacagaaattgttatgaacttactaaatgaccttatttattctcccggaacgctagcaaatctaatagttcccatctgctcttcttaacttaagaacgaaggtccttcttattcaggaaccctttgtttgaggggggcgtatccccggggaggggagagtggccgagcggtcaaaagcgacagactgtaaatctgttgaaggttttctacgtaggttcgaatcctgcctctcccacttgttgtagacttaagagaagagaaagtaggcggaagcctaggagggccaaccgagcgaagctctttctttttttggccgtgccgtgaagtgcaattttctcgtatgcgttttagagaggttgtcgaaaaaagacgatctatagagattccccatctatatccaatcgagaatagaagcgagtcgcttccggcgtcggcttgtagtctctgcagtcggcacacgcacgcgcccgccatcatgcctccttggttcgggacgaagccaagcgaggcatacgatagacgaaggaagcgcccacccagcaggagggctaaaacctgtagttttgaagttgcaaactccagcttcgaagctggagtgctttagccctttagttttgaagcaagaatcaccgtcttgagcgccttgcgcgctcaagaacaagcgatgagcgctttgttgcgcctgtgcggatacgttttcttgctggggaaggctagtttgatcgaggattggggaggagaggtggaataaaaagctcgggatggattttggagtctttgtgcgagccgtatgcggtgagagtcgcacgtacggtaaggaggggggttcgcgtctatacgtgtagtgtggtggttgggcctacccaccctatttgttccatgatctatgggtctactggagctacccacttcgatcaattagccaagattttgaccggatacgaaatcactggtgctcaatctagtggtatttttatggggattctttttatcgctgtaggattcctattcaagattactgcagttccttttcgggcggctgtaggacggacggccccctataggtagtagggtaggatgggtggtaccgctcagatagcggccaatcctcctaactgcgcgcgggccgggcttagagcgcgtgaaactcatcactacctcgtaagggcgttgagaccatagcatgttacacaaaagcgccgctttctcaggagtgttgtcacacagctgcccgactagaagagctactcgctctgtagtgttgtcacacaagataagcacgccgcccgcctgctggccgggcgaatcgaagttatcttccggtcaactgtccacccagtcaagtgcaaaaaacacagtggaatcacgcaacgcacgctgctggtgtgcttcctgcccacgaggaaagaagagcgacaaggttcagatttgactgtttgcagcatgggagctgattacccaaaaaatccctgggaaaaagaaaagatatctcggtaacgaaaaccataggaggctgtattggcgagatccaagggttcccagcagcccaaaagaaaaaccgcctggaagtccgaggacctttagtaccgtaccgaaccagcagccttcgcgccaagcgacgaccgcccttgtccctttcctttttccattcagcctacttcttagctttgttccgtcagtctaaggcaaagcttaagtggttcgcctaccttacccacttgatgaaagggaacgaacttcgtttccttgacggttttatggatggattcagtcagcctcactccttccttttgaaaagtgacgctttgcgtcttcgcttccgagggttagggtataggccgtttcgagcaagctttcgctttttctcccggctttctacaactttcgctttagcttcgcgacccctttccggaatttgaagtattcgtcgccctaccctaagaaagaagtcactataaaacagcttgccctcctgaagtaccaaaggtgcgcggagcccggtgaaaatgaatatgtttgctactgaaagaagcctgcctattgactaatattcgtctttagaatgaaagtagctatgaagcccaatctactgtcgattcaaaagagggcatagtcgtatgggtggggtgtttgtggggagctgccttggatatgaggaattcctcaaatctaaaaaaaatagaacaaaggcaaagtccgtgacgaagatctttcttttctatcaatagatagaaatgagtgttcgttataggggataggatccatctgctctctctctattttctttgatgcaatttagagagaaagagcagtgcgaactagaaaaaaaaagataatcgggagatgattaaaaaatagatacatagacatctaaagtaaagggatgtatatattattcctatatatatcatctatctatgaaaaaagtaaacagagttcgtttttgggttccccgaagccccgaatggattggatcgtttctgcttctgccaacgaaatgaaggcctcgccccttccgaatgcttctccgatcctgaagttctcgcgaagagaataagatgcagctccccctccctctgtctttttccgctttgctaatcttcccctctaacgcgggccgggccgggcttaggcgggcgcgggaggaagaaagaaagtcgaagagcgtcttctcctttgtccttttttcagtgcaacacaggaaagcaccctctttttgtaatccctgcagcttcccagaggcttttttttgtattgaacgcatggcgtagctaggacccctccaatcatgtttgagcctatgttcacccggggcccaaaaaggagaattccggaatgcctgccgacgttcagataaagtgcatatcccttaccactaaaggaaaggctcgacgaagggggggggggattttccgggtaaggaaaacgctttcggagattgagatgtcgatttgtttttcatcgaaaaggaagaaggccgaggggatagctgccttccttcgggctttgcctgccgacgttctaataaagaattccggctcggcccgggaaagcgctggcaacaacataaagaaaggggtccatgtagctgctgcgcccgcccactgagcagcaggttcggcatctactacaaaagagagaatccacttcagataaccacgtctctgctaggcagcgtgtggaatggccgggagcggaccaaatggatatataatccaagccgagagtggagttacgtgaacagccgtctgatggaaaacaactttcatgttcggttcagagagcacttttttcgttgagaataagtccttcccttttgtgtgaattccccagcggcgaattaacaacttgtggggccctatctattcaatctctcgagccccaagaaaacccccctctccctcggactcaatctctcttttgactctatatatgtgggcacctgatatctatgagggttcacccaccccggtgacagcattcctttctattgcgcctaaaatctctatttctgcaaatatgtcacgtgtttctattgttgcttcctatgggggtacattacaacaaatcttctttttctgcagcattgcttctatgatcttaggagcactggccgccatggcccaaacgaaagtcaaaagacctctagctcatagttcgattggacatgtaggttatattcgtactggtttctcatgtggaaccatagaaggaattcaatcactactaattggtatatttatttatgcatcaatgacgatagatgcattcgccatagttccagcattacggcaaacccgtgtcaaatatatagcggatttgggcgctctagccaaaacgaatcctattttggctatgaccttctccattacaatgttctcatacgcaggaatacccccgttagccggcttttgtagcaaattctatttgttcttcgccgctttgggttgtggggcttacttcctagccccagtgggagtagtgactagcgttataggttgttgggcggccggaaggttgccatgagtaaggttgggagaccgaaggcagttttccgtgcaccggacacgtagcttaccgaatcagttgcaacacagatgggaatgcatgctacgaaagacagggtcgagtctgatacatcaaccgtcgactccatatccttgtacgagtccacaatcactacacgagatgaacctgggtttggtgaatggaagttggccttaggtgtaataggactcccagttactgcgcgcgatcgtatactgaggtgctccccgtcggttgttggaacgacgcgagccgggccgggccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggcccaaagcagtgctttgtttcctggccaaatcaaggatttggggctgattgcaaaagatatctgaatatcaagatagatccatccatctatccagatatctaaaaaagaatcgatttcgatttcataaaacctttgattcaaagaactgcgcttagcccccccgctcatgaaacggctctgctgcaatggatggcagagggtccgtagtacccgaagcactggagtgatccagtagccgggaaggggcctagaagtgcctactactacaccacactacacttggctctacacatttacagagcttacccctgtccagtgtctggcagaacgttgggggcttcaatcgtcgactcgttatccccatctcagcccaggctaacggagcctgacttattcaggggagagagtggagcctatcgaagcactcttgagagtaagatccttggctcctcttcattctctacaggggtctctgcccacatggaagcggggcagagatggataagatcaaacacgggaataagaagcattttaaatgcctttttgatcattttgatagagggggatggataaagtgggcaaaacagactcacattttgaaatcgaaaagacctttttcgtctcgacaaagaaagaatcatcttgaaaacgctcctaaccccttcgtagggccgtgtatagtaagtgatccgaacccgcccggagcgagccccccttagaggcaagtgaagttggtgagccgtatgatgggcaactatctcctgcggttcggagaggactcagctgttagttagtacccccttggtttcggggtggaccctttcactctattttattatatacgcttagtgaaaagaatgttttttgatagacctaggacatggattctatatgaaccaatggatcgtgacaagtcgttactactagcaatgacttcctctttcattacttcatcctttccatatccctctcccttgttcgatcttactcatcaaatggcactcagttcatatctgtaaattcgatcattgacaaggttcaaagaaagggtggactgcaggtaagcactaattaaaacctccgcatttccgtgattcaaaaacaagaagggcgtacaacgcccaggtaatatttctttgctttcggatatgcttttcaatatcttcacttgtgaaaatagaaacacttgcactttctcgcttggaaaagaaagactatcctcgaagtaaatcaatctatctcgtattgcccaatctggatgctaaaggctcgtcaccccgggaactcgcagcccatcacaactactcatactaggagcaatggccactaggaggactgaaacgaagacttctatacaacaggtaagaaaatacttcaacggaaagtcaatccctgccaaccgtaatgacttacttcttccgtgagcttcttcatgttcggtcggtagaaaaaggcttaagagctaaatagagaaagtaagtttgaagtctggcttgggctaggtaaagtagtcaaagtagcttgcttgggtttaagaagtagttgaccaatctttctagctccattgcgaaaccacgcccaaaaagcaagatgcgaaccaagaacattcacaatttgatcccatctttcttcacttgcttccttcctttctactaaactgaattttaccctatttcagtaccacttgataagcccggatctgtctgaccaataggagtgaaaggtatcaagagatgtcgtattaaattcgaaaaggcattcgaatctagccaaactaagttcgaaatcggagtacgtgcccagcccggatgaaggaagaagcaaacagggggattagtcacatcaattatcattcatgccttgctcaactagatcttgattgcctgtttcattgataccttgaggaagtacaggaatgcaagcaagcgaggccagaacaaggagagtcaagaaaacagtagccgtttactcacaagctaacacgaagcacgaaacacatggattctctgagaaccggactgacccaaccaagcaatcacttgagccattcacaatccatgataggagaacttctttcactttatatgattaaacaagtgagtcttccgattccgtaccctctggtgaagctgcatttacgcgagtcggagtatgctattccaagaacaatcacaaaagccgtgcttgtttatggggaaaagaaggataccgatgattgttcaccactgccgcctactccttcttgtctgtcaatcaagaattgacatagataaagagttgatagttgatgtgagtgatgcacaggggaaagcgctactatgctccattaatttcgtatgagttagttattggctggcagcctgtgctacaatgctcttgctagtgtgcttcagcgttgctatccatcttgtacaagggtatgaagcccgaccagaaggcacgggtgaatggagttgagtttggaggtctcctgaaaattgggtcgcacaactctacctgctggtttgagcacttttctcatgaataattatgatgcaactacttcagaacttgttctccctggtagaggacgtattgctgtgagcgccgacagtgttcatagggtgtttggtctaccgaatggtggtgatcctgtcccttatgagtttgattccactgcggatgcctttattgattctccgtacggacttacgggaaagcaggtaccaaccatacagggagccaactaaccacctattgtaccccatagaggcagcctaattaccacatttttgagagaagaaagaactgttgactgccgaacatatctatttgcattttgataccatcttccaccggctgcatcttgatctcttagacgtctatcttactcttgatttctgagtgcctatctcgattcttaaacaacctctcccgtccggtcgagtcaagcagcaggagcgagcccacaagagcttttactgtaccagttccgaatatgagaaggggctcgcggattttaacaggttaggcttaatctacccaattggaaatctcttgcagtagcttttactagaaatccatttcttccacaaagctcctgtgacctaaccatctagatagaagcctcgcagtttgcaaagaaatcaagcttctggcttcaagttcacaagtatgaaaagacctgagaggaaagagctgcgtagagagctccggattctttagcaactaggagagcgacagagcttcttttttgaaaaggctaaatccctttcttcaatcccaccttagttcgatggaatgcaactagatgaaattactacctttcttcattcaaggactaaatagcggttcatatggctttctttaggttgaccggaagggctctattgaacaaaagcacaaaaaaaggtcttattatttattcaaagaactgaacaatattgtttgaatccacctagttcttgcttactatctgaattaactgatgggacatctttcttggtcgtagtaaacctttgaaaaggtcctatccaaattttacattataaaaaaccctgtgctcataaaaagttatgtaaacccacatacatatacataatagtaaaggaataaaaaaaggataaaaggtactgtacgtaggcgctgctctattgccaagggtaaagagctcttttatatatagcgaagaccttccattttctacgtgaaagcgtaatctgtttcccgaaaagcggaagggtaaagaaaggcaggagctgcagaccatggtggtcaaccaagagtcgcaggagatttttatggccaataagctggaggcatgatcaaatcgataccaacattcaagagctgataagggtaaaaaagagaaacgaagactgtaagtcaaatgaccatcagtcttcgtttctcttagactgagtgtctctacctggggtgggtttaaccccctctaggaaaactagagccgagaccggttgctatctattctttcatgacgtgaatatgtgatagtatactttataccctaaatctggaatctaatctttcatgacgtgaatatgtgtggtgttagtggactgacagagtgagctctaaagctagaaaaaaaagatccatctgcgagtggttcgactttttcctaagcaaggacggagccgtcgagtgaggattggctgagcgtgctttcgctgctcgtggtggagtactctcagaattattcgctctattattgcctcaggatgtgatcgggattaagccgcgtgtcgatacccggggggggccggactcaagggattcattctttttcgcactaatggaggacatgaattctgggcaaattatctatgttacagtctattaaaaaaaggacttctaataagaaattcttctgctaaagaataggctcgcctataaatagaagcttcggcgcactctatattttgcgggacaagaaagaaagagtcaaagccatggatatcgctgcaagactatcagcgattcctcaagaaatcgctgatatagaaaacactaagctcgaactagagcaaatgctgggtgtcctcggggagcctttatttctggctttcgtcgatccagcagtgatcatacaagatgatatagttcttgttcagaaccaaatccgcattcttgaaaacaggaagaaggcgctgctggaagaacagcaatcgctcatcgtgatggctgcccaccacggtgactaaaatagaaaaaggtagttactcgtctatctcaacgtaaatgaacgaagtcacttaaggcttcctactactactgctccttcttacttattttcgttttttcaggatctaaagaagaagaggttttcttagcgggcgtgaatccggtagcttctacttctgttctgttgtctcacttatgaggagctggtacttcctgatcaagagtgtagtgagcataagtattgtcttgttcagtattttcttttcaggtgtggtgtgtagagatatctcatgtattgcctttatgaataatacttatgtattgcctcttcttcttgttgtagaaaaatactgatgtattgcaaagacctgttgttgttttatttctttatgtcccaaaatgacaaagacttgaaggtagtcagaaacaaagaactactaaaatgttggtagattttatagagcgtatagccaaactgggatctactcacaagggcgtgaaaacagtttacttttcgaatttctcacgattcgatctcttaatgaagtttttagccagtcatatggtcgagtacaccatcaaaccgctgatgaggaacaagaagctttaccagttagaaattttgaggaaaaaagggggaataagaaattggtgttccatctacgagattcatacactctactccctaatagtatagaaacattggctaagactttatgtccgcacttaggttcaaaaggctcaatagcacatgacgaagttcaagtgtcttctcttcaggagaatagagcccaattgttggattatatggagctggatatcagtcttttaggtgatgtgatgcttcgggctaaatcaatttattggactagatacaatgtggatatcggggtatgtttgacattgtcatcgctagctataaaaatatatcgaatgaagtattacgatcaaaatggggcctatctatattccaagtagtaaccaggatgcattcattcggcgtggttactatggaggccatgctgatacgtacaagccatatggtgataatctgtattattatgacgtcaactctttatatccctttgctatagaaaacatttcacaggctccaatccatttgtgatctttacaacagatatcgcaagcaagtaaaccggtggtcaaggcatttgggctgtggggatctgtcaaggctctctgagtacctgatggggatcgtcatcttcgtcccggtggcggtgctggcatggttcccatttgtctcggagttccagacgagattgctattcaatcaggccttcagccgagggcttcaaagctgttagagaatgcgctcttatcactacagggacgcgagagaaattcctcgaagggagtattaaagggatgcggcattccctcaaatagcagttttttttgtctaaagaaaagttgcctattaataagcagtcttccctctttcataaggctctaacttgcgtaaggaatcaaggagctacagttgtttcccgccccttttgtatttttctgaacacaagttcaccgcatcgcgcctcgtgcaccttcaatttcaccattggacccttctcaaatgccatctacatttatccccaatcctccttcatgattcgtctcctcaaccatctgtaggcagtcgatcgcctttacttgccttcgattcttctggaccgccggacaggtcagtcaacccttgagctgtactgaggggttggactggaaagcatactttatgtgattcctccttccccattgtcctctcctacccgcctttcccacatccatcaaagggatgctcgcttgtcaagctatgtgctttctttcctttcaaaactctatgtattcatttgctttcttaccaggcctacccaggaaaggggtatagatagaaggagggatcctccgaccataggtctattgaatcgaaaaaacactattttttatccagcagctgcttttattttctctacgaagagagtggctagctagcttctttgccaacttcgagtgactgtgactactcttactggccgtaactcacagaagaggcaggaagactttttactcaaaattgataagcgatcaaaccctttgttgtaaccttctcttgcacccttaggttctttttccaataatgctaaaaaccagtgaaattcacctcttcttgttgtttggttaaggatcgagtgtggactttcgtctttatcaacctgcggctaaggagaatcaagcaccatttagtggtttgttcttagaccgactcaagcgattgagagtaagaacaagaagctacgtacggctataaataaagataaaatcagtcttgggaaggaaatctcaggtttggccatgcccatttatgagcaataaatataagaaagagcatggagtgcatccaagggtgctacaaggctacaacacttcatcgccaccaccagagttcaaaaacaaagctggggaatgccattgattcagttcagtatcatggtttctttttttattgtattgaaaccattgaacagaaaatgggtagaaggattgcgggaagacagtgaaattcctattggcaggttggggccgggcaagatcgcagtttcctgatggattgccaaccacttaacgagaagtcccatgacgaagaatcacatttcactgtagagtgagtaagcgctgctatgaaggcagcaccggagggatgagataaagaggaaatagtgtatggtttgagtacaattaattcgtttcttacgcgtgttcctgtgtctgaatgacgcagtaaagccacacgaagtggctcgctattgcaagccgtagtcactaacaacaccgatttggagaggttgaccttccttggtaaaagagcttcattagtacctttaataatagcaatggcagcggcttcggatctaggaaaatgagggggggcatcatccgcatagagaagacatggcttaatgccctggagaggtgatctcagcagtcccgctgtgctaattctttcaagatcggattcaggtaaagtaagaaatccatcacaagaatgagcaagtacggggaaagcaggtcttccagccgtagacctcttactcttcttctggcttattaacttgtctttccgctttgtcactctcgtattctgaataggaatcggcaagcaggtacaaccaccctcgaaaaatcgaacttccctccttaccttacttaccttagtgtcttttacctaacctactcgctcgccgagctttttttatcttggttattggctttttgactcaagttagagcttttctttcctggctttttcactcgagttgtttaattgttcgcttggctttagctcatttttttgtccatttcttctctttacagatcccctcgaagtaggaagaagaatggcaatgaaaaataatagcaatagtcgtctcgtaggtgcaggtgctggtgaaagaatagcttatggggctggagtcaaaggagctttcatagacatagaaatcataatagaaagagcaggcctgcgagcagcgagtgccctttgtaagttgcgagcctgtcaaaccataggcgccttaccgccccccctttcttttttgaattagaaagaaggggacggggggatgaaagacaaagaaagagatcaggttatttatgatcggagaaaaggaaggggcgtggttgatgtgtcactggggaacccgtaggaaggggagacgcccggcctcattcacatctgaaatcgccaacatgaacacaaacgaaatcgtcgaatttcgtatagaaagaaaaggaaccacttctattctcttttcttaggtatatgaagaattgctttttggtccctttcgtccagtggttaggacatcgtcttttcatgtcgaagacacgggttcgattcccgtaagggataggtacttattcccggccggcggtatcattgctgagtgatcgctcgctatctggcttgaaaaggtggtccgggagctttcggagaaggccgaaaatacatttatcctttgaattactctggcattccatgtttatcatgttttctgcaccgagagaaaaaatcaatatgtccatagatttagatgatttgattaattgtttgcacaaagagtacacgtttaagtattcaaaaattgtgcataaaatcaagcaagaaaacggatgcgcgtgctaacgctttcgcgctagtgcgctcaatccgttgcttgtttgaggaattagtcaattctattaaaaatggtaattatgaaatgaaaaaaatagacgacttggttgatttgacttttccatctcggcgggagggcccaggttatgtaacgaaagacgacattctttgttttccagtcttagaaggtgatcctacttataggcgccattttgtgattcccctcgaggatcgtattgtcattgatgcgttatcggatgttttattaataaaagcgcaaaagtttatcgatcctaaggtccatatttatggaaaaactgtgatgtctggagttggtaatgatataggtcctggtttgcggaatgaattcaattcttggaatggtgtcaactcagtagcagtcttcgatattcatgaggttctttcacgtgtggacctaaatatgcttttttgaaacctaaaaaaaagtgtaaatgcagatcctaaagtgtggaaatgttttttgagctactttgatgtagctaatgagctacggcagagtatgtccgaatatgatgcctttaacgaacctccttttcgtggattgccgctcataggttctcttccggtcgttttactaagcattttgagttctctggattcgtacgtgaaaaattttataggtgattggccctatgttcggctcaattacgagttgattttaaaaatatttggtgccatagatgaggaaccgtacctcgaattatatgatttttttaaaaaaaacgcaatccaagtcgattgggtatggctttataaccattcagggattcattctctacgcactggtttcttgcatttgcatatggaacaagtcttcttttcggaatttttataatcatagataggacgtagtcttgctcgatcaggaccctagctttattgcgagccaaaacagctgcgctattctgttctacaggtagtatgaaatttccccttcctccaccactttactagtctcggcaggttgttcttcctctaggtctctccattcccaaggaagcttgcttcttcgtgggctataagacattaacaactggctctcgagtattcctatcatcaagtttttctatttccattataaagttcgcgggtataagtcaaaaggttagctcgcttatttggctaaaccatccaaacaagaaaaagaaatacggcaccgacatttccaatggtagtcaagttcactggaataggttctttgagctatgatccaccactgtcgaatcagcagtaacgaagtaagtgaattattcatcgagaacttcctatggcattcagccttttccttcagcttagcgccctcactgctacttctctctattaagctgctctctgggtccgtccataagcatgcatactggcgctctcttattggctaggcccctatctaattagcgggttattataacaatataaaaataagataatgtttggagttcaataagctctttgcaaaagaatagttcctgctagtgaagtacctaaatagtgcaatctcttgcatcgagaatcatcctactggataaccttcttgctttgtctttcccttatcttgctagctctataccagtgcttgaaataggcatttctttcaagttcaaaaggttgaaaaaggctgtagctcaagtatgcatggaatagcacagatagcggataaagaatagtttagagaaggaaagccagtagagtatgccttggtttaagagaggaggcatctggtataaaaggcagagcaaggaggtttgaactggtaagctgataagcgagcgtcggtattggctttttgatagaggaaaagaagtatgttgaaaaggtccccggatatgcattactttggtagtaaaggaatatgcgtgagaggactatttcaaagaaagaccggcctatggtaattcttggcaaggacgtagtaccggtattagagatcaggaaagtagttgggagtatgtatgccggcaaaaaagtacccacaccttcttaggtggtaaaagatctttttatgaaaaaaatacatacattcttataggtcaatttatctcaatcgatgatattgtttctgaatagttgacctaaccaatcaaagctcccttgactagctttccagcatgcgctactactgcctacctagcagtcacctcttcctcctctattccatttctagtgcaatatctgacttcagtagaagaagagtactccccttcataatgcttccttcttcaagtctttcgctagtgaagtttgggaaagctagtagggaactgcaaccagagagagagttctagtgagtccagactctttctttcgttcatcaaagcgaagcatggctgcaatcccaaactcatccttttttcttcttatcattcgcaatgctactatggttttgatgtcttcttgtgtcgctatctgaggtttgagatcaagggaatagctaagcgtgtgggttgaagtgagtaaagatctgaagctaaggtaaataataggttgaaacagaagaatgataagaataaagtacctctctgaatagctactttcttacttgactttctgatcaatagaaaaagacttgctgtcctcaagttcaaggccttagagtgagaagggaattacgtggtacctctcttttcaataagcattctaccactaactatgtgcctggctatggtttgtcaactcttaccttttggtatgagaacggatgctggaggtaaatggatacacagctactgcctgacttctcagatttcagtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaatagcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgtt

SEQ ID NO: 624 - DNA, 23769 bp, Oryza sativa
  unsure (1)..(23769): unsure at all n locations
tatggtgtaccggttgttatgccaatagcagcgccgggcagctaagttggtatggaagaactgctgcgccgcgggaaatccttctctatacaagttctcgtacgaggtttttgaacagaacttcgataggcgagaggtgtaagcaccgcgaggtgtgaagcgatctcgtactaaacgaatggaactttccaaccttcgagaaaaggtcccatccttcaatatcatgattgggtcaaccaggccagatcataagtgaaatagtttgatctggtcgaccaggtcaggcccgatcaagcgaatttgtaaagttgtaagatgaatcgcctttttgtactatttatttcacggtttttcgggaaaatcttttttcattttcccagcgtcctagaattgcctttctgttttttccttctccttttgattttcgtatcattattattactttggtttcttaatagggggatgattcatcgtggaacccgttcccccaacgaattggattttcatttttttttatttttgtttacctataaattttgtttagagactgtttttttagatgacggagagaatgttttaccaaatccagcaggggatcaggctcaacccgcggatgcaccccttgctcctgcagtgcaagtccctgccattttgaacccaccccgggttccatcgatcccgtcatccctggatccagggagaacgccagaagatcgagtacgagagggaacagaggcagcagtcacgggctgctgctcgtcttttgtcgagtgtctctgttctacctggtgcgatagcttttagcggggcgcagatgtaggaaggcgtttcttgcctgctttctgaactgcgtccctttcactccatgtgaaggtagtaataattcttttctttaagaaagggatcgtaggtgcgtgaataataatcttggttggtggggaataggtttttgacgaataagtaaagtagttgtgattagtggtataggtcatcaagcacctgggaataggccctgcccaagcgccctcccgagatcggactcgagggagggtaagaccggaacgaggtctagcccgagtggaggccaccctcgaagggaaagcaagcactttcgaaagcaggaagtaggtatggtttcttgagttggattcatcaacccggaacaagagtggaggcgagcccggatgcagagatagatggtgtactagggattaggttaggtagctataagaggtagctggtttcgaggtaaggtcagggcgctacagaaatggcagatactacgttctcccgccttgatagatagttctgctagaaagcgctcattagaagtcgagaaaacatggtttctggctctttctttgtcgtaaggtctagagttggacaaccatcatagcactcgcttaaacagatctctactgccttagcaattgaaagcaggagaggtagttgcgttgcccttaatgtagcagtcaaaacaagaatcccttatcaagcaaacccggcactccttaactaactactgttcagttgaaagtaggtggatcaatagaaagcctcttcaaccctcgtcatcaagagcaatctgatctcgctttgattcatcaacaataggatgaccgataagatatggttactggtctagtcagctcattttactttcggagggcttgtcttttttcttagacttaagggagcaagctagaatcctgcttttcccaaagagagtgggatgcgtctaccaacttgtcctctcaattgaatgttaccaacttgtccattaatagtaaggaacccagggatatcgggacgggaacttatcgataccgatacactcaaagtcttgatttgtctaataacggatattgaacggtattcagcgagggctgctgtcatttcatttctatcacgtaatgcaagagagccagcagtatccaagtcggcagggcgttgaataagcactactctcctaatttcttattttaacccatccacaaaacaaaagtagtagtgaatatttcaggatcaatgttgaggttgtgtgctagcatttggtgcattagggtcttgaaattctcaatgtagtcctgaaccgatccagtctgcttcacatgagttaagcgccggatcagtgcctgatactgcatcttttaccaaacctaagacacacaaagtcacagaactcatcccaattcatactctctaccttattttctacagattgtaaccacattttagcttgacccgtgaaatacatggtggagtaatctttccaagtagtgtaaggagtgtggaacataagaaaatatttatcgcaattcttcttccaccatcaaagataggaaaatctggcctattgggtgccgatccactcgatcctatgctatgcatttgtgaccaaggcgaggtaagatcatgaatacaagatggcgatgagtcatgccaagtttggggagtgttgctcgtaccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctcctaaaatcacttctaacaggcgagcgtgacttgtgcgctttttcgttaaatcgagcaaatggatgtgtttttccagccactgagtatctagggtcattccctttaccaaacattggagtcgctgctcgctcgaaagcttttgctttcttcggtactggtacttcggaatccggtgccaagctttctgatctctctccgtgaggagaaaattcctaggattgatgctcgattagatagttgatttgattttctattactagagcttggcagtgaagacagtgcagcagattttcgcactaccggaatgggtccttatgattctcaaagaatgatgaggggcaaggctgatacctcgcaggtgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagagcgttctatttctagggtcggccgtaaaagacggatttgtttataactgacccatttataatataccaccaaactagtcactcatgggaggcttcacttgtgaactacaattcccgtactacgtagtatgattggttgctcaactgccccttaaacgaagaagacccctgggccgccttgcgaaatacttactgctcaaaagcgaagaaattaaaatgctttacctctctcttccgatgaatccacttcacataaacataataagtgttttggcatgccagcaagcggttgagactttcgttattccaaatttacgaagggaaggttccgaggtatcggaatgtggtaagccagctccacctagggacatcgccggacggtaggcatcggttgctctaaaacttctcacctggttttcctattgtcaactttccttacgcaagcggtcagtaaagaaaagccgagtcgagtacaagaaaaactaatagcttcctttcgttatctgcatctgctttcctcaaaaggtctagctttgccaaaatcaatagtttagttggttgggtcctgtcgatcaagttataggagctgcttgctatctatcaaagggtagaaaaataccacgtttgcattgaaggaatgtcgcaggaagctgccgatccgcgatttcaagtagttcgtgcttcggcggcaggggactataggccatgaaaacccaccccaggtatctccacctgtggattgagagtaaaaaccagtgaatttcgtatctcccgctggcacacgatttctattacttttcttgtttcccgtttcggagatccgataaaggaatggtaaatcgatatctgggctcgagccagggtacttatcctcccgtctataaatcaatgaccaataaaagaccaaaggggtgataaatcaaggggcggacaggagcagcatcgtagctaggagcaggtgtagcaccgtagctagtaggaagaagtccagcatagctacattccccttcgggttggcgcccgtcttctccaatagaaatttcatcatatcaagggctaagctatctgaaaacctactaccaatctgaatgtaaaagaagaactaaatactactatccatgagatcatcataacaaaaactagaattgcccagctaaataggaatagaaataaatccagggtaacttgtatcatgagatgggtcaattccaatttgaattccgtacggctacaactctttttaaacgagtcgaagtccagtcttgtcactttccccctttcttatcctcttttttatccaacctcttttatgtattcttggctatcagaaaatccttagaataaaagtttgtcagaagaagaaaaaaaggagctcaattggcattcattcaaataaagtttcacaaacaggaggccttgctttcgcacggggagagagatagcgatgggcggctgctgtcttgtcaccgtgttcctgtataccgataagatgatgaatggtgatgcaggacagtcgaacttatcctttattcgtattgtcagctataaacttgttatcagatctataagggacacaatcctgtggtgaaagccgccatcaacattcgcgtagagaggtgcttcccaaaaagggaggggaaaacgagatgattgctttgcccagtaaactatgcttgctctgatgacctggcctttctcccgttaaaaggtgggtacctttccctaaatccttctcccgtgcatgctattctcctgttcccccgaagggcggtatcaatacggcaacccgaaagctcgttatcaaagtggtctcttctcaaaagcttatctgccagatgaaaacaagttcgtagtaacaaggggcaaaacaagcaggttggataagggtgccagtgaagaaatcaagagaatatgctttggagtattcatagaaagaagtcttcctataagataatcatctttcctttgttttgacattcttgatgtattttccactgtatggacatccttctatctttgtatcggtagcctcttcaaagtattgctttaaagttcctcatgaagacagagaaccagctgactactataactccccatctcatccctgctgctgatccgtggtaccatttctctatggggaagtgttgattgattaatgatcagaaataaaaagaatgcagagaataggatccacggctatgagagaaagcaaactatactagcttcctgctgccgattagttgaagggaaagttaaaaatagtcttaagaattatagagcacgacagcattcaaatgaatgttcttaaaaaacaatatttttatttatcatattttgactagaacttcagttctttcacttcgacacgtcttccaactgatgataagtcaactcaacaacatttccagcttagctgccctttcacttgcttctgccttttcactagaattaagatagtgtcctcccagaattgagaaagaagagagaatacctatgtgctgctatgcctatggtccagaattgctatccgtacgaccttggtctttgattgtaaaaaaaatacatactaagcaagtaagcctgcctaaaagcatttctttttgacacctctctcgatttgaagagattacacatcactgcgaacttattcactcttcgaagcccccaccaccttctttctttgagctgagcactttacttcggctgtggtcattgcctaccggtaaactcccatacttccttcttttgttcgagggaggccatacatcttccttctttggttggatccaggtcagaaagttatagggtgtgcgcaaacaagtctgaattaataagaaggggcagtacactacccatttgggaattggcaaatcacagtcatacttcttagagtggggtggagcaccagcaccttaagctgcaccagtatcttagtaagatagacaccgattaagaaaccgagaagtctagattatggggactctataagtttttctcagatttcctgtgtctgtactactgaactttctaccctgcatattgtatgtatccttcgcccttattttctgttctgagaatccgccttcacccttcggagaaaacatggtggccggagacaaggtatgtagattaatagagttgctcttacttttataatatatcattgatcaaaacttggttcccatggatgaagtgtttgagtagacaaaagaagaagaagctgtagaacaacactagaatgattccaaccgacatacccacacacaaacagactaagactttgtagccccattctgttgagaaggtgcaatctatataccaagttgtctttgaggtacctcaagcacaacctcctaaaagaccatgtgaccatcagatttacctcacgatagtcaacctgtgaatcaaaggctttataggtattcacaccaccggttgaaatttatgccataatcaaggagtgcccagaatggtactctacaacctagttcatgcctcaccggctcttcatgtaaagtctctagtgggtgcgagcggctcccgcaccgggtcgggtctgtagtctgtcgttttgaccaaaagatgaagtttggttaagtcctccaaatgagtccattcgcctcgttcacataggtcctttccacgagggccaaagtgaacccaaagtcttgtgtaggcttttttgtttatatccaatccatgtggccaaaacaagatatttagcagggatacagacgacgcgattcctgctttcatagtttgatcaggtagctgaagtcgtggtgctgatcgcgtggtttgcctcttctctcgcggccgtgtgttggtcagcgtggtatggagtagcggttcctcggtagtctgactgtttcgatgcagcatctctatctttcggtacatcccgggcaggccttttctaaaaagtcttgtgctcaggtgcccaccaagatttctgacatcttagcctcctagttttaaattctcgaatcgaatcaattaagaatcaattcaaattaataaaagaataaggaaacgctatctcatccctattggtagcggtttgggccactactgccaaaacaaaccctagtttgaggaaagaactgtgggttctcaaaatcaagtatcgccgggcctagttattctcttgccccaacttatgcggggtacgaatttttcgagttggatcagtactataagcctaagtattttattgatcaggcggcacccagatttgaactggggataaaggatttgcagtcccctgccttaccgcttggccatgccgccaaatccgatctaaaatcgagaaaaatcttattcatccacattattttactaattattgttcgtaggaggggattactaaaccctttttttttcgtcgaatccctttgtacttatccctttccaatccctttgaagaaattcattccggtttttttattggacccagttttattctcttcgattgattgtatctcaaaacacacactgcttaaataccttctctttctattgaaaagagaaagggtttccagtcacagactgaaaaatttaggacaaattggaaccattaactatattaattaactatattatttgttattttgatattttctatttgttagtagtgaacggttctaaaatgggtattgtatccctttttcctcgatcgtcaacgagcaagaaaacggatgcgcgtgctaacgctttcgcgctagtgcgctcaatccggtgcttgtttggatgtaagagatctcgtttgctggccgggcccttccatgagtttagatctctatgtatgaatctcttattcaatcccatactttttctcatttcagaacgatcagcatactgtgtgacttctgcgtgacagttcttgcatttcgtttgttgctttgcatgaacatttagatattggaaagcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacctgttctgccggagctaatcatgcaaagctagcgtagcgccagccgtcgaagtgaatgaattcgaaagaacgaagaagtaaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatccctctgttgtttccctttcctcccgaacctttttctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatggatcggttaaacattctattagggagcccggtcttgactcttctgtgtggtattcattctggttcggctcttggaatcacatccagcagtggttggaacagctcgcaaaatccaaccacttcacctactttattgcccccaaccgtttcccgtacctctatagaaacagaagggtttcatgttctttcatcgattgggtattcctctccttttgtatctctttatccaatttcggtctcgattagttcacaagattgaatggccaagtcatggaaaagccgttattcgattgttttaaaagaatgttgagccgggcccgggtatgtaagttcagcgatgtacaaacaaggattgatttgacttcccgcacctaggttgggggttctattttggaagaggaatagaatctcattcatgtgttcatgctaacagaagagcggatccaatacacataagactcttttctcttgaaattccgaatgtaaatgattcaaagaaagggtggactgcagcaatagcaagagatcagcgaacgaagcggagaatgatcacaattaggtcgatcctaccatagccgagtctacatccaagacctgacacgatgaaaaataagattctttctaaaagagctaagaaaaggagtacgaggactagctcaacgtatacccgcacgaaagacttgaaagagctcacgcgtattatgcctaccttggctactggtgaagatggagtcgtaaattgacttaaccaaagccatacctgattgcctacgaaggtcttaagtctccgcacgcccaacacctacccctacctgtatccttaacaaggtcgggatatccacgcataatactatctaaaaaaagattaatgatttggatggcaaggcggatgtactagtaaagatatatctttccttcttttccatcttaaaaataagacttctggcgaaaagagtggagttgagtacccttgcttaataactagttgcaggcatggcttattaggtttctgaaaaaaattgagagctctttatatataaccaaagaaaatagaaaaaagcataaaacatttatagaaaaaagtaaaaaaatcaaacattgacgacccagacgaaacaattagtgaaatcgttctatttcctccatatccccaaacatatgcctattcccgcacatgttcttactcgcatattggacttacgaagggtaagccttattcccagctatttaactaataaaaaactcttcacaatgcttaacgcccatatgttcattctttctttgcttctcatgtttccatgctcctttctggtggcaggaggcaaagaagagacataatggagataatgatggttcaaatccaaccattccttgggcgtggttcgagcgagaattcaatgatcagtatttagatgtgatgtctcgggaagcgcttcgacagcaattcgttagcctaaaacaagggagtggtactgttcaggactacaatatgaaatgcgacaacttgatgaggtatgctcccgacattgtggcagatgacttccgcttgcgacggcaatatctggaagggcttcatcccagattgacacaaataatcgaccttcctggtacagtgagactagtggatctgatggcacatgcgctacgagtggagtcatatgagcctagcaagggtcagcaaagctttgttctcaatgtaaagccacgagttgatggatcatcaatcaaggccaagtcagtcaatgaattccccgccatccgcaaatccagctaagccaaattctggcgttgtgaattacgagaaggtttggtgtcgatattgtcaagggagacatcatgagtcaacttgctacaggaagaatggcacttgttacaattgtggtgggctcggtcatttcgctagggggtgtcccaagccaaattcaaaactcatgcttgggaccgagcatcaaaccgatgacacagggagtagtggcgagaggtggcggtacacaacagccgagaggccgtggaggtcccatctcccagcgggacgtgagatttggaggcagaggaggtagttttaatgctgcaatggtgtgattcctttgaaataggtagtcaagacctagtaagtcctcaaattgaaacacttcttcaatcttacacggatttattccaagaaccaactcaactacctcccaagagaagtttggatcattcgatcccccgaaggtactgaacccattaacttgcgcccctacagatattcacacccccaaaaatcagaaatagagaatatatgtgaagaactgttgagaaattcgataattcaacccagctatagtccttttgcagctcctgcactttaggtaaaaaagaaggacaattcatggcgcatgtgcattaattatagggaactaaatgccgcaaccataaagaacaagtatcccatacctataaatgaagatttattagatgaggggcgaaaatattctcgagaatttatttgaaggtccccggatgaaagaaagtgatgtgcataaaaccgctttcaggactcaccgtggtcattttgagttcaaggtgatgcggaatgacaaatgcacccgcaacttttctgaatttgatgaatgaaatattcaaggagaagttgagaaaaggggtattagtcttctttgacgatatcctagtatacagtgacgggatggagactcatttgaaataacttgaagaagtgtttaagctgctcaagaaaaacaaacctaaactgagcaagtgctctttcgggatgggacaaatagaataccttggttacatcatttctgaaaagggagtagcaactgatccaagcaaaattgaagctatggttcagtggccagtgcctaaaaatgtcaaggagctaagaggatttttgggtttgactggttactataggcggtttgtgcaaggatatggtggcatttgcagacctctcaccgaattgctcaagaaaggaggttttgaatggaatgcagaagctcaaaaggcctttgagcaactcaagagagcaatggtatcagctccagttttggaattacccgatttctctaaaccattcactatagaggctgatgcatctgatttgggaattggagctgtgttatctcaagataaaaagacaattgcatatttaagctaagcattaggagttataagtttggggttatcggcctatgagaaggaactgaactaatggcaattttgatggcagtgtctgtctaaatggaggcattaccttcagctgaaaccatttcttataaagacagaccaccaaagtttaaaatacttgcttgagcaaagattaactcaaccactccaattcaaaaccctaaccaaattcattggactcgatttttagattgaatacaaaaagggaacttctaataaggtaacagatgccttatctagaagggtaagagccagagaagtagagttgaatgctgagattttttgcattatcatcacaaagaactggatttttattatttcatatcttcaaggcaaatcgacccaatccagtggctgatgaagttaagttttgaaccttttttttctaatatccgttgaaaatttgtgtgtttctgcttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgacttttgactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtggatttaaaaaaccccgcgaattaacttgggtcactggtgtggttttagctgtattgactgcatcgtttggtgtaactggttattctttaccttgggatcaaattggttattgggcagtaaaaattgtgacaggtgtacctgacgcgattccggtaataggattacctttagtggagttattacgtggaagtgctagtgtgggtcaatccactttgactcgtttttttagtttacatacctttgtacttcctctgcttactgccgtatttatgttaatgccctttctatgaagcaatggtaccaatatgcaaatccacttttttaaggatctagagctggagggtcgacctcttttggataagatagcatagggcatgccccgcccactcttaagactaggtacccgtagactagtttttactactcaaagaacttccctatgcaatggtgctttctagttcttatctgcacctacatttaggattaaccctattcttgataatgggaatcacgaacatatcataccaagcccgccaagcgggagaaggggcgaagcgagaactcaggaatgaatgaaccaagaagggttcaagacaaaagaattctactcagaatgttgatcttctgaccacgaaactgagcaagaagtccatccgatagtgggggagatcaaaaagtacttttttatgggcagaggtatagctatcaagtagaagtctttcgctgtgactagggatagacaggagatgatccctcggttcgtctgagccggaccggagtcgaatacttcggatcctgcatctgcttcagttgattaggtgcaaatgtgccttttggaccgatcctacgaataagaggcattaacaaagcatttatgagacaccatactttcaataggcaagggccagcccgaagatcagcgggatctttctccaagctaagtttcgacccccgagggaaccggccacgatgcgtgggggtatcggtgctgataaacttgtctccgctcgctcccctgctcgttcaaagtattccactcgctaggatcttagtaaataagcttgctctgaccttcctagctttgagagcaatactacctgtaataacacaatgaacttatcctacttagggaacagactggcatcaaggagtccaaagcatcggtatggctcgagtgaaaaaagagaaagactattgtcgtccgtcatttcacgccctattgacattatgactaagaatagggttgcccattcctgccatggtccatgggatcttcgagttgcgagttagcttagagttagtttaagaatcacaggggaaggcaaaggtagataatctggttccacctctttactagagagccataagcaagatttctataactgaccgttaagataacaggcataaccagaagtatagaaccttccttttacaagaaggagggacttgtgattggttttctacagggaagagagataaaggcaggcgacaagaaggcggtcacttgctgtgagtaaataggggccaatggctcttccttaaggacgaggttgaatctccaatcctaagaagacctattacttgcagcagctcctagtactaccgggaggggccgggataccgaacttaggtgggaacttttgctattgttcagtgaagattttctatttatttgatgagtctaggaacctatagtatagatagtttctttttttagtgataagtccgtgtcattctttctttttcttaagaagaacatcgaatcagagtctttctctttgtaagctactggttcaaccaaagctagtctttccgaagccttcgttcttataattttgagatagccaaccttattttttttcgtggataagctgctctttcgaaaagagctctaacatcagcagctgggtcccaaactcataacacataacatagcagatttctttgatttctagtgccccaatgcgccgccataagggaggaaagaaagctcaagcatcataagccgcccaacccccttcccctttacagcactcctttcgcgccttgtagctctccttggagaaggataagaagcaggagacggataaaatctatataaatagaatgaggcgagtgatttctttaagaagaaaaaaccaagtgttcagctaataaaaagtaacataggtcagcgctgatgccgatcaggtaccaaaacccagatgtaaagcaagatgtctatctacgatattactgaacctgaagaagaaaagaaaggccgtatgcacctgtagttaaagcataatcagttgcgttatacatctatctactgaacaagataaatcttcctctccaggtcgactgcatcacttcactaggtatggttgtttttggttcataatggtggtctaggagaacccgaaactagagcacacacgggatatgcatttttttttatggtttgtgattgttgcaaccacctctcggtttttttctctgttgctgatccagatatccatcttcttgcttgcaggtcggtccattgtatctccaaattgttgccttgcatgctgagctgctgggctttcagtctcaggtccgccgtgtttcctttcaatttcatgtttttactatattttttttcataaactcaacaatagtctagatgagtggtcggcgggttgagatagtgatattcgggagttaggcgatgtaggagatcaataactcgcatctctaaggttgagctacttgcatttgcccgctttcaagagtactttacttacagttctattgaaagggaaggtgataaaaaaaatagagctgattggtcaaaactctttccctttgaatcccttaattgttgatttgagtgcagtgcctgtaagggtagcttggaaaaaaagaatgaaagtgaaatcatcatacctcataggcgcacattgcttacagtaggtctcgatgtgttttataaggaaacttttttcatcataccgatttgccggtgtgatttcattgtttattctccttagttcgttggtcccaattcttgtaatgtcggattgcaactctcgaaacattggattctcgggccgtgtaggaacataaaatccccggttcggtccaagtcgctcatgggatgcgaggtataataatagcatgtagaaggcccctagttagaaaataagcaattcttccactttctctctgttgcctatcggattgtcgcctgttgatggtaggtttgttctagaggtagacgaggcattactttggctaggtggagtgtttgcgagtaccctatctatcacattgatcccctcaagatcattttgaaatagaccatttattcgtaattacattcccggaaggccttgaacaaatgtctcatttatggatacattgggagcaaaattggaaaccctagctagtatttattttggaagattaataacccagtccctttgtttttggttaagaccactagctctaaccggccttggtttgtttttcctaaaccttgttccttgtgcaaattttcaagcagattttcttgattaggaaattccggtttcaccaagctggtattaatctcaatgagagggacttgttggtcaataccgaaagaacctacttatggtggtaccaccgtttccggttcggccaaaacaacaacgatgtcattattatgaggaaacttaagacattggtgtaggctagaaggtagcacatcaacatctcatgaaacctttcctagaaggaagctctttactgataggctagcctaggctttgattcgtggtttacttcaacactgggctcttcttaaaagcaaaaccggtcgcatatgtcgttttctcgcttcactatatgataataactcctagtatggcacccaatactgaatggataagcaattggggctggtggttcccactgtagaatgtaccagcactgggtcaaagaggcctgctaggtgagagcctttcataggatgtgccgaaaagcctatcatatcaacttacttatacggaatggaatgaatttcactcccatgacttggagatgggaaggccgaccactacactacacggagagatttctataccaagtcatgagcgatagcgaagccgcctataggcgtcgaaggacgaaagtccgttagacctccaagccatagcaacctcttggggaaattacgagcaccgcgttgcaaatgcacgagatcaaagaaatctagcgaagctgtggatgaggctggctaatgggacggtcatctttcgaaccaaagtaaaaggcacttaagtttcatcagattcagacttacggtcagtgctgaaaccaatggccgaacatcccacttaagataagagcccaacccacttccttttttaggactctgttttgcaagggcatcaaaatctttagcagatcttccttctgcttgatcctttttctacaggtcgggatgtcatcaaagccagggctgctcgcctttccttttgacggcttggcttcctatcgctcctatgtagtggtcggccttaaaagtatctttggaccctaccataccatcatgcatgcctatgttatagtgcgttaagcttcgccagaagcaagcaagatgatgaagcgaagcttcgtagacaaggctcgttccgtgcttgacttacgagctcgtgtagtaaggcctccgccctatctatatctatggatactgaagtgtggccggtacttgaatttttcgaaacaactttttgttgttcttcttctgagaagcctctattaacaatcagtggtaaaggcattgtattgagaagcgagcccgatgagcctagctctaacttcgggtggattgaggaatagtgctatagataagcattaggtttaggtcgcccataactgaacatagcactatcactatctgaaggatcggaaaatggaccgcccaattgaaatgataattctcgtttctcgtatagaaagagaaaacaattagggctctaactgagctatttcttgtgacacaatcgatctgaagaacaatatgcgcagagcgcagccttgcttcttcatgaggtattacaaggatgactaccacctggaatcactcaatcagcttacttgacgataggaagtgatggcaggcaggatacatcacaaagtagcgtagcagggaaagaactgaacagaagagatccgctgcctactatacaagacaagtttcccgttccggtttcggcttgagggaagtgcatgaaatcgattcaatggaataaaaacaacaggagctattcaaccatcgttagaggcaaaccttagaagaatgctggaagaagaggaaagctgattgataacacttaaccaaacatcgcaaggacaggaaggagtatcctgaacgtaaggccaatggctagcatacttcgctgaacactcaacttgatctatatcgatagacacatctgagagaatcatagttccccctctggggataactagttcttctcccgagtccttgttttgtatgagataacagcagtctttgcttaaccgagcatcgtagggcttacttcatcacacatagctgtctttactttcgtttcgctaaccgcccaaaagcaggtgcgcacacacaaatgctaggcgagatacgtagttctctcaacccttcctatccatcattacagaccggaactagatcggattaggtagagcaagaccttgagcctcttgagaaaccaatagaaacgacagtagctagcttcaccagaagaggaagaaagacttctataacttcacttccctattgagtagaatgcatggcaagtttccactgctttaggctactctactaagactcgagggccgacttcacgtaactaaatggcttaactaaactaaaaaggaactaaactgggagaaatcagaactaaaggcgtactgtactttgcttaacactcactatattcagcaaaagctggatgcgtattatattatatcttgtcgggcccttcttctttcttctttgaattccgatcgtcatccaacataccagtaacatgtgatgatgcacccgaatctactgctctgtgaagagttggaaaggaaatagggcggtgggtaaggcctatttcagaattttgttgatccccattttctacttctcttatttacgatcagctcatttcttaatttcattatacatctttctttgacggaatgcagcatttgctccaatgactccctctgttcatcattttgtaagtggaacgtgatgggattgtcctcctgtatgggtgggacatgttggtcgtccccggggacaatctctacctccggctccgggtcagggagcggggcgttcaaatctagatccaaaatctctctactcggtggagcttcgtccacgggcggaagattttgatccaaaaataagagttcgccagcagaaagtgcaacaccacttgtataaagaaaaaaatgaaggaaagtgacaaagtcctcacattcacggaagtaatggtaaggaaaattccttacttttccatttctttggaaagctcctactaagattagaaattccccaataaagctgctagtgccgggtaaactcatattggctaaagtgaaaaagaagaagattatttcgacttctacagcagacagcacccatctccatagtggagaggcagatgaggaccctgaaaaagttgttgcggcaactccaacgagaaagaataagcacaaaaaagtagtaagagatcgtttggggacgagcctcctactcctagaatgtattttccgacgagtttagatatactcttggagagacaataacatgatcacttttggacacaattatgtgtacttctgctctccttggattagagagactgatcccaactggccttggccaggaaaaacgaagaactttttatgcgatctacaaacgaatgagatcagaaagataggcggacgacttgaccataaggtcggatgtttccgtgagcagtaagctgcggatctccccttttttgggggaaagctggtggcccttttggcgtgttaattctttcgacggggcggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggacctggagaacgtgtgacactgggtcggggtttggtgaaccaacaggtcgctcctttagttgaagtatcgggcccctttttcgttgcctaggttacaccttcggaataccccagacggggattgagctctattccccccaatcttcactttacgccacgccgactctccgtcgtggaattagaccaagggtcgaagacccataccataggaccccgtcccccgtatcttatctttcgcgcgtaggagatcgagacacagccttagggctatggggaaagtagatcgattgccctagaattacaactacatagagggtctctacaagtctataaagaagtttaaaaaaattgatcggtagtagtccggtcgcacccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcagaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttcagaactggttaggaatgggcgccactatcccagcccggatccagccaggttctattgatcatgtccccttcccaacagttgtaccttgtcttggggtctttggctttactatcaccggaaaaataaaagtctttctcttcccgtcccgggtcatagtgaggcgaaggtgcgtccacagaagaggaaatcgcaatgcatcttgctcagcaggcgtagcttggagtgggagtgttgcgggagtaaggtaaggaaagtgtggcctaagagaggaaccaaccagggccttttgagcgctgctaagctaatatgcgccagagaaagaaaaggaggtaactattcggtccggagcattgattccccctaacgaataggctaactctatctctcaattgcctatcctgtactcgagaaggtcccccagttcctcggctgcaccttgaagtgcatttagttgtctaactttagactcgggatattccccactccatggcatctttcgcttatccattcagcccgcccgcccagacgcggcgccctttcgcattatcatctaccgccctttctttcctcccgtcccttcacgcatgaagatcgtcgtatgtatgttcgacttcggttgccggtgcaatagaattggcgggagtatattatggcaggatcagtcacctgggcaaaccaaccctcctccaagaagaattgtgctatgcccccccgatatccctatagagcgaaagagctgcctggtgatccctaggttgcagcacgtccggtcgttaactcctcgctagctgccgccgtttttaggaccgaccgacgcctcacctgcatgcacaggtacctacgtagtgtagtgtcggtcgcacattcataatagcgttcggactcatgtgccttcctgaaccaggggagttcccttgctcctgctgcgtacgattagccagccttgcggcggcaaaaggattaggacgtccccccatgctaaggttccctgcggtccggccgcattaggttagggagctgggcgataatagctcctccgcaccccaagcgcgctgccctcctaggcgcgcaacactaagtaatccaagccaacccacattactaactaacggtggataatcatctttcttagaggtactaaatacaactccatgaatgagcaaaatgaaggttgcgttaatgataaagatctctggggaaaccgctaaaaaaagattgaacatgtggttccgagtttcgataacttcttcagctttcattttcaatactgatcgtgaaacaccatgagcagcaggatgttgaggtccggaattcgaagtgaaattcttgatttgcccgttcctagtcgtcatgggaaagaaataagaaagatattattattccttttctcttcagctatgtcgaagatatttacttatttgccgctccttggctgtcaaaccttccaattcgaatttaaaattccaccccctctctcgaactgagctattccgatgataaatcactaggacgacataagacagacacataacctacgtaccacaatttctccttaggcgcatgtctcgggcagatctggagcgactggattgaacagaaagtactctcacactatagaaaaagtcaagtccactaaaagtacatgcactcttttcttacacttatagagtttcgaagaaaagtactctcacactataggtagatggctaacatcccgggctacgctatctacgactactgccacagattgaatgaattgtgactgagctcgaagagagagtttattgctttacccgcgagacagtttgaacctcgataagtcagtgtagtttaggcggtgactcacatctgatatgagagataatatatatgcaattcgttcgaacttgcttagtagtgaattgggaacaagaagaaaaagagggggccatggaatacactattgtagtagctgaaatggcggattcccctgctacattacaatacctcgctccttatacggccctggctgagtattttatgtaccggcatactttaataatttatgatgatctctccaaacaggcacaagcttatcgccaaatgtcccttctattaagaagaccccccggctgcgaagcttacccaggggatgttttttatttgcattcacgccttttagaaagagccgctaaatttaattctcttttaggggaagaaagtatgaccgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatctaaattggaattagctcaattcgcagagttacaagcctttgcacaattcgcctctgctctcgataaaacaagtcagaatcaattggcaaggggtcgacgattacgagaattgcttaaacaatcccaatcaaaccctctcccagtggaagagcagatagctactatttataccggaacgagaggatatcttgattccttagaaattggacaggtaaagaaatttctggatgagttacgtaaacacctaaaagataccaaacctcaattccaagaaattctatcttctagcaagacattcaccgaggaagcggaaatccttttgaaggaagctattcaggaacagctcgaacggttttcccttcaggaacaaacaacaattttgcatgtctactcttgttagtagaggagaaatcgttgagaaagatttttcatttgaatcatgcaaaaaagttttcttagtttttagtatagttatttaaagaatag

SEQ ID NO: 625 - DNA, 4474 bp, Oryza sativa
cccgcttttctttcgtattttcttctttcattttgtaaacaacctggtagcgaagctgcagcttgataattcataggggccatggtgtcaaaaccgggttacctaactagggaaaaactgttccgaagctcttccaaagcgtggcaggctgggcagcttttaccgaagcggaccccccgcccatagcaaatgtttgttgtcatatttcaatctagggggctgcggcacaacctgggtgtggagacatgaatgagtcgaaccctattcatcatgacgtaatgtcaaagaagtggctcggcgaggggctttatgctgattcaaggccgaaggacaaagctcttcctcttcgtgcttgtcctaaataatgatattcactgaggtgtgctggctctgcttcaatccgttttcttgctccatgccaatcgaagatgaaccattcaccgagccgagtatgtgcaagacaagacacggctagataagtcaaatagaagatattgcttttacacgagcaactcttaccttcatgtaggtacagcccacttttcctttgatgaaatgcgaacacaaacttcaggcatccaagaaagaagtcaagatcgaaatcgaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggctctcgcggaacgaggtgtagattgagaagaaagatgagcgtatggtccatactcactcgggttcaaacttattcttcttttttttccattcattcaaccttatatatttgatccccttctcccaggtgcgagtctattattgaggaactgcgagctccttttctagagcttccttcccatttaggcggggtgttcaaaggggttccaccgtcaacttaagttaaggaaccccaactcccaatttggcatttacttcttgtgtttacagctcaaatctctatcgtcgtcttgacatccaattccttacggcagagacctaaaaatacccattgccggctttacttttgcctgtggagacggggtgtggcataccttcccaaaagcatacgggatcctatctttgaaaaagcaaagcgtcggctagttctattctaacctgactgacttcctcaccaccaccgcttacggctatttcacgcttatttcattcgtagggccaaaagaaagagctccaacggcggctaaaagctttgaagctccttctacccttcctgtgaatgaattggataaaagcctttatgcccgagagtgaaaggtgctccagcttgcttggtgaacactgacttactgaagaccggaatggaccaatgtgacattgactcaagaaggtagacaaaaaggccaactatagaaaagccaagctgactgaatgaaataccgcagttcactctgactccggttcggtacctactctatatctgaagattgaccacagcgtaatgccttaccgctttacaccttgctttccttattttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaatataaaatatcttacccgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccagacccatgccaactggacacccgcaacgtatgtccacccgccctttcctttgataaatcctattcctatcgatttagctgcataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaatgagtcgtggtgcgctcatcaagaaggggaaagatggatgggaaatgcttgtcaagctcggttctttaaagaatagcatcctcgtcttcctagtgaaaagcgcattgggattctctacttgtggtggtatagtgctgcttttagtgatttggagggtgcctcccgtgggcatgcctgctacgctgattaagcgggtaggcagatggattgatctactcgttcaacttgcttgtgttggtgagttgttctattattgattggtcgagcccggaggaagagtggccttgagtttctcgatacataacattgtctaaatcaacccaagtcgcttcttcatttctctaaacagactggtagttgggtgagggatgtttactattgattggttataggccttccttccaagcatcaaagaaagaaaagagcaaagcaattccaacataaactgacactttaggatcctctaagcctttctatagaacccctaagtagggaaggtactaaaaagaaactcaaaactagcactactaacacaggctgaagaggatgacctcgaaaaagaatacaattaaagatgtggccttccctccaagcacatatatggatatggagcactcttttccaccctatccttatatatttcattcccgccattgacagcaactcactcttttcgaactgcactttgaaagccaaagccaagaaagaccatatcaactactctccaaattgcaggataagtcacagaattcaaatggaagacagaaagagaaggcaattcaaacctaatggccaaacattacgaatccaagacagaaagacttatagccataaaagaataacaagagaacaaaaacaactccatattctactggcctgcctctctgatctactatccaactgccatggaagcaccactgaagactggcttctccgaccttccacccgatcctgggcgatcccggatcgacaagccgacggtatggattccctatatatggatggtaggaacgcttcaactgcagagccctgaatgcgtcagtgaggttccctctatgagagaaagagaggttgctaatcttggatcagacggcgtgttggtattattgataaggcttggattagcaaattagcaccgcttgagtttaggtattcgaaatagcgaaatacataaattatctatctcaagtcgactctagatccccaacttatcttgagccatcagtcagattaaaagcagcgccctgccggcagctcctgacctctgttcctatgggagaaagaaggtgtggctttggaccccaaactcttccatgacggccttcttccactcattttattagcaatcaaacctcttccctgctcttgcactgaggtaagcattcaaatagcaaagcaagggaaaaaatatggtatgtatttttttaatctacatacagagaaagcggatgtgcccttattagcgcagttgaaaataaaatatataacgcgtagttgcaagctttctttcgtgagctagctatgtttgcttcctcttttcctctctgtttcggatgtcaacccaatctctgattcaagtccataagttccttttttatagctcctgttgctcttctctggctaggatctcacttatatggccttttttttcttttatatattatatagtaagcttcaatagatagcgtagtaggtgctgtctctatttactttctttcttacgcctaggtgctaccttctttccagttccgtaagtcccatagagttattttttatctttgattcccaaacgctgcgcgcaagtcaagcttacagaattcctgccggggcgccttttttcttatgccagccaagtagcaatcagaaaaccaatcaatcttccttacactacgacaattcacttgaactaccaacatcatgagtgacccaggccggccgtatatgcgtcatttctcctcatccttgtctctatttgttaattgctcgctacccgtagtgggccttgagtaggatttaagcacgggtttcgaaccgtctacttttccttatccttatgggaatttaagagagagatcactcca

SEQ ID NO: 626 - DNA, 682 bp, Oryza sativa
acccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcagaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttcagaactggttaggaatgggcgccactatcccagcccggatccagccaggttctattgatcatgtccccttcccaacagttgtacccttgtcttggggtctttggctttactatcaccggaaaaataaaagtctttctcttcccgttcc

SEQ ID NO: 627 - DNA, 859 bp, Oryza sativa
ccaataaggataccactcttactagcaaggtgaaggacacatcaacccgcatacccttttaccacacctaccccttgttgggcacgtttacgcatctcttgacccatccacatgacccgcttggctaactaaaagaagcttctcggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttctctcgtacgctagtacgctagggaatgtgcttcggcttcagcctagctacttttttgattggtgactaaactactaaaagcaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccgatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacac

SEQ ID NO: 628 - DNA, 496 bp, Oryza sativa
  unsure (1)..(496): unsure at all n locations
gactttggatcttagcacccaatcagtctgtctgtactaaggatgacggcctgtattcggagtttccctggggttggtaaagcgaaatgggggccaccctagcccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctgttagagctctcttcaccctgttcatggctagatcgatcggtttcgggtcaaatagaaagaacgtaaatcttccacctctggaaagcgcctacacctaatggcttaagccgctgttcccatttcctcgctgacccatcatgcgaaaggtacgccgttagagtgagtgcgcccgcgctccgctccttcgactgattgttcgcatcggatctcaggttctctattgcactccccgatt

SEQ ID NO: 629 - DNA, 417 bp, Oryza sativa
  unsure (1)..(417): unsure at all n locations
nnnnnnnnnnnnnnnnnnnnnnnnnnnnnnnnagagcacttttttcgttgagaataagtccttcccttttgtgtgaattccccagcggcgaattaacaacttgtggggccctatctattcaatctctcgagccccaagaaaacccccctctccctcggactcaatctctcttttgactctatatatgtgggcacctgatatctatgagggttcacccaccccggtgacagcattcctttctattgcgcctaaaatctctatttctgcaaatatgtcacgtgtttctattgttgcttcctatgggggtacattacaacaaatcttcttttttgcagcattgcttctatgatcttaggagcactnnnnnnnnnnnnnnnnnnnnnnnnnnnnnnnnnnnnnnnnnnnnnnnnnnnnnnn

SEQ ID NO: 630 - DNA, 394 bp, Oryza sativa
aggtcgactctagaggatccccttcaaagtacagtgcctttggtacattggtgcattggggatttccaggtagcaggtcggttgagtgagggctccatccataacagatatagctagcgcacaggatctcccttctgcgaacaaaaggacaaaagagccgggtcgggcgttgattcgccgttgctatcagtcggtctactcgtgcctgctgcttactttctcgatcgatggaatcggtgattcgaaaaacctaacatccgtaaggagtctcaatcgtagctcactcgttgccttactctcccacaagatcacactaaatacaataagtgcgtgatctactagattcttatataatcaatttctcaccttagttgatagacaggaaccaccatgg

SEQ ID NO: 631 - DNA, 602 bp, Oryza sativa
  unsure (1)..(602): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccccttttttgttatgggatggtggttcctgtctatcaactaaggtgagaaattgattatataagaatctagtagatcacgcacctattgtatttagtgtgatcttgtgggagagtaaggcaacgagtgagctacgattgagactccttacggatgttaggtttttcgaatcaccgattccatcgatcgagaaagtaagcagcaggcacgagtagaccgactgatagcaacggcgaatcaacgcccgacccggctcttttgtccttttgttcgcagaagggagatcctgtgcgctagctatatctgttatggatggagccctcactcaaccgacctgctacctggaaatnnnnnnnnnnnnnnnnnnnnnnnnnnnnnnnnnnnnnnnnnnnnnnnnnnnnn

SEQ ID NO: 632 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnaaaaaagtattgcatgaccgaataattcaaggaggggcgcacagcggggagggtcctttttagtagatgactcggcgggccgtcattttctatcaggaaggctatgtcatttacaaccccggcgtatttcggatgcttgaaggccccgctcacccgaagtgatttagaaaaattcttctttctcgatggggaacgggcatgggatccataacgttgcatctttttcggccaaaacctgatttcgttttgcttctcccgggcgatcgactcgactcttttccctgccccccgggctctcactttgtttcggtcttcctctgtaccctcgcttgaatgaagacacccgatcggcccgactttcccaaatgcccaccaccggcccttatcctttccgggtcttgatttgtcgcgtcgttttaatcgtagtggtcgacggggaaaaaagaaatgaatgaatgtccctttgggaaaatgtagaaaaatacacctaccgagaccaaagccaaaagtgagtatccgaggtggacggatcgaactgaaataagactaagaatgacatcttgatacaaagatttaccataataataaatagagtcaatggggacagaaccgcgggaagagccgcttttttttgcggggggggcttcattcaccaaggcagaataaaaacacgtgctctttgaa

SEQ ID NO: 633 - DNA, 736 bp, Oryza sativa
ccccgaaggaccattcgattcattaagggggacggcccatttgtaaggcgggggccctgatggacgacatcccccggcctcgattcttttgcatagtctgggggccggccgcagcagagctgcggggcatagcggcaccctcgctctgcccagccagggcatagatcactctctgtttactcctacttctgtgaagaacagaggcatccaaaaagagacgagaagaagcccgcgcctttgcctgcttccttagctacgtcagaaggtagggcctgattgacagacggctccgaagtagcaggggcctgtttgacagaaggaagggcctgaatgaagagcggaccagactcttctttgtttcagctgctcccacgcacgcagaccggaagatcccagttgtcctggactagacaagtacgtagagatcttcgtggaaccggggagggagtctcaatcgatcttttctaggattccaactcacgccacgcacgaagatttttctattgatagagttaagggctcggctcccccgactctaaaaggttaggttactaccagcttgcctctacggaagaggtgtactttgtattgtctgggggtcatatagatcggaacccggagcgagttgaacgaaaaccttacccacagctacaactactggcgctttaaagggcttagattctaagtaggggtggaagcccctgaaaaccttggtcctttagtcagcgagcagccc

SEQ ID NO: 634 - DNA, 13970 bp, Oryza sativa
  unsure (1)..(13970): unsure at all n locations
nnnnnnnnnnnnnnnnnnnnnnnnnnnnnnnnnnnnnnnnnnnnnnnnnnnnnnnnnnnnnnnnnnnnnnnnccgggtatatgaggccgcctatacggttcctaatctaactgcagcgtatcatgatggcaagctaaattcaatcaaaggaatctcacctaacgctagctccggcaatcctgggacgagtccatacgctagagtagagaaaagacgagcgctatccctttttttctaaaatcccaatcctagggtcaaacctatccttggtttaggcaatgccaacctttcctttcgaacaacggtacttactgcccgtaaaacagatcggcacctatcctcggtctcggctatctttacggcataccccgaagacgaatcagaattatcgactttaacagatcgatgttttgtcgttcaatcaaaagcatgattcaattaatagctcggctttcgagtcctatcctactcggcttctccccatttttcagacattttcctatcagtctcaccgtcaagatcgcagttcacaaagcacaccaactatatgtgacccctatacagaccaatgaatacaaggaataagataagcccctggcccgactactactactgtattcctctccactctcctcgtcagttcgagcccggctcgcaacaacaacaaggcctttggtcatatcatatctcggcgcctcccttgacatgttataatgcatctataatttaaagattagtgtcccaaaccctggtccacctgaattccattgtgtgatcagaatacgcaagctagaacgttgttgaagcaaacatataggtagaggtagcttaatcactaaatcaaagaagccaaggtatcgaaggaacataaggtttccaatgctactaggtaactccaaaaggttccaatttccatttcctaaatcgtttgtttggaggttgtaaagaagataagttgactcaggctatttcttcagcttagaactataaactttgaggtaccttttgtgctttaacatgtgaatagcatccggcaaccaatattcgtctcttccagtgctagaacatgcaagcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataatttttattttcttgtaaagtatttcttttattttagaggagtctctaaagaatattcatcatcatctctaaagataaaggtgagttccagcagaatgtctattgaacaagagcacagcgaacttcgaaataagagactgaacttactttctttcttgcttgcttacttcttccttgttaatagtagggatcaagctagtcaattcaaaccttcgccgcttgcttgtaatccgcttaccacttgctgatactctagaaacgacatatcgaattagggctctttcccattgagaccagtacccgtagttttgaatagattgaataggaatgaatgagagcaatagaaaagcacatcaatggaatttcttgaagaaaatagataaaatgaaatggaattacagaacaaaacagtgatgattgaaggaattggacaaaaccaacgattactgcgaatggaagaaatgaaagttcagatcgatctaatcctcggctccacgaagcgaagtatgttcaaatccacggagggacttgaattattacttctatttacttgatttgctggggaagaaaatcattaaaataccactaaggccgggcaagtgcaagtcccgataacgggaagaaatgcctaccgtgcgtagtaccgatgtacaaccaagactaaaattggactagaccttttatcttgggctcgttccgagtaaggattcttttgcctacctcgattcaagttccgacaaagactgggacggagctacttcttccaaggatggatatgcacaccgtaccgacttgtgagaccaacattctattcaatcaactattatgtttcatagttgttctattcaatccaatcattcctatctatttaatccaatcaatcctatcatagtatttggtttcatcttcattttttcaatttagtagaatttcgtttatgtcaggtagcacacctaccgataagcggaaagtgatcattatacctaaacccatggatagtaaccattttcttttatgaggactctctgtttccggtataggaccaaacatttcattaaatggataatcattttgaaaggcagacagcactactggagtaagatccttcgtttccacgaaaactaccttactataatcagtcacatttgccctctcattgagaaagacatgataatcttctggaaacagatcaacgggtaacgcttctataccgctaactggtatatacctgaaccatacaacggtataaaacccaaatttgacaagagcatagaaattcccacatacaaacgatgttccatccttggattggattgtcataagattcactaaacattgtgtgtgtatttagcggtcaatgtataatttgaagattctgttaatctttgtaaagatgtccataatctgcttcgcatagagagttcaccaaatttcataggagagagactccttaaagaaagcatatcccttatataattataatgaaacctcacaattggttgattgaattcgatattattgtggaataagcacatattattccaattaggactataatatctataacggatttcatagtgcgtttgcacatatttatttatatattcttttaatatacgtggatcttgcaaacagttattgacaatttccctcttcctcctcaaagcagttatataattaccactaccatattctatagaatacgatttgattttctcgctgatggattctttccaatcttcagagggcgtatgcgtgtgaacgcttggttcaagctcttcacatagacatgatcttggaagactcgtttttagaccgaagcgattctttgaaccgagttctttctctttcttgcgaatgctgatggttggattcaatgttctggatcaggtcccttgaccttagcggcctcgttctttaaaaaaagaactacattcagttgacacagctattgactcagctgtgaaggaatgaatggcgaatcgagggaggaatatggtaaaagctatgctcaaaggtaggtggtcgacaacattggtatcccttgccaactcttgaccagagatacaaagcacctgcagctgaggcatatctcagtagcttgcaggaagagaaagatggacttaaacactatagatcttcgcgtgatccgcttcccccagaccagccaatagaagaaatagaaaagaaaggctttatatactacattagatagcaagtggaaggatttgccaatgcgaaattgagtagtaggcactttcttaatatcatgcgaacggaaggctggtatcgatgcccaggctatatatacgctattaaataaattcttggtgtaacgtcagtcagcaaagaaaatcaataagaatttcataaagaatgaaaggcaggaaacaaggagaaggaagctagcaaacaatatgaaggaaaactttcaagccttattcgtactccacgggaccacgtataatagtttcttctgaatggaaccgtaccgatctactaaacgaaggtgttcacgagagggaagggcttatcttcaaattcggtatcaactgagcaaatctccaaaatgcctttcattcataacaaaggaaatggcaccgaaacaacttatctgcaaccctgacaccagcaagcacgggcaaattgatcctcaaaaccaaagggcgttagccaagtcgaggcttttgaaaagccttacctacaacgcgagtctcctatttgactatcaaccattctagtttcaaaaaatgttcccatcagtgctgctactcgactttctcatctcctatttgtttgagccattcattatagtggtggtgccggggaggcagcttagcactctagtcctaaagagtaagtaattgtagcatgggcaggcaatctcttcgattgattcccctccaggaattactttcattaattagccggcccacggagtgaaatatcgaacttaacctataaataactagtatctcaaaaatccaaataaaaggctttacttttaaagcttgttaatggaattccacaggagtcaagcgctagcaaagaagaattggaaatcagtcgcttcccttctgggctcaagtcagcagaagagtgaacttcatattaataggtaaatcctgcatcaagcgtaaaggaagtacacttatttggattcggcgcttaataactcgtagttgacgttggtttcggttcgatcaactatcctttttgaagcggatagttcacagtgctcattctcaaaaaaaagcggaaaagccatgatgtttccactccattttcattacgaagatgtattacgtcaggatctgttgctcaaactgaatcacgccaatgttatggaagttcctggattgtttgaaatcagattagtaccaaaagctgcctctgattttaaaatccaatttggaaaattggctatggagattttgtgcggtcagagattcatacagacacaaaggggcccttattttaaagcaggaaagtcgtttcgatccaatccattcttggggtccgaaaaagacactggatatgtcagtgactttgcacgacaaagcgttctccgagggcatggaatgtaccattttttggtcagaatcttgacagtaatgtctatgttagattctccggtcgaaatatgggaaaactccatcaaattctttatggaaacggagttttgcgaattctccccggaactggaagatcatttcgagatcttcgagcatattcgagggttcaatgtgactattgtcacttcggccaatacaaaagatgagactttactactgtggagcggctttttgctaaaagatgagggggaaactaagtaagatgtcggagaagcgaaatatacgagatcacaaacgtagattgctcgcggctaaatatgaattgagacgaaagctttagaattttttaacccgatcttccgcgggatcgttataagttgtccaagttgccaagaaagagttcaatggcacgagtcagaaatcgaggtattttcacgggtcgccctcgttccgtagttgagttctttcgcatttctcgtatcgtttttcgtggattagcatctcgaggttctttgatgggcataaagaaattgtcttggtagcaaccaccaaaccaatagaacaaaggttagctctgcagctagtccacaagcaagggttgtaggtccattaccgtccggctcccgaccgaaactaacggagtcatcccaactctcggatcggagatgctaacgggacaggaatcgaagtccatatttttctaaattcttaaatgagagagtgaataccatacctaattcagatttggctcgcttagaacttgatagtcttctaatggctaaattggatgaagataatcaagccaagctcatttactttgaattgaggaaggaaggggtaggggaatactaaatttcttaagatggttttgtaggtttctcatagcaaatagagacaccgaggccctctccacaacctagtagttgatgggtatggggaggggagagaagagtgggtatgagggcttcgctcgcttgtttgttttcctaagagtcacccatactacaacgcacacagaagatatggcttcaatcaactatttattttcttgcttgatttcctgtgcatactcctttttttaaacatacttgatccaaagacttgatcaggcagtatcaaatgataggtggcacgcataaacttatcttgtcagttatcccttgctagcttgtatttgtgaaggatatgttaatctgggtcaaagatacttgttctcgatgagtgaagattcaggtattacgcctcgaatggagcattacgagtgcatgattgagttgtttagtaagcatggttgatttttaatcatttttttccaccttaagggccccagaaacttctagttattctccagtaggaaaggttctagtgacattgctgctattgctggaagtccagtttcattttggctgggagttctctgtcagctagtgggagtcccgctattctcattgtaggcgtagttgcttctttcatccagcccagcacgccatataatcccttttccatgcccgtgctttgacctacgcctaagttaatgtcgatccaaaggaagccatttagatctgagttaaggaaggaagttaatttaagcaagagagcgataggatagatataaagcttagaccaataggcatcttaggaaagccggtttttagggaaaaaagtatattagtatactacctcttggagtttcagttgctatccattctgtttgagtgccatatagcttttcctattcagttctagaactagtggttacagcgaatgagcaatcttgtgtatatccgggcaagagactctgtcaattcatccaatgagtaagcaggacagttaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtcttccacgggtctcaatggaggagaactttcctgttcatcctactgcataggcaagatctcatccttcggcgaatctaggggctcagaagagtgctccctacgacgggaaattggggtccaaagactatctcttcgacgacgtggacacggggaggcgatccgacaagagagatgcagaagaatatgccctcctcaacgggtcaagccctcgctcagaactaaatcatcctgcggcactcactgcatgagctcatagggcaagatgaagagaaggagaaaggctaaagagatcgtcaacttcaccttggcatgcttccatcagcgctgaaaagacagcattgaacgagaagagaactaaggcaaggctggtgatgtgccactgtacggggagctctgagaaagtagaagtgctttccttcacgctgagcgtgaactctcgatttcgctatacgaggaagattgcttatgacatcaatcagctaagtccgtctgtcgaagaatttctcattgcattcgatgtttagagtaatagtatagagtgtttggtctcgcttttaagttgtatcggctggcaatatgccatagcggctggttcagaatatccccctcgcgaacctccacccgcggaccaagactccaaccgaagcacagacctgagaattggtagtcggagaatcagtagcttgtaaatagattttctgttatgcgatgctcgtaattctcaatagggccccctttctgttaagtgaagtgaggcggggtcgccgaaccctgaacctcaacttggactggagctttcgggtctctaggtattgaattaaagaacgggtttagctttgctttggggggagtcctggtggggagatatgctagcaggtaatggctcagcttctacttaaaaagcgttttaagcgggtttccttatttatttgcgggtctctcgtacaagattctatcagttacagcggattcaagggatggagccagatctactatccgcttgctgtccctaagctgataattgcccgagcctatttgtttttttccggggaggggcacatagcgatagatactttataaacctatcactaagaagcgggctcactgaaaaccaaactgttcgtatttctttaaaacgctgctgccctagccgggggtctgtctatagaagaagggaatccagaggaagaagcagctccccgaaggaatccttctaactaccacctatctacctcccgcttttgttcggacaaggcgagtttcctaagattcacccaccgcggatacactaagcgttcttcccgttggtaaatctgattcttgcaaatcaacatcagacttagaagcttcatggggtctggtctcgccatttggcaatttaagccaaacaaaatacagtacagaggttataaccaatacacaagcaggcgtgaaccagtcagaaattagaatggagaagtagacacagaagaggaggttgttgggacagtatcgatagccgccttttcacttattgctaggagtgattgtgagagaatacataacataggtgaaagccaaaaggcatatatgaccccccaatggaagtgatttgaaactgacgtttctttagaattcgattaagaataagaacatagaccggcttctagaaaaagagacgtgccctcttctctatctgtagattcaggagcaacatgctggttccttttgtcataatacctaacggctgtgggcagaatgaatgaaaaagcagatgaaagacactatacataccgatagaatgataaatttagaataaagctaggtgacgtcacggcatttgagaaccaattgcttcttttgcttttcaccaaccttcatgtacaatcttatttcgtattggagtacagcctatcgtaggcccagcaaaggcaagacggaaagcaagcattaagtgaagaagcaaggtccaaacaaagtagtgaaagattgacattgaaaagcttctccatgtctatatctgtccgatggaccaagttcaaaggaaacggcttctctactgcatcaaaaaaccaatccaagcctgaaaaggagagttgcggttaacgattcctataaattgagaaagaagcatgttcttcatgcccaaaagcggataaagtagatggaacctgttctctaaccttctttttgtagcagatactgcataaagtttacctgccttgtaaggcttttgtaggattaatcaaatttgctttttctcgttctatctcagagtatccattcattcgatcttgctatccgctctcaattgaatcccttctctgttgtcgacaggtgtgtccgcatcaggaccagaatcacggtctagtacctccgtactcgaatacctcctactttattaattaggaagtgaagtagggaacggtttcctattcaaagtacagtgcctttggtacattggtgcattggggatttccaggtagcaggtcggttgagtgagggctccatccataacagatatagctagcgcacaggatctcccttctgcgaacaaaaggacaaaagagccgggtcgggcgttgattcgccgttgctatcagtcggtctactcgtgcctgctgcttactttctcgatcgatggaatcggtgattcgaaaaacctaacatccgtaaggagtctcaatcgtagctcactcgttgccttactctcccacaagatcacactaaatacaataggtgcgtgatctactagattcttatataatcaatttctcaccttagttgatagacaggaacccccatcccataacaaaaaaggggggcgaaggttattttgtaccaatgaagacggatttctctctcgagctgctcaaagatctttaagtggcttacgaggtagacttgatcatgatccatatccaaccttctcccatctgcttctgcctaagtatttgttttcatttctttgattgaacattccaagcttcctttctattatacctaatgcccatagctagttttattttatatttgtctattctttttgaaaaagctttatccgccccgtgcgagagagttgaacaaatagcataacctctgggatgttggccctagtgaaggggagctcttcgcagctgtcagtggaaagatggaaattggttctaaaagagccgagctagggataagagatacggttggttggctgaatggaaggaatgctattctaatgggaaccgggaaaagaatggttcccaatacagggcccgaagaagagagacgaaagaaagtagtgaaagaagaaataaagtacgcggataaaagtgaaaaatcacatagctactaagtcaaaacgtccaatgagaatggagatcaagaaggacatgaaatccattagcagctctatcagttatttcattattggcattccttaaccaatagaaaaagaaagagatcacaagcgttatcagtctccagacgcatctatctataaaaaggagtagggcacctgatatgagatacatactggagtcaaggattgagaccactagtgagaaggcaaagaaatcgtttttatgtatcggaagggaaagaaggaccatccattggcaagcacttaaggacaatggctggattaatgaactccgacaactgctttcccttgcagcacgttgccaactaagctctcttacgtaccaactgagccacttatttacaacggaaaggtaagtccgttaggcacaactgcaaatggagtttattaccttagcattcccaactgtaagggattaccttaggacaactggaaatgggacgggggaggcttgagcaacaaatctttcagcttcatatgccgccgatccttgacaggcaaaagaaaacctctattccgaggctagctttcttccttgtttggtggggctctccgcctttacctgcccgttctttccttgccaccattgtggtgccggtctcaccccctctgctgaggaatcaaagatcctcttcttcctgtgtacctctagtgactcgactcgtgtcttggaggtccaaatgttcctatttgcctttgcgtttttgcgcctctagaagcctcatcgctttttcacggtcaaagttcaagaaatagggtttctgatcagcagaaagaatgaactgtagacccgctaaacagctgcaccaagaaaaatggctctttcggcaccctcaagaatagcttgtgcgttggcccaaagaagccctgggtaaagctcgattagtacataaaaaaaggaccctccccggggcggaggaaacggcaaccctactgcattggaacatcgtctcctcaccatctccctccccatcgtctccttcttcacttccccggaactgcacatcaggattcttcaatccttctatctggcctccgtacccgtagtggagtaccttgctactttcaatattcaagtcattttcattgtttgtttttagttttgttgtggagaaagagggctacttaggaagcaaggtaactctatcaccttccgtccgtcttttcttgaacatttgacttcgcgaatcctagcttttataagggaaaaccaacatcacgtaagatgaggcctatccttcccgaaagcgtcggctagttctattctattctaacttgactgacttcctctaaaagaagagttaacacggtcgaaggtcaaagcagaaagggtttgagcttctttggcaacttagctattctttggcaacagagctattgcaatagagaaatcgagggaaataggcttaacctacagagaaagagtgtaaggaaagaatgcagaaaaagatagaaaaagtgagtgaaacaaatgaaatcagagtaagaaatctcacaaatagtaggttttaccggactagaacaaacgaattagcttgttttaactaaaaagcacagttgagcaggaacgaagtgtgaacataggcacaaaaacaacgttttggtgatcctgtgtagttgcttgctttccgcttgagctactttcactgtgaagaagaggacttcatctcttcacttacccaaggaacttggaaataacgcgtctggcttggaaagctagttagggatattcgatagaggaaggacccgtttcgagtagtgaacgcaccaagaaaagccttttattttaagccatgcttggtaacgcacatgtcctactctacctgcatcgggactggtgagagccggcgatgcacggaattttggaaacgctctacttcactaaggaagatacgtttcacttttccgatcggaattttaactctggctggttcaggttacagtcagaggaaataagaagtatggtaagatgaatgaaaggcagaaatataggacatacgctttatcgcagaacatctatttgctttctattcgacaagaaggacaaggaaaagataatggatatggaacacaggtcctggcactattggaaaatgaagctctctcagttcaaacatatgagattacttaccccggtttctaagggcggaagaggaaagtaccaaggtgcactaggtgagaagaacttttttcgcttttttatcggaatttgactcattttagtatagaaaaacaccattctatccgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctgctccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactgaagtggctattgacttaagtggctatttcctgattccgatatggcgtcctgaatccgatattgcttgattgtctgttgatgcccagccgaagaagtgacttgcttaacgcagcaatttctgttttcttgtgctctccacctccgcttgacactctcgtagtagatcataagagaagtattctttcaagaaattcgtatagaaagatggactagctcgagaacaagcaacggattgagcgcactagcgcgaaagcgttagcacgcgcatccgttttcttgctccttggcttcaaacaatcgattgaatctggattcctttgcttatccttcctggctatagtctctcttgtgccttcggcagttcagttaaagatttctgtatcagcagtttgtttccccatttgctcaaagaacgcataaaacctgttccctcaccgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttgaattgacatagagaaatcttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatctnnnnnnnnnnnnnnnnnnnnnnnnnnnnnnnnnnnnnnnnnnnnnnnnnnnnnnnnnnnnttgttttcggggagctgggcagaaggaaaagaggctcctagctaaagtagtctcgccctgcttcaaaactacagggcgcgcgctacggctttgacctaacggcctccgtttgctggaatcggaatagttgagaacaaagtggcgaacgggtgcgtaacgcgtgggaatctgccgaacagttcgggccaaatcctgaagaaagctcaaaagcgctgtttgatgagcctgcgtagt

SEQ ID NO: 635 - DNA, 33380 bp, Oryza sativa
  unsure (1)..(33380): unsure at all n locations
tgaatccttcgcgatggaaatgccctcgcctacttgactaaactaaggacctcaacggaagcttatgtagattttctacttttccattttccttcttgtttatcaatcaccaatcaagacaaaccgggcactacggtgagacgtgaaaacacccgatcccattccgacctcgatatatatgtggaatcgtcttgcgccatatgtactgaaattgttcgggagacatggtcaaagcccggggtaaggctaaaggagatttcttgaagccaacatccagccttagtggcccctctctgataaggttttaaagttttcaaaacgaaaatcaaatgatccgaaaatcgtataaaaatgtgtggttccgaatgcgctaacgcgcaacggctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacgagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccaggagattctctcttatttcttaagaaagtatgaattgccatagaattcttcgaggcctgattcaagatctgaagtatgaattgaacattggtttttgcctgtcaataatatcccttaaaaagaagagagagagagactgccatcgccatctctctctctctgtcatgtcaaatcgagattgtgtgggtgttcagtatcacaatccctgtattctaggttctggctggttagagcagaggactcgaaatcctctttagctttgcgcgttggactctaaatcctaacagagtggttcgattccacctcagaacgaccttcacgaaagtgaaaaatcttcgtcctaccaaaaccggatcttgaaaagtgttcagtgcccaacacatcggtgaaaccggggagagctgaagagaagggaaaccccagaggcattgatcatttggtacagccgctaattcggcatttggtactgccaccatttctcgaaagggaaaaaacatacttaacaattcgattgggaggaccaagggatagatcgattgcaatatcagtatcatacaaatagaaatagacatgagtacatgaataaggaaacgcaaaagacacagagtaggggtagtcagaagcgtcaatgcagacgccaatgggtaatcagatccattccacttcttcagatagcagtcgatcctggatcgtcctcgcttccaaactccgtaaatgaatgaaactccttccccggtccattgctcgggtgtgatacaaatacttctttgaagttgtaggatgcgggtcatcgatcttcctatcggtccagaggttatgcgccagcttgggaaagaaaaagtaagatttgtttgtcatatcacgatcggaacttagatgtaactcttcttgagtagggggaaaaggacacctatcacgcggtcatgccttgaacgcagtaaagaaattaataagcttcgaataatagctacgctagtctccaatagcgtcttaagcgttggttttctttgcgggcatcgtaatggattggtggttcgttgcctctatttnnnnnnnnnnnnnnnnnnnnnnnnnnaatcttctctctcggttactcagtggagtgatctctctcttaaattcccataaggataaggaaaagtagacggttcgaaacccgtgcttaaatcctactcaaggcccactacgggtagcgagcaattaacaaatagagacaaggatgaggagaaatgacgcatatacggccggcctgggtcactcatgatgttggtagttcaagtgaattgtcgtagtgtaaggaagattgattggttttctgattgctacttggctggcataagaaagaaggcgccccggcaggaattctgtaagcttgacttgcgcgcagcgtttgggaatcaaagataaaaaataactctatgggacttacggaactggaaagaaggtagcacctaggcgtaagaaagaaagtaaatagagacagcacctactacgctatctattgaagcttactatataatatataaaagaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctgccggcagggcgctgcttttaatctgactgatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttcctaccatccatatatagggaatccataccgtcggcttgtcgatccgggatcgcccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgtgacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctacttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttatcaaaggaaagggcgggtggacatacgttgcgggtgtccagttggcatgggtctgggttccgctcatcaactcgaacggtcaatgctggccagatacctgcatcgttatacgtcacaagttggggtggttgaacaggaaaaacaacaaggcaggcgataggcacacacacctatgagaaacaattccacaggaattgggcagaactattagttcaatataaggaatttcatatcaccatgggacttactagtaaaaagcgaatatcaattcatgacagcgatggccgcttagttggtactaaaccccatcatattgggggagatgagttcaaaaactttggccatacggcccatcgagctttaagcagtgttttagatgaaaacgaggtactattgagagaattgtcgagcttggctgatcataacactcccaaaagtagtggaaatgacactaaccctagcccgaaggaaccgtagaaaaataaactacgataagtatcgagagtagaagtcgagaacaactgtgtggagtagaagctgggatagaaagggttggaattctcagcgatcagtggttgatctgatcagtgaacttttggtgagttcattggtatcgggtggtccgtttcatcctctttcggcaaaggaagttggactttagttagctaaaaaaacagtaccagcagcctgtctgtgccctttgagtctatagccgccaaatctaaagattccttaagttgtcgtacggcttctttttcttcttttgtcaatgatcggtgacaatgaatgctacgaatgttcgcttccactaatgtcgtctaagaattgtgaggtgcccatagcttcccggaaagaagaagagtcattgtcgtttcctgaccgatatgaatgcacatatttaccctcgcctcggggaataccaccagtagagtctgcagaaggtgtcgttcaggagagatgctgggctctagatatgcgagtgagatacccaccctcggtcatgacctgggttgaagaaggaatctattttcttggaagcaaagaaagaactccggtattccgaccttagatttttgctctgtaggggctaccctatgggctgttatctcaaggtcctggttaggctcttctttttgtctcttagaggctaaaaagaattgtctcttgtgggagtgcccgataaggatgaagagacctggttacttgaaggtacctttaaaaaagaatagtgaaaaggttacctagcctatgatcctccatatcctccagagattgactacgagtcatacccagcgggatacatattgaccaaatttcacctaaatgaaaatcctcttacttaacccagcatcctatctatgatcaatatctatctcaagtgttcagtcaaagaggagagtgagagagttttctctttttctgaggaagccgccgccccgccgggcaaaggttgttgtccctcgcctctggcttgaagattggcatttttggccttctctttgacagccatttctttgtcacgcttcgacgcatcctttggtaaagaattcaatcctctgccctccctctctataggatcttgtacacatatgccatcgcatccgcactttaagttaagaagcatagtgctgactttacagaaagcaaagcggcgtaaggaagtaaactaatttgccagctcacagacctactatcttatctgataaaatatataaggagaactccggggtttgatgtgaaaacaaaccgtgtcaggatgaaagttttgaagtcaagtgttcggacgaataagagttggatattacctgcttcatgcttcagtaccaaatgaaaaacagccttcccagcgagtgccaatgtagtaagtttagcctctaacgccagttcaactacaattcgagaactcgcagcagctccttcaaagtcagatattccacttgctaaactcactcgtgtaatgacttcgattccattaattggaactattcaaacagcgtgaagctataaagggggttagggaacttgacaaggaagatggagatattgatgaaatgttgataaatggacctcgctttcttgttgctgagagatcttgcacgcatacagagaaatggacgcggagaaaaatatttatttagtaatatttattatatattactgatggtgtggattgaaaatccatggataaaatatatttaaaacaaagaaattctggaattgtcacacagaagctatgacaaaatagcttgagagccctattcacatgaactttgactcgtcattcaacactgcatgtagactgaattcttcaccatatacaaatggagaagagacaatagggttacttatctcttatttacgtagatttacaccacattccgtgtagatttacctttagtatctatgtgcgtagcggcacaagtagagagaaatccgccccatccgtgcattattttcatctcaattgtgtatttatgggcataaagtgcaaaaaatgcccataagtgaagtaagatcttgtgttgtccagccagaagccacttttatggtgagcactatcctaagcagctgggaaaccgctgaccaccctatgtatgcttaccctttcactacccagacatacctgcttattatgcaatgtcaggaagtgaattcagtctatctgcttacacttcaattgggtgtgcgcagtaagccgaccctgatgtaaaacgacatgattttcgatatgattgggatcagtcttccgtactctagagttgttataggttcataaatattcggtgaattatgcatgcaactccccttacgaatgaagctcatatccgatggcggagaggctcgtcggtgcaatacggagtgaaggaagaacgaaggggatgaggacaataaatacgaaagacatgtgttactaggtatggagagaaggggcagctaattccatttcaagaagaaagaagagaaggaggagctactgagacggtcaagctgaaaagtgatctcgctttacccgatccccaagcactgacattgatagaagtctggtttgcagcatcggccaaacagctgactcttctttttcggataagattttccaactattcattcatagcggacgaccctcctcgggtttgttattttccttccaagcctccggtgtgctatctaccaacgaaacgcagaatagaagatcctggaaacccaggaagagcgaattcacttttcagaaatatgttcatttgaaagtgaacacggaaaataggattggggctataaattgctctctttatgaaagacctccatctgtttacttttgtggttggttactagcgatattatgagcatttatctcattctcctgagtagactacttttcttctatatctaatccttttaagaagtaatcgaacgggtggggaaagaccatcaagttcttcgatatgatatggttttttataaacccacaaggaagtatttggatcttttaaggccaatctttttcttgcccttgtgcttagcggtggtgccaggcatcggttggctattaaggattaagcttcgacccgacacatctactgcacgatcctttggagccgggggctggataaaacacagaactaaatcgacttccttaccagcatgtctgggattcctgtggttcttactgccccggtgaatgtgtaggtacgaatgactatcaaagaaagtgagacctataggttggattttactccctagtcgtatcttttagcaggttcgctttggtcttctttgttgccgtagaccagattgagctacgattgggttctcattctcccacgtgtcgctctagcacatgctgtatggacgcatgctacggcggataatccgcacaatgagattctacttttatggattccactttggggaagggtccaatctccggctactaaaaaggtttatgtcccatgggaaaagtttaggcttgtcttacctctctgctgcgttcggactcccgctacatagtacttctgacaccggagaagatgtaagattgatccatcttttgaacttcagaggtgaaaaacgacttccagttcacgagctccttcaatcgatagagaatccgtatcggttgtcgatatcagttatagatggttgccgttcgggggtgcttaggaccagaggtacttgcatgcagaccggagaggaggaggaaaacttagaatgtcgtcttttgcgacataaccagggccctcttgcccaaattgaaacgttaaatccacgatgcgatgtccatctttttcatttcataatttcctggaaaaaaagaattaactaatgaatcaaacttatctttatggaagattcgggaatatctacacgagtactcattttgcaaacatagcagaaaatcttctaaagaaatggacatattgattttatccatttttgctcttggggcgttgaacatgataaaggtggaatgtcagagcaattcaaattatgtatgtaaggcccgttgaagtccccgagaaagagtctaaatagggctataagtaggccgtttgctattgcaataagggctgctcgcctttccttttgacggcttggcttcctatcgctcctatgtagtggtcggccttaaaagtatctttggaccctaccataccatcatgcatgcctatgttatagtgcgttaagcttcgccagaagcaagcaagatgatgaagcgaagcttcgtagacaaggctcgttccgtgcttgacttacgagctcgtgtagtaaggcctcgccctacttcaataagggcttcttatgcactccacccgtaaacgagcgttagagctttttgagcgagcgagcgaagccttcctggagcttcccccttccctcacccgagaattgcatttccgcttcagcttccccggtttagttggtttggaggattaattgattggatacccaatccgcataatctttcaaagtcaccgcttctacgacgataggcgtaaaggcatgattagttccacaaatctcactgcactgaccatagtaaactccttctcgttgtaccgagatggaggtaagatttgaacgaccaggtacagcatcacatttgacacctgaggaaggtacagcccaactatgaggtacatcagcgggtgttacaatcatacgtagatgagttttggctggtacaaccactctattgtcaacttctaataaacgtgattgacccaattctggatcatcttctggaatcgtataactgtcaaaagtgagtgactgttcatcggaactgttatagtccgaatactcataaggttgggtcgacgcccgcctccccccaaactttacttgcaagtttccccgcaaaaagctctccacgcctactcttatttataaagagcactattcttctttagttaggtagttctcccccctctatgagaccgtaagaccccggtggaatcgaaggcccgcttactaataggcaagaggggaccctttctcgcccagccctacctacatcagtgaagctggaaccgaggaagacaatgttcaacacacatgagacaaaatgaaggtatgggacggccagttcaccacggaaagcgaattcgatcctttagtagtcttctttgttcgaaaaatgcgcagtggaaagggatgctagtcggctttggcgaagttgtaggccccaatagatcagatcaagagtgattcctcacctatcctgtcaggggccaagtcgaaggctcgagtatagattccctatgctcatgtgaacggccggcccgtagatctaaaaggatccataggcccgaccggaaagtatgtttgtccacgaaaaaaagtcgttcatgagacctcgaattcccacgttccagcctgcattatgccagcaggtcccacccccaatttcttgagtcacccttatctaaaaaaaaaaggacggagtctatctagatcataggatcactgtattcagaggtcaattctctttctttgacctcccaccgttcacgacatcccttgcttctcgcaagaacggctcctcggtggaggagtagaagcgctggtccccttcggtcaagtgcttgtgcgtgctcttacctaccgtaggacctccgtccccgaagcgaagaaggaggagcaggaacaacaggttgtcctctcttggcccagtagttccgcaactactaccgtggttgttgccaacggggatcccccattccgaaaggtaacggggccggcccttaggtccaaagttgtatgccactgctgtggtgccgatagattcactactaaagccccgttatcggacattgcaggcttagcatctatttttcgtatatcgctccaccacaccgagaagaggtatgtgtacctccagcaataacaagaatggaaccataggctcctatgctgggagcatttcggggtataggtctaaccacctcaactctccgtttctggcatgctatagttcttttagtctctcgacgacgggaatgggagatgaccggtaagccagatgcttcgcgaaccaccggtacatttcgttgcacttaaatcaccctcgttaagaggcgcactccgataccattgatgtccaatagctttgatagtaatggctggatctactaataccccgtccattgagtataacagagcaaacgatggtatagcaatgaacaaaagaatgacactaggaaatatggtccgaataatttcgatagtagttccatgaacaatcctttgcgggattggattagtttgctcgttgaaatgccataaagcgcgaaccaacatccgtgatacgaaaaccaaaatcagaatgaggaagaaaaagatatcgtgatgtaagtcaatgattccttgcatcataggtgttgcagcgtcttgagatcctaattgccatggttccgcagcatcacaaagagcgattgtgaggaatcgacattctaatgaacgaagaatcattggaatttcccatcttttttagctctgctcctagaaaggagactgatcttgacgtcggcgttggtttttccaacgaaaaacgagaacatactttcacgaacttctaatccaaaatgctagttgccttgtaacgcatacactggagcgtttgtcccatcgacgaaggccaatgagactactatacgcgttttccgaggagcaacatgatactttctttgccgttggttcccaactctccttccttttaatttccttcctcccttaaagctgaatctcaccattcgagaagctatggaatcgtcgacccccttaccaagtagactatgaagtcactttcgtttttttggttgtgtatgctatgtgtttgtgccccgtcatctacgaagtaaattcgacaagaaagctatccgatgtatattcgttggatatgataatgagcgaaaagggtggaagtgttgtgacccgaatacgaacccttgctatacatcccgagtgtggtcttcgatgaagcatcatcttggtcccaagctgtagtattgccagattctggaaacttagaaactagcttgcaagaaaagctagaaaaggaattgcggccgcagacatcagctaacctactttagtcgactttccccttcccgtaaagtggatctgccttctcccgctcaataacacagctattatcgtatcgcaagcagcaagcgctaaaagagaagtgcccagcactaacgctataagaagaccttatcatggggatgagtctacttcttagctgctcttaaagttagcgctttatgctattcaagaaggactataacacgagtactgctctcttgctctttcctaccctatagagtcagactagacttccttagaagtgatccaaggatctcccctactgtctctagtcccgtactgacatagtatagtctattgatacagtatccacccaggctcaaatcaaacctgatttagggtatggaaagggaaaggcacgtacacttattactcgcctgtcataaaataaaggtcaaagcctgataataaatcaggatgtcgacttcttcctttcttttatgattgtccttggcaaggaagttctgatcattgcattggcattccatgtttgcaggcagctcttattgagccggggaaagctactttaccccgaaatgcaagcactaggtaggccctttctagctttcggaagaaaaaaacgatgatgacatagttgtcagatacgcttctgtggatgaaatagtcgaggtggaatgtttttaaggtttgtcttgacgatagcggaaaaggatgaaagcttgattcttgggatcgagaaatggcttttttcatttgggactgccctcttccaacactaatactattaagactaaatcagtctattgggaactagaggaaagaggaactcgggaacaagaaggtagttggggctaagcatgagagtagttagcctgagatgggtgtttagagactggtaagatatacgtatttaatagctagttacgtggacctatgttgtttcaaagcagctaggtttatgccagggccgggaaaagcattcacttgtaaccaaaacggttatttcaagaaaggatactcacacactcccttttgcttcttcttcgcttatccagtggtgggtctcatccttgtctttcaagcaaatatccagtatctttgtaccataaccactatcaatcacagtcatagaatgtttcattgaagaataccgaatcaggttatcataaatcagagcctgttgacaatatacagaggttcgagtagattcatgaagcttactgtgtagaatgctggaattttcattgcattcaaagcattagttataaagcagttgtgtacagtgtagataggaatattccaaatcatacaacattttgtaacccatgaagctaaagaagcatccagttgatgaatgcaattagcgaaagtggccctcatacatagatttcagtcgatcccgactttctgtaggcaatttcagcgttatttgatgtctctttttcgtctgacccaaacaaacattgattgatttcgatttcatgtagtcctgcactatagtaatagaccaaccttcataaacaactggtatatctggtatatccatgtatcctgcgaaccttgttgactagattcattaagatggaaacttattgttccagtggtataaaacacctgcaacctgctctcactacgtttgatgatgaaatctagactttttcgcacatcttcagatgcactatgttgtgttttccctcggaaagcagtagttagttcagtagagaatgcaatcccgggactagttgatcgagcagtactagtgtaacgaatagtttgcaatgttgcttagtgagatgctgcagccggaaaaacgactgctcccggacttgagttgtgaagtgatagctctcttggcgaagaatgaatagtagggacagcaggtaaagcagttgggacggcctgtgaagctttcgcccttgcttgtcttgtcccaaagccaactctttcttttaggcatgcaggaaaagctgttccaggactaccaaccccagctactgatttcttataagcatcccccgacccagcgagtgatttgtaaagtgctttttcccctgtctcctaggatacccggctggcttgatttggttggtggaattgtttcaggcaaaggaaggattctatatgtacagggaagcgcggtaccatacttaagtgggtgaccttgcttgggaattgcactcagaggaattctgcccgctagttcgctttcattgaacgaaagaattcccttggattgaagtgaagtgggtgcattgcctgcaaatatgaacttctttattggacactaaagggatgaaatatcctaagcaataaagatgttactattgatactagcactagtgggactgggaacagctatggtgaaaaagacaaacattcggtaatgtatcttgcaggctttctaacacaaataaaataataagtgaagcctacgcatgcataaggattgaggagtcatattacaggtatgagtggaatttgaccatattcccacaaggacttataataggtaaactaggtatggagtatgtttttttttaacggtgtaagttttccgtttttaactcctggtactgtgcaaatccagtaagttgcccacatccacaagtcttttttgtcaagatattgtttcaagtgtggtgtcatagtttgatggtgttgcacctaagcatgatgcactgctgatgcactagtttggttcatttgttagaccgctctctatatgcgttcaatgaaagcaggatcaccgactctatgccaagttctcaaagtgttttcttatatagaaatcaccagaaagccccgaccgacgttctttatttatagaagtaatagtagccaaaagtgggatgataacctttttcgacaccaatcgggctctaccttccttctttccctcctcggcctccgcctctgccggatcgagatagatgcccatcatgccctttcctttccttcaccagtaaagtaagtacttcccatcctcgtccctgagcctggtgtggatgattgctcttcaaaaagagagtgaaaaaagcatcaatatgacacatcagccaatacatgaaagcacaaagccccacgatcatttagtgaaaaaaatatgtatcagcctcccaaaagaagttgattttgtcgagttaagacaaagaaaccgaaagatttacagaggaagaaaaagcatatcgacacgggctcctacctattctggtgtttacttcatcatagcttgaaaagatgagtgctgaaaacaagtcgtcttccgtacacctggtatacagtgagtacagactgagacgtcatacgcagagactgatatggccggtaatagacaacaatgagaataagacgtaagagagagaacggaaagaatgagccgcccccaccgttcacattattcaccgctcgttacatgtcttgaacttcctcattcgaagcctgaacctataggttcgttccatgtcttccactctatacaccactccaggccgccaaggttttacttttcacattatttattatagggaggccttgtgggatctttcaattggtgtactgctactaccttaattcaacaaagaagcccattgcaaccaaaaatacatcggtgcacgagcttttttcatttcgaatagagcttcgtgagatgagagaaatcgaagttgaacaagcgtatcacgtagccacagatgatcttgtctctgccacatatcctttcttggaacaaggcgcctcttctaactcagtcggctagcgtgcctgggagggaggcaaagtcgtacccgaagaaagtctattgaagaaacttgggaagtttgccgttggacactaacgggaaacgcaaaacaactctagatacttgaatgtgaagaccaaaaatgccgaacatgcattcttttctcggttgcggtgtacttggagtgaaaagagggaagaagccggaagaagaagcccccgaagagatagatggaaagctgtgcatgagatgtgctttctaaagattgttgggtatgtcttgatgagggggttaaccaaggatgtcaatcacaggtttttggggtggaaaaagtgaggaagtgtgtggggcggcggcacctcctgatgagcaaggaaggctctctactggactggaaaagttgttgacacctagtagcgaagaacgaaaacatagtagattttttcccttacaccttcacctatgcactattctctactgttttaagcatatgtgcttgggtaacttgctataagaattctttcaagacttgaagcctattttctctttaggcccagaaagaagatttcttttctttgctaattcctctcaatgaaatttgccatgttgcactaagttacttacggatgtatgcatgcaatccgggaacactttggggtgaacacccatccgaacaagtagggtcaatagttcagcatttaggccgtaacatttagcaaaaaactaatcttaaacccaacaagtgctctccgaaccaagctagatagtctcctatcactaggctcaccaaccaacctggacttagattctttcttattattctaaccggatatcaaaatcataaggattgtttccagccaagagttcccatatgacataagcgctcttgggtggggtgggccctcattcgccaggtctttgagtgcccgtcgtaccacgtggttggtacactaggctgatagagactttactttaaggatctggcacctgcgcccgactcggtctgccagtgaattttggctctacgtccggtcgggtatgttcgcattcgtacaaatggaaggcatcgcgtacgttaaccttcctttattgggctgggccattccatctttgagaaggggcccaatctcgtatttgatggtcggcgtggcaataggcttcgcttcgtagactggtttcccagccgttgcaaagacttcgcgagaacggtcaggggcgcggattcgccaagctagggcaaacaaagccgtccggccctaccagattaagaatgcgaaggcctttccttcgaaaggagaaaaaaaaatagctatgctattgaccgaccctttcgtatttacttcgaatcaataggcctatcatttttcatgaggcgggccaaatagagaatgaaatgcaaaaaataggggaaggggggatggtcgcgcctttgattttgtttaagggctgctcgcctgactaaagtaccaaaggctttcacggcttccacccctaccttagaatctaagccctttgaagcgccagtagttgtagctgtgggtaaggttttcgttcaactcgctccgggttccgatctatatgacccccagacaatacaaagtacacctcttccgtagaggcaagctggtagtaacctaaccttttagagtcgggggagccgagcccttaactctatcaatagaaaaatcttcgtgcgtggcgtgagttggaatcctagaaaagatcgattgagactccctccccggttccacgaagatctctacgtacttgtctagtccaggacaactgggatcttccggtctgcgtgcgtgggagcagctgaaacaaagaagagtctggtccgctcttcattcaggcccttccttctgtcaaacaggcccctgctacttcggagccgtctgtcaatcaggccctaccttctgacgtagctaaggaagcaggcaaaggcgcgggcttcttctcgtctctttttggatgcctctgttcttcacagaagtaggagtaaacagagagtgatctatgccctggctgggcagagcgagggtgccgctatgccccgcagctctgctgcggccggcccccagactatgcaaaagaatcgaggccgggggatgtcgtccatcagggcccccgccttacaaatgggccgtcccccttaatgaatcgaatggtccttcgaccctcgtttgattccgacggccggcatagatgaaatcccatgagacccgcccactattactacaaaaaagccctgcccctggcaccttcgctagacggagagtaagcgacttctattagcaccggaccgtcgagtcgaattgatcgtgtcatgtgcaacgtccatcaatggtggttcattaatgtccatagatttagactccttcccccctcccttatacgcaaaagatcgagaggggcccaaaccaaaccgagaacgtaaacagaattcgactcactctcgtatggctcgccctcgagccctgggcgagtcggccgggtctttccctcttgttctgtttccgccacgataaagacgcacggaagaactatggtatgcccagcgcagcgcgtggaggatccgttgagagtgtcccttgtctcggtagggaacagtacctattgtcttgaaaaaaagtcagtgctacggtcccctattgtttgatccaatattgaccggtgcggatcacgttctactacctccggtccgtggttcgacctcccgtagtggtccttgcttttctttttgaaagctccgcggggccaatttttcgtacttgctcagtgtgcccccctttcgtcgagtgccccgcccggttcacagggctgttggcctaccaagcaagcacttgcccgcagctcctgccgcctgccaagcgggctccgcgctcgttatcctgactgttctctctgctgggccctttcctattgctctaaccataagctatggcaattccagctcgcacccactctggcccgcccagcgaggcctgagtgagctcagtggtcagcccctgacgttaggggtctttcgcttttgccagatctatagagatattacgagtcctccgtcccagattccctcgccgcggccatctggttcaccggtactaccaaaaagtctcatgcttacgttactgtgactgatatataagtatgatcccggactacgaagacccagtcgtgcttctggtttccattctcatcatcatattgaaggaaactcctcgtgctctgccataagaacttggagtccgtatcatggtgaaggtaaggtaacgctgtgattcttgctcaaaaaactgaccgaacacgttcgagttattggctcgtccgacccggacgcattcatgagtcgctcgttcaactgtccctcggagacacggtcgagaagtgccatgcatggtcgcccccccccgtcctttctttctctcggtcccaccagggcgggcccctctggggtaataaaaaatggataaaaaaaggggacttctgctacgggctatgccacccattacttatgagggaagtcgcatccgtcccatcgcaagcacctacaatgtcatgatcacattggtttacccttttttggtagttcaacggacggtcgcccctccaacaagaaaaggtagaaatatggaaacttctctgccatttagatcggagaatttatagaggaaatcgggttttaaatttccagaaaccacacgattatatagccaaagggaatacgccgcgcctaaaatcatcccaagcgctgctaatgtggctactaagctatttctttggaaagctcctactaagattagaaattccccaataaagctgctagtgccgggtaaactcatattggctaaagtgaaaaagaagaaaatggtagagaaattcggcatggtgctcactaaacctccataatatctaacaagtcgagtcttatgtcggtcatatagaacaccaacacatagaaaaagggctgaagaaaccagtccatgacttaacataagtaaaatgctacccccaattccctgtatgttcgatagagcctaatattcccccagagtacgccgcttaccctccgaaccgtacaagatagttaccacctatcatacggctttctaactccacttcttttctggtcgttccgctctgtcggatcgatggtagtctcagagatctggtaacctccgacattttttacaacacgcttcctgcttccgttttgagttgcgcatctttccccccggggcatactatactatagtatcacatcgtagacctccaccccaactctatcttccttatcagtgaaccggaacatagtgcataggtactcttcgatgctgcgaggacgagacgaggtgacatactacgatcacgcactgaagttctgcccttcggctcggcatatggaacctctcaactgctccctcgggataggtaggcccatcccccacccccctttcccgagaggcggccgggctgtgtttccccagcggccacccagtggcggcagaaaacgaaaaagggtgggctccgcgcggttcgcgttttattgtaaagagagagcttttcattctcttatagaagcccgcgtccacgcgggtaaagcccagcgaagctgcagggagcactgagcaatggggggatgagggcgactccgcccacgggttggaccacaccacaggcaaaagtccttccacggcaagagaagggtgaccggaacaagaaaagggagctagtcgttggagggaagacaaggctcgttccgtgcgactccacagaagagtacgcgcgctagaaaaggcagccagcttaaaaacgctagctactttttttttagccttatttagtttggttgcctacgcttgctccccggcgcgctacggcaacaccccctgcttgcttctttctgttcgacgcggagctcgcagcctccccacccttgcttagcgttccacttgtgatcctggaggatttggagaaatgcgcccgaccatgaagaatggattttttcttatctttcatgtgaacggccctatcttgtaaagaatggtttttcgtgctatagaccacgttgagaaagaccaaccaacaacacaaataaagcccgttccatttgggtacctcgaaagggaggtgctctttatgatgctacggacggctgtccgaagtgcatgcaatgacgggctcggataggataggattgtgcgcgccgggcccttcgggtgtccatattttggccgaccttagcgtaggcccctatgttatgcggccgtaatatttttataacttccaccgctgttacgccagaaatccaaggttccacacgagctcctgttctgcggcgtggtggcaggaccgctaggggattggctccgggtgtaggtagggtcaaatccgcaggggtcatgcaaatacataggccccttcccttctgccgagttgtttagaaggcgctttccgttctacggtccctcggagcgaagggttaggcaggtagtacgggccctctgacttccagctatgtgctgtgtgcgactcccgcgaagcgaatgaagggaagctcttcgagctttctccgcctgcggcttatgtagtggtcggcattcctacgtgctccgactgatccccacaggagattatatgaggggtcttggaaactgtcgtgacgctttggtgacgaaggtcaccggggtgactatggaaggattccgtggtagtctctgactccctccaactcaatcaatatcaagaacatgtcgtgagcatgggggtttggccgactactaaactatactattggctagggctaggctagttatagcttctatagtgagtggcccttccgctttgatctagttgtagtttgtattgtactaaattgaacacatatcaaagaaaggcgatcaatcaataagtagttgcccttctccggcctgggaaaagcagcgaactcgttaaactaggggcttttttattcatggctgttgtattgtatattgtcgggggaagctactgcttctacgacagctccgcttcctcgtcttgcttctactttgcttgtttgcgcgaaggcttagagtccttttcgctaggtccaaattcgtcaaagcgaaagatcagatccaacggaaatcccgcatattgagcgcagctgatatgtggctactaggcgcgatcatctcacatgccataaaaaaatacttcttttttttatggcccgtcatataaagatagaatagatatggatagagagacattctattgaatcgcgaaatggctcgtcgatccaaatgaatcattcttctggtctctctctgccccccgccccaaaactgacccacgacactgcgcccattcgtttcgcgcgcgggaaggcaacgaagttctgttcaaaagaccgcagcggagtggagcagccgcgacacgaagttccttaccttagctggatctcgctggtgccacctaaacggtaggtataggcggcggatgtctgacgtttggagttgtcgttcgtgcacctgtccccaatagaagaatgagtgatcccttcccctgcgctgcggatcatggccttaccactaggtccccgatggccagcgggggatattcggtaaagcagctcacgttcgtttgcgctgcgcgttcccgctggaccggacacgtgttagctgtaggaagtatggttacgaaagtgacttcggttcgccagttcaggctcaactcctcgctttacgttagcggacttacaggtcgggccggggctccacgctctttctttctgtgtgggacgatgccggggaatgtgtcgaggcggcgaacaacaacaagacaactaactacatttgctttttccccccatgagatgcgccagtgcattggaccgatggataatagaactgagctggccaaaaaagcgcttgggcgctctacatacgatgtagactccatcagatacatatcgatttctttctgatggatccagaatagatagatatcttgtatcatcaatagatagaaagaggtcaacccttattattgatagattccctttcgatctatcagaacagatcaggccatctatatcaatcgatttaaaaggttcatctcgcttttcggtcatttcagccacgctataatagccgccacaataagaaagaagcaagcgaaacagctagaagcgctcgcttcgccgcgcccaacaattcttattcacgggaaccgaaagattcgattcggacttcgtagagccggtgctgctgctgtctgcgtagggccgtcccccactcccgccccggggcgctaaggggttttgttttaggaacagacggcggtgttttgctgacgcctcgaatcgacgcttttgttgcgacatgctaagttttccccctattgctagtaggttgatgggtcgcacgcccggcacacatgttttggccttgcttgtgtgtccataactcaaaataggtgacctaacggccgccgcccgactaaacataccaatagtcaccaaattcatatgggctactgaggagtaggcaatgatcttcttaagatcgatctgtcttaaagtggtcaaggaagtatatattatagcaatcgcgcttagagtataaatgaaaggagtgaaacaaagtgtcgcttcgggaaacatgggtattgaaaatcttaaaaacccgtaggttcccaattttaaaagaattcctgccaagatgacggatccagccgtaggtgcctctacatgggcttcgggtaaccaaatatgaactggtaccataggcactttgacggcaaaagaggcgaaaaaagcaatccatagaaggatttggcgccgctcactaaattctgtggttaataaaatttgtaaatcggtggttcctgtttggagaagaatcaacagaatagctaatagcataaaaacggatcccagtaaagtatataggaaaaactgatatgctgccttgatctttctttgtctcgaaccccatacccctataatgatggtagagtcaggggtggccccaaagcggaattgaccggtggtggttggtcgaagctccagtgggtagccactcccttctcagggaaccgtacgtgagacttccgcatcatacggctccgtcccgagcttccgtcgtcggcccttgtcattagaccactatgcttgtcttttccgccttgactctcgaatcttttgcttctcgggtggtggcgaaccatgctgcttgcgtagcgggagatgcccgcccgtcgggcccggcctgcttcctgcccgaaagaaggctagcaggactagtggtagggccgtcaaaaaccctacctttcgaacccgcccgttcgttatatctaacgatagagagatccgtgaaagtcattgccttatgttatggtcgccccccgactgacggcctttacgcaactacgactactgtgatgtgagcggttctattggtttgatctttccggcctccacttgtacgaagatgcatgcataaagggacccgcccctttatttatctttattttctttattaggacaggaccctaccctattctcgaaccctccgccgagctctaccctgcccgcatttatttggaagggggccaaagaaatgtctccacctgctgccaacagtctttcttcggaattctactgaatgggtcgatcctccccccccccccgtttgttttagcaacttatcctaaggtctcttcgccaagaactctccggcaacgacagaggaactaacctgcctgctgtggcggggcggcttttttttaaacaataagacctggacgattatccctaccctcggtagcttacgagtttacgtccatccctggtcgggtacagtttcctttatttttatcccttgtagccgttacccgaattcgcgcaagtgtgtccacacccccccctgacttgacgaggaatccattctcgcgaacaaacacaccccctacacacacctaggagcaccccttcctgcatatccatacaagacctgagtaggcgggtcgaggtcctacgaggtacccactactcggagtaccctcccaccaaaaaaagatgtgtggttcggtggttcgaccagaaatgctatgcttacgcacaagactacccctcttcccgaaagcttcgcggggacctttactactttacgacgacgggggaccgcccgtagggggtttactgcacaaggcccctgcagaggaaaagcttgatcccagcgaatagaagatgctcagctccgcacaacatagggattggcacgctttcggaaagaacatagaatagtagaggatccagcatgcaggacacggcgatcattagaaattcacgaattagaaatgctgtaatatactctttcccaaaacttctcataccagaccaacccactgaaatgcaaatagggatcagaaatgtggtcaatatcacgaagaataatgaaagaccgtctatacccatatacaaatggatgttttcataaggaagccatcgaaggctttccacaaattgagatttggccgtagaaggatcgaattgtatccgaggaacaaggggatacaaaaaagtaataagagaaacgcacagaccaatcaatcgtatcagtcttattgaagaatttggaatgaaaagaagagtaatgcttcctagcacgggacagagaataggaccacttagatcgaaatagcattcacagaaatgttctaacatagagtagaatcgaacattgaaaagattagttgacaacagtcaatcaaaaaaaagatggggcgccaaattactaaacaataggggtctttctgtgcaagtcagctgaacaccgtaattgatgagtgagtaggtgggttaggcgcacccctcgcccagtgggaagtcatgaggctagcccccctgaatgaagaagtagtggggccccctgcccgcccacgtatgcgcctttatttagattctaactaaatattatactgaactttatccgggaatctttctaaagaatccatctggcaaaacgcaatttgtcgatttcaatctaaggtgcaccttgcctttttcaggtagctttgttacgcctattcagctaggtggggcattggtcatagccgaagtcgaagggcaaaaataaggtaatgagatgatggtgccatcaagaagttttcgacgaacgtagtagcggccaaaaatgaaactcttgcatgaaagaccggacgcaagatgaatggcgttggggtttttcaaatgaaacccgtgatcagaaagtcaccaacggagccatacaatctatctagtagtgtgccatagcacggtataatggtcaacgactttgatttgttcgtaccattctgtcatcgatcactgctgggtcggttggtgagtcacccaaaaaaagcatagaaaaaggtcaagcaaaatgatcagcggtctcatttatgctatgccctgcatcgtgttcgtgtgtgtttttgagctttcttaactttcagcgccatgcgctttgctccgctttatagcatagagagaccgaccgttgtcttgagagtgaaaagcaagcgatagaaaagatagtccctcgcgcgaactactatggtgagatcattagtgaaaaaaggaccaacgacaatcaaatcctaaaagagaaggaggagtcagttttctttaaagatcgaggtgtcaataggacaggacaattatgccattcggaagaagtcttatacagagggaaagcctgttacgagtaagtggagaggaaagatctccagagattcttatccagtggctcgaccagtaaccaaggtcgaaaactcgaccatggtttcccggtagaaccccatttcgcccaagttgttgcggaaccggaaaaagaagcggtttttcgcgcagcttgctcattgtgctggtcccacttttctatttatttggccgaaaaagcatcggacaggttggagttccaaccttcttgggactccatggaccaagatctgctttcattatatgggcaataccaatctactaaagtagatcatatggatgtagaaaaagctttagattttgtgatgaattggaaacatctcttttccatttctatttacctagttcatatttttgtttcgtgtgttctcgggaggaattctatctctaaagaaaaagttttggaagatttttttaacctcagcctagcggattctccccgttacctggacctgcctcccccgcggtcaaaactctcctctccagcccctctggctgggccagaagcctcgtctcctttaactgattcaagtgattcagtcaaaatgaaagtaatctcacagaaaattggattatctaaaacctcgtaaaaatgacaacgctaaatcgaaagtcctttatttatatacaacacacacatattcctttcaacttacgaacatgaaaatccagtggatggtttggaaggctggaagagtgaagaaaggttctttacccccggagaccggctttcgtgaaagcacctttgggcgatggtttctcgatcctctctctcacttgaaggaagatagccactatataaatagatatatatatatccatttatttattccaaattttcagtgattttttaggtggcgactctaaacccctttttcttctacttggttgcttaggtggccaaagtaatgatgatgtggcaagcggtgccaaaatgcgggcgtacagcaggcgactccacaggggaataaaagccttaaatcaaaggtttttggcttataaatataaatggcttgacttgaaaattcaccaacattcccatttctttcctttgtgaaaaatgtagtttgtataaactaagggttaacctatttgcaataagcacacaccacctcactacacctaagcattgcatgcatatgcgtcttgcatatctggaattgtccccaaataggaaaacctggtgggaagtcttggttggcatggtccagggggccgagtcatactatccccaaaaacccaccacctgctgtcaagtactcctcttaggagggtataccaaagtgggggtgcatagtaccgcttgaccagtccgacgtcctagagatgaagggctgggaggtatattttaaagccctcattgctgtgggaaccttaacttgtcttactatagcctaaattccatcatgtagtggccatagaactactgaagtttaggactacccagtaggatgcacctgagcactaagcaacactaagaggtgatttggtttttgtttttccttggcatgggaaaagatggattagatgctctgtgaatgtgtggctaaacctgtggggctgtatggtactttagctggactttacaccagctctattcactgatagcgttactggctcttttccagcatttcttgaaagcagctcgcactcaccgctgcgcgcctagttaggctttgaaataataggaacaaagatcttccgcaatcaatgttgtactcaaatcctctctggccggagagggggatctcttaagcagagtattccgagtctagggctagcggaagcgttgaagagggatatcgttttcaaagaaggcatggggtcctttcgtctttgtagagactttcacaatataccagtggataataccatccaagagagaaggcccataaaaagaagcaggcaacaaaacatcttgatttataggaatcaacgacctcgccactgcaaaggaggaagtcgaatgatttggattcggacaggctgtctcgacagtaagaaatcgacatcatcatctgtctttcatgatggtgggaggcaagatttcgtggtcaagcacaaaccaagcataagtggatagcaacttatactatggaggcagagtctcctcccctcatttctgggctgcttattcgtcatcacggagcaacccggtaccttttcttaggcgagcgactgagacgagagctttcaattatgccgttttggtcaaatcccagggctctttctgatttgattaaatacttctatcatttagatagagagtgatctttccttcttgtccgagaaggcaacaaccatttcatttctttaacccggattgcattatttaattgatttactacgtcgtgtactacgtattggttcgcgaatgcgttgcttgaaggaaggaagcagctttagaggagggatgccgtcaaaggggtctgccggatttgggctttgctaaagataccggttcaatatgtcatttccgaaaccgaggagcacaccgctgggaggacaactcaagcaccaaagacaaaggtatcgctcgtaaaaggagctcgcatcgtagtactcgctctagcgttaggttcaatccagcgttaggtaggataggcaggtattctagggatatgctcatccgctgcccgcgtaaggttcgtatctgtccaaggacaatggtataaggttcgcatcttcccaaagccgaagaacttctttgaactacagccaaggcaaatctctagtattggtaccgggggccggtgtctagggataggagccgtcaaagggctagtcatcgctagaaaatccgaaacaaggctatcgctatcccggggcgtagcataataggaatcgggtaattcgctcgtcatttcatatctctactcaattggctaggttgcctccgaggagccgttgattgccgttaccgagcccctctttttctttctttcaagagctacaccgcaagctcgtctcgcaagtcgacgcatctagcaatgcctctgaaatccaggtacttaccatctgcaaaggacctgttacgcgctgcttgtgctaagtcacccaatcgttccccacaacattctcaatggcaactgctcaggcaccgtgggaatagctcagaaggaggtgataagcattataaaattgatacgaaggatatccgtagaaatctttctattcgtagtagtctaggacccgggctttggggatgaggattcgtattcctatttctttctttggattgagcgacaaaaacaagagtgagaatgcaggattgaagttcagtacttgcttactagctttctacttggcagggacaggggttcgtggtagacttacttgtctatgcaggcgtgaaacaatcttcctttcctctggactttatcatcattatatacttgctttaccacttgaattagatcttctttttaatacctaactactattaaattcctttcatgcctttattcacaatacaataattcaaatctcaatcatgtgctttgccgaggagagcgctcgctacccgatccccctaagctaatgtagttcccaggttgcctactagataccgtttacggctatatccgtgtaggaagccgaggaaagagataattgatagttgccaaaaccacgtaaaagaaatgagattgaaatatgttcaattcaacaaattctgattgtttcattatcaaatgcaagggatgtgggaccaggttctgttattggagttaagcggtgtaggagccgtgccgttcctgtgtattagctcgttgttagcagccccgaagggcgtaaagggggtaaaagaagataaatatttctcggaagcagctcttcgcctgtgggaacttgctcttttcttttgtttgaaaatggattggattgtagcaaagacccgttttgagcccttggaaagggtattatgggttgagtaatagtgttagtatatttcccttgcccgaggacagtctatcgatgaacggatactaggaatcgtaggaatagctccccttttcgtaggaatagctctagcgctcgctacgccctcaccttttcaatcccatgttgatgtagagtatacttcaattgcttcgaacaagagctaggtgatcatcgacagcttgggcgttgctggataataggataggggattcaatgaaaaggatgaaatgaagagtatacccacgtcaacttctgctcctaacgtatacgaatggttcttatgctcgccaagggaagggggccgaacccatatccgttacccgaaaccaggagttaaaaaactagggatgcgggaagccattggaaaaagatatgcgaatccgctggttaaaccctttcttcaaccccttggtatgatacctcctttccctttgctttgctaaaagatacccgttccgctgttccattggtgctgtgccttgtaggagccgtcatcttcttctttgcttcggaaaagtcatctgatttatttgcttcggggataggaatgtgcacttttgttcatgtgcacatcaacacaatccgggatgaatcaaaggcatggaaagggaagagatagccctacccttcagtgaaccactcaaggtcaacctacgcctgatatccgcggttattatacgatgcagttcgtggattggcaaaacctggatgatcaaagcatctatctatggttgggggcttcaagatcgtcataacatgtcacagtagagtcatctagcttataatgggaggctgaaagcgaggggaaaccctttctcatgtgggtattagcaaggtataagacaaagagagtcgttagtgggataggtttttcttgtaggagagagatcgggaatccagacaacagggctagggtttggggctagtgcggattagtttgggcggaaagaattgaagagaggagaaagccatgaccgatagagctcgggttggatagggaaaggaagaaaaaggggtagggtcaacctaaggatttaaaacctgagcttaggctgacgactgcttcgagagcagatagaggatcctcttctgggcatgaatctggttttcaaaaagaaaaaacctttttactaaaccagatcgacgagcaatgaatctaatcgcagaacgagcaatgaatccccaacgaacgccaaacgaacaaaggctcctcttcttttccggtgtatccttcgcccaaaagttcttaagtaaatttagaaaaagaacctaaccgtcagtctgaactcccaggaaatgaatagctgacagaaggagtcactgttaagtggtttctgtgtgtgctcttgaaagcgcggctaatatagctcggttaatgtagtgattgtgtttcccttttgtctagtggattaatcatggtgcaattgattggattatataagcatgggagttcgctaaagtttacaccctattgttaggccttattctaggcttgaatgcgcaagaccgaaactcaaggcgggggagataacctccgtttgctggatcttctaggcacttcaaacagaaaatctacttatccagtaacaggggacggaacataggaaggagacacgtgctacgaagaaataggagattgtcaaaaacagggaaggctacggatacacatggtgctaggctaacaagtatcttcgtttgaccctggattggggttaaatttcctatgtttaatggaggggagaacgagggaatgggttgacaagtgcgagaagtatttgaagttgttccaaataaatacacttcaaaaagtgaaaggagtagtcagagaaggcatgggctggaatgagttcttgaacgaaggttttgataggtttgaccaggaaggagagtggaaattgctcaaacagtggagtgatgtggaaagaactaggtgtcggtcacgaaaaccttaataagaagtgaggagctgattgaaacataaaaagtgactgatcgtaatcttagggcaaagagcagtactcttatatcagtatcatcttccctttcttttttttatttaactgtcgccttcctttcctatcaaacttttctctggcccatcatctcgtgacaagaactgctcgaatcacaaaaaaaaaggcatgcactaataaagaataaattcctgtctcttctaacaaacctatttattgaacatctgaatcccgatcctacttgcttgatgttgcagttacagcagtaggactttctcttcctaacgacgagcagcccgatgagcgtatcaatggaatgagccgtgccgaggcaacggagtagttcacagctactgtttccgtagcggattcaatagctgcctattcatgccttcaaacctcttagaggaaaatgccatcgtctgcatccaactataggggctagcaaatatgttccatgccattaattcaatatccttaccacgcttagaataaaatacaaagaaagatagaaggcgtagtcagtctaacgcatgcgagagcttctagagctgcttattcgagaacaaaagaacctagtggggctatattctgccaaaaagacgggctttccataaacacgggaaaattggcataaaggcatccaagctgtgaacaatactaaaagctgcaactcgtctgctattccgatcttcctctgattcaagtgctaccagttccttcttcaactccaggccaggcaagagccgagaagctatccgtcaaagaaaaagaatatgttcaacccaacaagcaacggattgagccactagcgcaggctgtagtttgatagcgagttcaccttcctagtaacgtttactcatttcattcattctcattcaaatctacttctaaggcatgtgaagtaccagttgtagacagattccttggcttgcgtagagaaatgtgaaattcatttctaaaagcaagagtttcttttctttaattagattataaatctgcgtaggataggtgagatgaatgaaaaggtcctcttgtccgtcgatccgaagaactcactcgattccccatgatgatatgcgtcaacgtaaggaagttgttaaactacacgtgcctttaacacccatctcgggccgggtgagaaaga

SEQ ID NO: 636 - DNA, 7710 bp, Oryza sativa
  unsure (1)..(7710): unsure at all n locations
nnnnnnnnnnnnnnnnnnnnnnnnnnnnnnnnnnnnnnnnnnnnnnnnnnnnnnnnnnnnnnaaagaagcaccaatagcttaatgcaattgctatcatgcttggagcatagatagaagaggtatgggtataggtaaaatgcacacttctaccaggtatgtgagactctttctaagtaagagagagctcgttctagctttgtcaatcgtggaatgagcagctccatccttactgtcctggtgaattaattgggtaattaatgagcacactgactcacaaagtctatagctagtctctacgaatatctcgatgcaactattaccaatagttggaggtaacttcgtgcttgaatgtattagtggaagttagtagcttgaagaatggaaagagtcttttcgtccctctcaaagagggaggggagtagttcacagctactgtctcaaataatctagtagggaatggagtgaacagcagggagtttagtgggttgttttgctataatgagtgcgtacttccagagtgaaggaatgaacaacaagcatagtagtgagtgaaaagcatcgatgttggtctgatcaatgagttaatttccaacagtaggagagctgacagctagtggagaaatgcgttcgtttccaacaaacaaggaagtagtgagtgaaccgttttagagtgcggagtgagaaaggagtagttcaatgagttcgttgacaagagtaggagagtgagttgataggtatacaaactcaatgctagcaacttgtgttgtatcgttcgtcatcaaagagagatttatgctgtgcagttgactcgagccaataccatacctagcaataagaaagtcactggcggccgtattctgaaatcgttgaagaagttcttggacttcctcttctgtacatggcgaagcggtcgtctaatcgaatttacaaggagactggatttcatgctgattactcactctttcaatgctatgtctttaagacattgagctttcctatgtctgagaagggatgccatactaatagactggccaagcaaagcctaggatgaatctctcttctagtctagcttccgcttacactgaagcttccactcccatacgggcaagaagagctccttctctttttgccaaagccctttcttcttttccttgtgcaagtcaactgttccctggcacaccgcacagttcagctgtgacatcttgcacttgtaagatcacttgcttgcctttatgcttgagtttcagcattcctttactccattcaactgtgatttgagcaaaacttgacaaccagtcaatgcctaaaataagatcataacgttgtacatgaagcacgctaacttctgtttcaaattcatggttttgtaacttgaattgaaggttgtcacatttggtactggtcaataacttacggcgagacgagcatccctataccacgtgtatccacactcgtctgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaacgctggttctatcccggccaagcaagcaaggtgaaccccggtgggaaagaaagaccagggggaagaagcggggtagaggaattggtcaactcatcaggctcatgacctgaagactgcaggttcgaatcctgtccccgcctaatcacgtcagatacttctacgagtcctgatcacctgggtgaaagaatctatgttcaagtcgcctgcctaacaaatagacaactacgtgttctagttgctctgttccgttggtccccatggaaagtgttgttgtgtcaaatcgagattgtgtgggtgttcagtctaccgctcatgttcacgttctcaaaatcaggctttcgttggaaaaaccaacgccgaccccaaacaagtctctccaatataaggagagcggagcttaaaaggatatagttacctatgatgagatttagttcaatggatatgaaggatagaagaaataaagtattttctactactctacccactcgtagcttgacaattcctccccaaccagtggtgcaacctgctcctcctgctgatctgaaagggatcttcgtattgcaagttttgatgcacccgagccaaatcttactttttttagtaaagccttatgatgttttcaatttattaagggaaggggcttctttgcaaagaaaagggatagcgctaggaatatcaatagcgtatggatagcattattccattccattgctattttccttcgtttcgtaaagtagaggggctcgcaacaccgacaaggaatgaagtcaacagagctagcgttagggataggagcagtgtcgcaatacgataatagaatgcgctttatcaaataaatatcatcttctttggtttggatatgcgattaggattgttctaaaggaaacaaaagatacctttgccctggaggattggacctttttacattaaccttcccccaaaaggagtacgaatcgctacgctctagctcgtaaaagggatagccctcctaaaggggatagcgataggtctaggaatagcatttctctagcgtataagggctcgcggtcgagggaaggtatagttgaaggtatgaggatgaggattagaatttcattccattgctttgttagagggagaggaagcttcgattggtggatacaataattccaatcttctttgccaatactactactcttgcttgctctatcttatttcaactactactactttgaatcccgttttattatctctatactacttcttatctcttggattccactgccaagcttcaacagctggtcttgtctctacttgattgagctgcccctgcaagtctgactatgcaccagcggcattgaaggaaataaaaaacctgaaaattgattagccagatcaaagatcaatggggaaactctcactagctggctagaacgatgttcgttcttacccacagccgcaaggggcgcttgaagggcactaagatccgctggcaaggaactgtgaggagatgagattctctttgccttatttataaagttcttatatagagtttggggcatgcatatagttagggcatatccttttttatgtgtttgttatctcgctgcgcgccttttcgatgataagatcattttttatctgacttggttgagtaatgcatgagatcaacctgcggccttgtgaaagaaaagttggtagactgcttctttttcagtatttgtattggattggttgaagatgtttattgattgtcttcggctttaactctttccttagtagaaggatccgtgggtggcttgacttactttctttcatcggtagcgcattgtcaacctgcggcctatgcttctcgtgtgaggagagctaagtaggaaggagggacggacttagactttaggtagagccaggcagcctgattgaaccttacaatgaatcaactattcccataataagcaagtggaacaggtacggctactgagtcgcaacactcacctacatttgacctgactttgatagtcaaacgatgtagaggaacgggcgtacctggaatcagcttaccattggaactatgcctacgcgacgccctccccggaacgcaaatgccctctttcgcttcgcccttggtccttccacttcgtgtaactccgaatttacctgcgaataaatcggaaaggcaagctttcctcccctaagagttctttctttgttccgctattccctgctttcctcgttctctcctcgagacagattttcactacaaataaccggatagagatatttccttacttatagagccagactgtgctttaacacacgacatcccagtcagaggggggaatggtcaaaagaaactcgttccattgaagatcttttacaaagcactttcaaaaatgtgcatgatttgtgcaatgcaagtcaacttagaaagagctcttcttttccaaaaaaaacacttctctctcgaaaacaaaccacttgcttgggcgggcatcactttgcctctttaaccatccctttacttacttggttcctgatccgcacagacacatagttagggagctttcaatcagcaaatcgttgctgtgcgtggtggtcctctcatgtctgggctgcccctctcttctgtttttgcatttctgtgcagtgattagtggaaatagtgctatgacattgatttgttgccaatgagaaaatgcatagataatgagctgcgccccctcaaaaagcaattaagtgagctcaggtccataaagaatagaatagaaagatcgcgagaagaacctctgcgaaatgagaacgtaacttgtcgcgtgtcctcgactagtagtgtctaattgaaaatgtcttcttacgagatgagtctctggtactgttcctgtaaaagtgccagtactaactggtaagtcggctcctggaaaagtgaatactttaagggactatcgagctctgtttatgaaatgctcgaaatagctcagttcgagaaaggggatagagaagagaaataaactattgatcgagggatggagaaggtgtgggcccgcttactaatacggttccgttccgcatgaaaaagaccaatcaaatcaaacttttcttggaaaaaccgacgccaacgttaagatcagtctcctttcttttcggcggcatccttccgcattggcggcgagtggaagagttgggttcgattccctttatacgcgatgtggcgaaaaagactgattcaacgaaatatgccatgcctgcattattacttaccaccagtatctcgggaaacggaaaaccggaaatgacaatcctttctatggtctatactaaattactttgtacgaatgcacatctcggcgggcgtcgggtagatgctcaccatttcaatgtctatatctgtggttccagaagtggaattgctattctcgattcagacaagacactgatttgtttacgaaccgctcttcattttataggatctcccattcgtaaaaaatgccgttccttccttttaaagaccaatcatttatttcgatgtgagatattggaaaaaatggcgagctgtatcaatgattctcaatggaagatcgggactttttttagcaattatttggctaaaaaaaaaaaattccgtttaagaacgaaaaagataaattttgggttgaaccaacaacccgattgtgcggttattctgaatgcagatagaaagtcttcggtcatactggaagctgctcgatcacaaatacctattgcattcttagttgattccacgatcccaggggaatcccataaaagaatcacttatcccatcccagcgaatgatcctatacagttcgtatatctatttcgtcattcggtcacgaaaacagggattctggaacgtaaatctgtgcacgaacccatgcaaacaggcttaaaagcagtggatagcctggttcctataggccgtggtcgacgagaacttataatcgggggcagaaaaacttcaatctgtagcgctacttccagagttaccaaaactcgaagtatctatactgcggctgacagcgaattatttttagctgtcctgcctttcctttcggaaatgccagaacaggtagtttcaactgtggagcccttcctttctacaatcccggaacaggtagttccaacctacattccacaaatgcaaaattttataggtgaaactactaccagtctaccccagctacaaggggaggctggcccgagtaactctacagggggtggggctgccccttcttcttcaatttatctggcttatgcggccgaacacgcatctttcctaaaagcaatttctgaggagctttaccggagagtaggggaacaaatcaacttaaagagtcccctggacgaggagaatataaggaatatagtctacaagatcatgaatgatgattttgaactcttcttcgatcccatagaagatttgaaggactggctacaattcattaaggcgaatccccttagttttcaggatcttatacaattttggatggcattagccaaatagtcgatggggatgggggatccaccagtaaaggatttcaaagaaagaatggttgggatgggggtatcatagatagggttggggacttcagtgattcatttgaagagcaggattgggtggccgaccggcccgcagacgtaggaaggcttttatcgccgactgaactgcgtcaccaaagtcgcgatctgaaagagacgtctctttcaggaagggcaatgcgggttcgactcccgctcgtgacaagaagcaagctaggtatgctcgctagctgaaaaggcaagggaaagagattctgattcaaacccaattccgggagtgaaatagtctgctgtgatagaacctggcaagggaaaaggaatacaactgagcaagataactggattgaaccagatgccgtaaagagtcaaagtaaaatccattagcgcccagaggcagagcaaagagattcggagatagaagagagtgggaccacttcgaagtcaacgggttaaacatagtgcgagttagacagatcccacatctcaaacgtataaagaagtcccttctcttagactccaaaggcacgaactacggctatgacctatgagctagggggcatccacctgtagtacaccaaactctttcattgtcttgaagcaatctatattactttagctgaagattgatttggtgggtgtgcagactatgaaccgtgcggttcgggtgagagtagctgatgctggtgaatcgaagacggatcatagcagtggagtggaggttctatggcagaagccccatatttatgaagaaaaacaagttctaaccgcattctaggagttgccacgagtgattcccttcaaaacaggtgtggaaaggtcattagaggctcctctggaggccatacaagaaggatccttaattcattgcaaggcattctccaatccccattcacactctccttattcatacatcagttcagctacaacaaagaagatatcctcccatacaatggaaaggagtcgtcgataggcacactaccttctccaaggcggtgcacccatctcttcgagaaagaagaacaagaaaaacaagagtagtatttctccccgaagggaacaagataggtgccatcaaacaacgaggggtttcacggtcgtgagctccattccaattcaacagattggtgaaacaacctagaaaaccattgtcccctcaaaccggtaataacttgtcccatttctgcatccgttaatgatttaagaaccgttcgttgagacctcaaaagataagaaaactgtccctttttgtcttgcctcgataaaacaatgaatgggtaaagccgaattgatctgaccaaccaaacatgggatcttttgtttgatactcaacacatgagaatctaggaggatactgattggcgctcaagaatggcgtagttaatgttatgatttgccagcattctcagctgctgattctcaggctgattctacttggttggtagaaaatctacttatccaggaacaggcgacggaacatacgaaggacacacgtcctacgaagcaatat

SEQ ID NO: 637 - DNA, 29638 bp, Oryza sativa
  unsure (1)..(29638): unsure at all n locations
ttacttaataggtattatgaagggggaaatcaagctttatttctctttatagtgaagctagcctcttaggcgcagtgtcagacatcttagctatgtagggaatagcggtcagtgctgcttgattgagtctttgtcttgcagttgcaggagtgatgtcaaacctcttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgagggttttattttaaatccaaatcgaaatgcctcaacttgataaattgacttatttctcacaattcttctggttctgccttctcctagtaagtagctcacgaggaatggggggacagattccctcaatctcgagatacgaacgtatcgtgtcaaaatttattggaaaatttttcttcagtggtttgttagggaccgatagaccttaccttatttttatttttatttccctcatttttttgggactttatattgtcagaaggaggagggaggctttttcctctactctaattggatccttctctggtttgttttcgtttttttttgtggaaggcccagaggttgcttccgctatggagaacccaccagggcctgggcctagtgaagcgggtccttccggatccgctgcgggcaagtcagctgaagcctctactccgtcgtcctcttttttcaatgggctttcgggccagatacccgcaccggattcccccggggaagaggtgccgcaaggggaacagccccgttttgacccttattcaattccggaagttcccctggaacacgtattcggggctgttccagatcggggagagccatccacaagccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcaatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaaattggaaaaatccggtactagctgtaatgtattcaataaaataaagaagaatgaccgtaaatcatttcgaaagaactacgaaagcaaccctgatctttcttctatgaagaaagtacgtaggcactcctcagcgaggacgcgggttttaaagtaggttctacacattcgagaagacccaggcggattggagtggttgtgcgccggggcaatctctgcttgcatttcgcattggaatttcttgactagcccgaatagatggactcgttcgttcggtcgggcggggcaaatctctaaagtggaattcgtgaaaaggtaccacactcaaatcacatatgatattatgtcaaacaaatcaactagctaaaaagctaggaatttatgtagaagtctgggctggtcagagttcaactcactactcgggctccttttcagttaaggatgcaagggagacttccatgtctggggctgacagctttcgtgtactgaatttctatgagattctcttgtccgcgggaacaaaaagctagtaaattcagtacacgaaattaggatattctagacaacgaaaagctaaacaaagaaaggaatgacaatgagtgtggaaaatccatctacacaaatccactcactacgaggaggtaatcaatcttatgctcaggcaattcattcgtataaatcactactcggggtgtagaggaaggaaatcaggggaatccccggtattaaagtagacagatcaagactagtaggaaaggatactccacgcactagagctttgtctggtcaaagtgctcattctaaggttcaatgcgccgcagaacgagtgctattccttttatgaaattacaccgggaaggaattgagcaagccaagtcatttaactcactccacttaagattgaacaaccccagtcagtgttggttttggggtaaagaaaactatgatagctagctaattcaagaaattctattccatgaaattcttcctccggacaagaaagagtgcggcatcaaaatatgaaatgaaaaactaaataaactaaaaatctctcctctcagtaaattcgtctattcgactaggaaattgaagacaaaggaatttggaattacaagacggatatcagcttgctacttctgactttgactttcaatagggaggtcaaaaactagcacttttttcgaggagtgatcatggtttgacttcgatatattccgggaagatggcttgaagctaatagcaaagtctatttcgactagcttgtggtactagctaggaaattccctaacctcgatatgaacaacttactcaactcaacagagtagcaaatgcccaagaaagcccgagtcaatctatttggaaatccaatctattttctcgtattcgtgtgggaaatcaagctattctagttgaaattcaccagaagaaatgcacgcacttcaatatgccaaaattgcaaaggaaaatccttcgattaacagtggaattcaaccaagaaatgaaaaggtatatataggaaatgcactccaaccaccaaccaataagtgattccgggcaatcaattctatccgcgagttgtggaagtgtttcatttgcctccgaactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgatcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgcctactcaacacttgaacattggtgtgtttcacattcaactctatctagccaaatatcatagctagcccaatgcatttcctcgtcgtagtgaagtgagggaaggaatttactagcttaactaacaataccaggcttgtccgccgtacttcctatatatagtattgaatttactagagcatattttactaagtggtgtgtgtagtttttacatttcctacgcttttcgtatcaattcctccctctttcctctttcaacactttggcccttttatcatataattgaattgaattgtcttggcatttagcatttgctctcttctgggacctaaagaaagtgagtgcctgtagcgatgagtgccagctttttcatagattgacttgggtgttgcatctctttttccaactcggatttaccattggcttgtcgtcctctcttacctgaccctgtcctatagaaagtagtgtgtagtatgcttaaaaaaaagcaagtttaaatataacccgcaaaaatgaaagctcgctttgattgagtactcttcttggcttgttcagttcttctcatctgcctcggtaactaggtgcttttaagctactcttgttggcaatttcctttggtttgatagtcggatcttatcttttttttaagaaatcaagccttcctccttagccttgaacagccaccgcccctggcatctcctctgtaaactggatctcttctcttaggttaaacaaccgaatctcctagctctcgatcaaacccttatcccaatcgacatccggaaaggtcgaaatcgtccgattttagcatgaaaggcgatattaatcgttcaatttcattcactcgcagatcagcttccaggtctgcttcggccaatggtgctgtttgaagctttctttctaaggaaccaaaagaggtgggtaagacaagctatagagatgttccacaaacatcttacttgaagctctgtttcgagtgcactaagcgaagaggcaagtgatgagtacaaaacatggaaaggtcagtatagcttgaatgaactacgtagtaaggtttagtactaagcatgattaagtcacggtaactaagtaccggtaacgtttaatagatagaagtaagtaacaagtaccggtttagcacatatgggtcacataggcataccgataggataataggcttgtacgcaaggtcaagtataggctagagagaaagaccggtatatgtttatgttgagaagaaatgcattgtttgatttccgaagcaaataaaggcgcgcagcgaaaggcatgcatgtttcatttgcaggtgctgccggtccagggctcttcggctgagcttactaaataaaagaaagcacggcctggtttatgggaatcgtaaatagacgaagtggtgttttttcctttccttgaggatctatgcttttcatggctctctttctaacgtggatgacaggtttcaaatagtggatcagtttcttaatagccttttctaagtgcttttcgttgccttcttcttatctttatgtacccaggaaaaagagaagaatcttcaccattaccatcaccagtatcacctccaatggttggcgtccctttaattgtcatttagtagtagataggtttgttgaggacataatctcccggccttattcatgcatgataaaggtagcctttcatagtccaaagcctttgtgtgcttttgtattgaactcttttctacaacgttgaaggattgccttacgggattagcaatggcttaataaaaggattaaaaaagggcttctcttaggtcccatactagatgaccacccggaactggatgtactcgtactagaacatttggtgattacccaccgggacttcctactaagtatttgacacttccatcaagaagaaaactataaagtactcaatcaatgcgaatagcaggaatggtacttgcaaaaaaaacatataggaccagagaaatgggaacgaggctgacctatccaggtagtgaagtctacctatgctaaagagcaagttcaatatttggttcgagtagccagcctattttcaggagtggcttattatagtattattaaaaatcatacgaacaaagaaagcctattttaggagtccaccatatcaagggaaagggagatcaggcttggccttcgctttgcttattcatctttctttctttgcttttgaatgacttgatgggtctggataataacaagaagagtcaaggtagcgaaagtagctatactctagtagctggcggggctagtggtgaaggaaatcaaatggcagagaagacacggattcagacttcttttttcaaatagcccttggtggtatgcagattcattgaacgaagaaggcagtcttgcttcctcacgaacaagatcggagcacccaaggttaggcactcgattggatgttcccgtacgtactctagaagcaagatcgcgggacgtccctataacacatcgctgacgtcctcaaggctttcgttgtcgaagagtgaaagatctcacaagtcctccatacgtcagtttctattccagcccagcaacgaagtgcccgtcggtctgcaacattccctggtacaatgctaggaatatgcagtcacagataagtcaagaataagtgagtatgtacgagtcaactcataggtttagtagggctactagaaagaggagcttgggacagagctatacaggactgcttcttgctactccaagagataacaccgctaccaagccaaaatgcgtatcccgatgtcgacttgcgttcatctggacccaaaataaccaaaaagttccagaggcatcttccattcatttcgattttggtctttctgcaccatatttagatcttccctttctacgatccggaattcccagtaaatccttgactcctcgaatacgatgggatttcacacctggcgaatctttcactctacctcctctgactaagactatagaatgttcctgcgaattatgaccttcgcctggaatgtgagcaaatatatcatgtcgattgctcaaccgtacttttgctatcttacgtagagctgaattaggttttttcggtgttctcgtcgaaacacgcaggcatactccttgcttttggggacattgatccgaagctcgagtacggtccgtgcgctgtttttcttctctaccatgacgaatcaattgattttttgtaggcatccctctttcctatgtccttcccccctttgccctttcactagtggttactcccgatccgaagcaccccttttccattcatagagaaatccaatcgtcaaaatcaataaaaaggccatcatggaccaagatccaaacagatcaatcttgttaggaggtactgcccaaggaaaaaaaaaggtgacttccagatcagggataataaataaaataggaaccggataaaatcgtatatcgaaacgacttctggcatcaccggagggatcgaaaccacattcgtaggccgacaatttttctggataggtcgaactattggaagcaaatggaaaaggaacaccgagtggaatcaaagaaactagcggactgatcactaaatagatacaaataggtgcaaattccgacaaaaatgcactttcatagccgtttatcgctaaatctatccgtattccctgaagaactgtggcgctttcatagccgtttctcgcgttgtaaacaccaaaaaaaatgttgtccatgaattcactttcttcattcaattgagctataaaatctttccataactcttcgcgggattggccccccaaaaaaagtgatagcggcgactcaatcttgtcctttggggccgggggaacggcagcactgaatgcacaaatagatggaatagcagcaaatagcatatttcttctatccttcttatccgttgaactaaatctcatcatagggtaactatatccttttaaagctctgctcccaaaacaaacgggagactttttcgttttgtggccgtggcgttgggttttccaacgaaaaacaagaacattctttcacgaactttcatgacactttatcattcggaaccctctccgtattagtaagcccacaccttcgtaacccaaggaccgacgaacagaaattgaaacaacgcaaccgtactatctatttacgataatttgattgctgacaacatcacgcttctctttcttattcttatttatataactgtcactttaccgggccggaaaagtgacaccgtcacgtctcagagtcgtatgcctggaacaagaagggtcgtcgtacaatttcggcgattcaaaaaaagaaggaggcgagctccctatccctctttgtctttccacttccctcgttcaggaacaaacacttcgccaaattcttttgagtcccggcccggtttttccccactaaccaattacgttacgaccactgaacaaacttggttgacgaacatggtttatgcgccgctaatctagcggcttgtcgagcatttgacaaactcacaccatccatttcaaatgggatttgtcccgtggacacacgagcaatccaacccgtaggatttccttttcctcttcccattcgaacttctgcgggtttccccgtaataggaagatctgcgagaactcttacccatatcttacaatttcttcggaattgtccgctcatagcacgatggaattgcccgattgtagcccgacgcgctgcttcaatggctcgatatgaaagacgaccagctctacaacttttggtgccatatcttccaaaaccaagttgtgtaccatccggttcgcaacccctactacatctgcatttactatatttactatatttcgtacgtttcggatatagcacgtcccttcttattttgactatatgagatccgcactttgacacctgaaattccgttacgagtggatacttccgcaagagcataatcgattttctggttaaatacattacaagatgtttttccatactttccgcattcagttctagctatttccgcaccccctaatcgaccagaacaacaaatacgtatcccctccaccccttttggcattattaatggaatatccttcactatttgactaaaaatggaacgaaatgagattggattgttccccagttgaaaagagatgtcttgagcaatcagagaagcactttgataaacagatttgatctttaccgactcaattaaggtattagtgtttgttctattagacaaaaaagatcgcattttttgcacttcgttcaaataagagttgtacccgtacggaattatcctctttctcagtatgatctctatcatcatctctattccctttatcaatttgcctatcctacctaggtagatgaatttctctatcaattccattaccttatccttacccatgaggttcctacatttgatccttaattgacctaggagttgttcccgggcatactcaaaaaatgggttattatacaccccaaccccatcccttggaaaaaaaaaggtagcaccgaagaaaggaaagagcgagatggtggtttttgttgttcccgcgaagcgaagatcattcgcttggcgaatgaagtggatcaacctctttttggctcgggccaaacactttttctcgctggtcgagctttctacaaaaaaagcgatgcgagagcgtattctcttatctaagcttcctcccttcgctccccccatcgtagatggttcagccacacccggtgccacgaaatgattgagaactacgacggggtcgaaatgcattttgttctttgtattaaaaaagtattgcatgaccgaataattcaaggaggggcgcacagcggggagggtcctttttagtagatgactcgtcgggccgtcattttctatcaggaaggctatgtcatttacaaccccggcgtatttcggatgcttgaaggccccgctcacccgaagtgatttagaaaaattcttctttctcgatggtgatcggtcatggtatccataacgttgcatctttttcggccaaatcctgatttcgttttgcttctcccggtcgatcgactcgactcttttccctgccccccggcctctcacttcgtttcgttcttcctctgtaccctcgcttgaatgaagacacccgatcggcccgactttcccaaatgcccaccaccggcccttatcctttccgggtcttgatttgtcgcgtcgttttagtcgtagtggtcgacggggaagaaagaaatgaatgaatgtccttttgggaaaatgtagaataatacacctaccgagacgaaagccaaaggtgagtatcgtaggtggacgtatcgaactgaaataagatctaagattgacatcttgatacaatgatttaccataataataaatagagtcaatggtgacagagccgtgggaagagccgcttcttttttgcggcgggggcttccattcaccagcgcagactacatacacgtgctctctgaaccgtgctagatagtcacccatcacacggctctcaaacccaacctgtggtggatcccgggggacaaagcaaagtcaaagcgcttgatcctttgccccatacttttagatcttcctccccaacaagcaacgggttgagcgcactagcgcgaaagcgttagcacgcgcatccgttttcttgctccgatcaagcagcaacgcagctcgtgataggcttagcttaagccgctaacgttcggttcggataagtaaagtcccttcggttggttcgctcaggtggtcttcccttattttccctaacgttcagagttgttctggtttgagaaaggagcaccgccaagtccactaggggcgccctgaatgaataagaaatggacagctgaggtcaggcttgcatgaaaaaagaagataataagttagatgtcgattacacacctgaggttggtaagaactgagggacaatgcccccctcactgggcccatcagcgaagcaactgctacttaatcgggcggtttgctttcgtgcaaggcccccgctgctggaacaggcggttggcattttcaagtaaacgccccgccccagaaggacgccctcgctctattggcaaaacgctttgaaagaagaacgtatcgccaaggccccgaccggccggcccgccccctttctttgcccgccggccgcctagctcgttattctttgagatctggatagagtctcgcttcggggcgggggaagcagcaagcgtaggctaaaaaggcaatagtctaacgttggggtagggcgcgccaaaacaactgggggccccggaggggtcagtacaaaagtactatattctttccacttactttcattggctagctgccttttgtagcgcgcgtactctgatcctcttctacgaatctacaactctctttactgagcgagacttcatctatatccctaaaagtggatttttattcccattttttctttgaatgacagcttcaacttggctccaccttagagagggttttcggttttaatcaagatagggtcaggggcgcgtcggaacggtagctgcttagtctcatccgagagtccaatctctttgtactgtgcttttgtgtctttgaataaaaaagaaagaagggggtcgatttaggctccttcccttccactgcatagctgcgctatcaggtactacgagccctctgccccacgcatctaaccagctcgcgtggttcgccggttccaccgaaaactctcatttgttgaagcggagcatagtgcggcgccgagcgagaaaggtctcttttttcggtttattcactgatctgaaatgaaacttagcacttgttttttattgattcctggggctaggcgttcgcagaatcagtctatccgaaccgcagacgcacttttcagatcagtgacggcctctccagcggagctgggcgccggggccctggatgcgctagcgatcggcacattaggggagtacttgcccgggtttctcggcctggtatccttatcctcgcgttcatgatatctacattcaactgtgccccggagacacggtcgaagcacgcccgccccgtgtgcgtctttcacgacatgctctggtcccgggtttcttcctgtggtcttctagcgttagaagaagtcgtgtccgtcccggacatctgcaacgtcctctcacgcctttttttggggggacaaacaaagatcaggaaaagacggaccgaacccattcggtgactttcgcggtcgccctcactgaaccgacttggatctgaactacgattcagatcaagtcttaccgaaattggatttccttttcgtgccatatgtcgcttagactttactttttcccctttctgtcctttcctctatttgttcgatagggtcttcgttctattctaattctaaacccattgtcgtccacagtttccttgtcgacgcgaaggggcaagcagcccccaaacaaagaactcataccgcggttgtggcttgaaggccgcatgcaagttcttcaatatttagagagtatgtgttagtacgagatcgcgctatcaacttatttaatctttctcgatgatttaagacaaaattgtatcccttaggaaccgtacatgcacctttgtttggatgccgatcgaatattgttacaatacgaaatacttgaaggccacacgcaattgactcacctacattttatgctcccgcccttttgtagactcagcctctgcctctggggaagtgctcacatcaactccaatttggatggagcttctcgatgggttagagcgtttgcgaaccaaaaatgggaaaaacccatcctccaaagtgacagtgtgcaaatcggtatctaaacaaactatagtgaagtgagccaggacaataagacaataggtctcatgggccaagcctgctatcaggcagtgagtgggaatcaatcctgaaagagagaaggtctagtgctctctgaaaatatttgattcgccgaaaaattggctttatcagaccaatccatgttcaggagccttccatcaaaagtcagtggtctaggccgctttccttgactttgagttggatctcattcttcttcccggcacaaaaagagggtagacttcatccgagacacatgggttcttttgcttccttcaaagaactcgtctttgagcctctaaaaagatgggcatagtatcccagccacctagaccacctaaaaggaaggaattggtctttggctttgagtgatccaatcattggtgaatgggttcagtaaggtagaaggaaagggcccctctcgacctgggaaattcacagcaggaaagactggcgccgatcagcgaaagcgaacccttcagtacatcgcattcagccctccctcaaaatccccatttgttttattgaggaatcactcttgatcctctaaaggctcttccccgtctataactcaaagtccatctgtctctcgtggaagcgctttagagtgcctagaagatccagcaaacggaggtgccaatgctgtcccaagaccagatcacggtaggtagctgctttaaagagggtgggagacagactggtgaacaatcttcttcttgttttctccgacctagagcactcttttttcaatcgtacgaagaaactccgtgaaaaacccagctatcactcctatgagacggctaactcccaactcccgatacattctttagagtcgaccaaaggaaaggactcgttggtttggacatagtttctttgttcctgtgtttctgttttgctctcccccttttttcacttagtttagttagaatggatggaaagagaacttccttcagcctttttgttgcctggttcggtctctctgagtggaataagtgggtccttcttctttttcctgactgatgaaggtcgaaactgaagatcgaatcaagcggagtctggattcctatgttcgtaccaactcaaatgattgatgaattggatcttgagtatgctcacttcgctactcagcaagggtgaaagaatgacaaagagactgacatcacagaggatgggaaggacccaatcgcctgcctctttcttggtccaccccctggtgggtactttttagctcacaacacgagataggcagatatgtgacatagtctcattgctttcattgacaacaagactctcttcctgattggtctgtgcaggatctccttccctatgagactcttgcttccctttgaaagaggcagacccctacttcaattgtcatctgacgactcttccccagctgtggactcagacctctcacaaccaaaaaaaagaaaagaaaaagcaaacgaatccgaatataaccaatctatcgcctttgatgactcgttgacagcctcctcaacccaagcttccatctcctgctccagacatcggcgcttgcccgcgccagtccatgaaaggtggatgaaggtgagtttgactacgaactcgaggatgctgggaacgatctcttttcgggctcccgtcgagaggccctcttcctccctttttctgaatctgggagagaggcaaaagagaagtccagagagacctcgactctttcagggaaaggagggggatcgaatgcgagatggagtccctgccgaatggaatggacatccttggggacagctgtgtaagactgaatttaccataaaattggacggaaaaactactacaaagatcacaagaaacccagctcaaagtgaatggagagagaacccctgtgccttggaaggatctgaagctgttcggacactcatagacaagtgaactccaatccaggatccctcgaaaagtgaagtgaactagccaggtagaacagtcaggttaggaaaagagtctttcatgtcaaggtgaacatagacagacaaggttagtttgttttccttaattctcagagagaagactcgttgctggaaccgagagcactggcgattgctttctttctgaccttcagccgagaaattccataccttccaccgacttcttttgtgtgtggccagaacgtgatgctttccaatgccgagtacttttcttcacaatgtatgaagcccgtaaaaccgaaatcgatccaaacaagcaacggattgagcgcactagcgcgaaagcgttagcacgcgcatccgttttcttgctggccgagttaataaaaaagaaatctctcataattagggatgaagcaccaatgacacacggatatgctttcgctgcggttgaccgaacacttcgcgacattaggagaacttctgcaaatgacactggttcaaatccgcatcacagactaggtatagttttttttatcatcataacaataataaattcagttggatgctcgagtaagatgatagagcttcagaatgctattgagtctctgtctttttcttcatttacagaagcagcgtcagcatatcgtggatttccatcagtgatgggtttgttaatacgtgagagataactgctaaagattggatattagctaaaagacaaagctctagtaagctaacagcggaggaattacggtttgtaaatgcattggatcaatatgatcttgaattgatatgccttcgttcaatatctatagtattctcggatatgatagattcatcgcttgttcgcacagctgtgttcttaagtgtgattcataaaatcaaaatagagtattcacgctctaggttggtctcccgcgtaggactcgaaacgacaagaataaaccaagttatgagcttttggttgatctagaaatagctgaaacgcttgagaatcctgaagattggtttaatgctgaggaaattccaaccgtatcacttagtggtaagatgggtataactatagcttcatatttagtggagtttatggtgatgagaggtgtaattggtgtggttcgatcatctctcagttcaccgattcatccatccaggagggcaaagcatgtctctttgtccaggtatctctttgttttgttataaacgtttatctatgctttttctttttctattaagtgaatatgcccagctccgaaccaatcgtttctttataaagaaagagtactaaatatgatattcaaaaaaagtactttttcgttgaataacgaaaactaaactttctatgagttgttgaaaagcagagacacccatattcgctttttccctgttccttccaacgaagaaatgtataaagtataggttcctctcctgatgatccctggtatctccgttttgacgtagcctatgccaagcgcatggaaggaagctaaactgctccagcagctaaaaggagttaaaacggacagaagagagtacgaaggagaagttcataccctgccgatgcggagcggccgattcccagaagaagaagccaaaagaaccggtgttgagaaagaagtctggtagaccaaacaaagacgctgtattaaccttccctagactagaagctagctctttactgatagggtaccctaggctttgattcgtggtttactttaaaacagggatgacagtcttcaactgctataaaagtagtgctgtgaactagtaagaatagcgcctgccaaaccaatggatcctgtttatccccaactgaagcgggaaaaaggcaccttgttcaggtggatcaccgatgttcatccttggtgcctcttctggttcctctatctgactagggtcgagcatcttcatgttatcttgattgatgcacacctgacctgttagcacttagcttgaagtgtgttgatgactttgtttgaggttctgtatattattacgagattccgcaagcattacttgaaagaggaagtgcgccactaagactgattgcttttctagcacagatgaagttcgtaccagtgcatgctgtcgcagagctaagaatcaagtcactcaggaaagctaatccatggggaatagaaatccccgtctgaagaccgagctaccactttcataaacccagacatctatttaattatacgaaatatgaggtcaattaaagaaaaggcaggttattatgtaagataagaatagtggagtggagacagtgaactgaacatcgcactagaatagcgaacttaacttaattaagcacagtactatatgtcaattggtcgttgcatttaacctatattgactaagcggtatggtatcattaacaacctacctttcactaagaagcggtaccaaccctggacttcccggaatcaatgaaggagttcattcagcaccgagccgagcgagcgtagattcaatatgttgattgtaccgaacgaaggatttgccttatcacgaaagccacattcgtttcgtttgaggaagtcacacgccctgttccctataaataaggagattcattctttttttttcagaaatcccctcttcttcctcctcaagcccctatcacaagaccaagcggatctcatcctgcagaagactcagagcggatctatctaatggcatggctggctgtcggatgtgatctattctcgtgtcacatcgctttctttcttctccctccattttattcactactaccgcttctacacataaatcaaagaagcattgtggaatagtggcatttcgttaatgtcgaaaatgttcttagtgaaagggttgccgcaaaaccggcaaactcagagcggtctctgaaagtgaataggagcatagcggcatcatccaagccaaacacgtctcctcagtcaagggtcttctcgcgcaaagaagatcaaaaacataacaactgatttcgcttaatgcatgtcacccacccgctctcaatacagcaagtgactctctctcacaagacagagaaagattaccgattcatccaatttgatcagaagtgagttcattgttgttgtatagcgaaacctttccttgacaaaaccattctcagctaatagaagccgagctatctatccagatcagggttgaacgaagcgaatggaaaagccaaagaaaacataaatccattgcgattaaaaacctgtgactctacagccagggctcgatggcgatgtaagatagaaagaatggggagttagggcttaggtttcctctgtagccagttccaattccaaatcatttgccgacatgcggactcacttctcttttatgggacccttatctaagttttctatttacgtgggtgaatcaagtacaacaagtcaggtcagagcttgtggtagaagattgggctctgctacggccttccttcaagattttagcctgcggatctctctcttcaaaacatatctttcggcgccagtctttcctgccttaccttaaccccgctttcacgtggcgaatcggtatgtgatcactttacggtattctttaagctttcttggtcaccggacagagtgagaactgctcagcttgctttctttccctagcacacacttagtagatagtaggcacaggtccgctaagagctcatcgaactttacttgtagagtaagaccacagctcgatatggtgaatttcagtgctctttctcccggtatggttcaccacatgcctgtgatcgatctctctcaagctaggtttggtatcggtgaagtccgtcattgaattgaagtggtagagtggtaagtgggcgtacggtctatgtatttcctcctatcagtggcattagttccttttcattctctagatagatgggcagaacaagcttctctttatattctaagaattgtccgcccttgtcattttacttcttacgcgggatttatggacaaaagttagcccggattactaaagatctttgttgcgggaaaaggagggatttgctgagttcaaaagcaagagtacttcagtgaaaaagcacaaaattcattcccagttcaaagtgatacacaaacagcttgttgctaatgaattcacaaaataaatgcttgctaggtaaatcgtactttttgcacagtcacatatggctcgtaactattctcggtgttatcttacaactactcttcctttctctccttcggaagaactagtctttgaagcaagagatgaacatattgtgggcggatcttcttacccattgattggaacatcgtaaaaactccgaagatccttttcactatagttagtgacgtatccaaattctgtatactattggtggacgggacattccccgcttccttctgcttttgtttcacgaagcgagcgctttcaacaagcttcttttctttgttaataaagcaaagtgtgtaaagtcctccgttttatcactgggaaagctttgttgtcttcgttttctttctgccgtagtatatcaccgcatatgatctggcctttaaagtgggttagtaagaaaacttacctttctgggtaagtgcccttttaatgtttaagagctagttgagcagtaaaatagaaataagagctgctaaaacaatatcctttttcttaaagttcctacgatgctagtttttaaaaggcatatacactcagataatgcagcaagagttccccactaccaagtaagctctttctacttgttcacctggatgaaaactacctggctttgtttggctactttttttattggctagtgtgattttatatctcaggctagactcgcttgagctgtcttacattagtggggctatatgtgaatcgcagaggtctgtaaattaaggcaataggcgggcacatttgaaatgcagcagtagtgagctcctatagaaaatccaaaattcaataaaaggtcataatggtcggaagctgttcactacttcagaaccatccagaaggcaagagaaaaaagcacctgaggtcaggtgtttcttaggagttcaatatgtttcatgtgtgtttttgcaaatcttttttcttcactggtcctgcacgcttgataaaaaggatctggtgtctatgccaggttggtaaaccatatagatcttgcccaaacaaggagtaggggctagcttgtaagccacgacttagtactacgaggattcgggcggagtttcacatatagataggtcgggatgaagatgagaaataggttcggttgtgaatctgggtcaagaaatgggggttatgcgccagcctatcaagcaagccgaataggcgcgcctggatgatcaattccttggttttttcttacctgaccgagagacggggccgatagagcatattccggacaagttggttcgattcgcagttcactttctataagataacaaaacagcagacccgccccatgcttttctttacgctgacccagcattcccctttgcatttcttccaggcacaaagggattcgtttttatgagaagcgagttgttctaggctgggccgatccctacccgttttgatctgacagcggacgaacagagaaacgtgggtctttttctcgcattttagcgatcaataccgaatcctcatctatgcaattcttgtacttatttgatgaaagacaaagaaagagatcaggttatttatgatcggagaaaaggaaacgatcaaaccgcctacacctattccattggttaactattccggttctaatctggaatcgtagtgagagtatctagcatacatctgtacattctgaactaagttctactaatttcttctaagatagtggtgttctcattcccgcttgcactaacgaactgtgatgtttacggatgagaagtaggctgttggacagatgatgcttgtattgccagccttcatcggctccgaggtgtggccgggtgagcagtctgcggaacgtttcactgcctggcctcccgggtttctgagtgctagcgaacctccttagaagtagctatattggaataccccgctgacttcagattctgattggctggaggtgaagacctaagcattggcttacactgactcctctatcaaaagaaagggtacaggcactagacaaattacctactggtaatgtaaagggaggaccagagctgccacatagggcagttttacatcgatagcaggtaaagacagatagtcagacctaccaatatagttaagtcggacccgaaagacagcttcacaagaccatgtaatagtttacttgttcttttcttagcactttatcgaagatatatcgctgattataaaaacaaattggcagagcttgcattttttcttccactgagcgaggtgtagatagcctgctttttctctctactaaaggggtcacacattggagtgtggattttgggggaagtgtggagataaatactaccctgggcatcagtgtaaaatcaaactaaacatgctattgggttaagaagaagaggttggtgaggatgaggaagatccacaggaggagttaagcaatagtgcaacagaaaagcaattagaacctgaagaagcattaatctccatgtttgctatctcctctaaccctaatctcttttgtttgctactatgatcaatttggcatttcgatcatcttttgttttgaaggtacttataacaaccaattgagcatatatctgtacatgctggtacgcgtgatttagtactagagacacattattacctaatgctgctgataatgtgctgtcttttatagttacaaacaacctatgtttccatctttttaaagctgtttactagttatctgtccgagaaacaaactatcacacaattaaagcccgcaatgcacagaacataaggcacatacataccactttagcacactttacagaacacgagtgcaacataccaattctagaaaaaacacataaacagaatccaacaaagtcacttaagaataggcaagggacacaccgtccacgccacctacttgaagagcagaaaagagtatagttagtgtaaggaaagtattataggaaagaccctataagttcagacaatatgctacattctatgatatcctattcaatccccaggttagcatgcgttgctcgtcgtgctaataaatcctctcttcttaaagcccaagtaggacaaagaaatgcaagtaaataccctcgattcattccttttatgcgagtgggaaagctagctagaaatcaatgacaaggagtagagcctagagcaaaagggcctggcgtcaggttagttaaagcaagaaagtcaatgctggtgctcgcttattcaatccttttttctctcctcctttgtgctaatcactaggtcaaaaggaacccttaatacggagttttatacttgttcttacttgtgttagtgaagccggatagttcaacttgcctgcccaaagtcaatctatgaaaagtcttccttataggcgcacccagctgtaagagagtagaagcaatcggagtaaataaatcccatagtgaaatgagcgttagatgttgactagacaaaactagctaatacatgtagtagggtaacttttccttttttctcggttatgtgaaaagggagaaaactcgctacactttataggaaatgaactactcttaatgcaagctagtcgagctggatgagttgttaggaatggctcaacccaggcagcgctaaacctttcttttccaggcaaatctctcacttcaatctttctgggctagctatgttctcggaccccaccagagtaggtttcaccatcgagtaatgaagatgttaacttctagtacaagcaagcaaaatctaatgcccgagaaagagggaatggcattgaggcttcatccttggaagaagacgggagtgctactagggacgaacagagttctggggccagaggaaggggaacaaaaggtagaatatgcgggttatcgtagaatctctgagtggcgatgccctctactacctaatactaaaagaaggggactttgaaagataggtgaagcatacttattcttttcccccgggatatttctgtacactagctttcatgcgtaattataaatacttgctcgtcacatccaagctggctcgtcgctacatctctagttacataaagaaaaagattactcttttttatagaggaatccctaggtggaatttgtgatgtaattaatgctctctaactaactcaatttcaagtcatgcgccagtgatttgccgttataggccagggccagttggaaagtatgcattagatagctagggctactagggctaagaggaatagcttttgatcagttgcctgctaaaaggcctttctttcattatcggaagttctttcttctcacctgatccgcacaatgccaccaaaggtaaggatcatcccatacagagtaatgggcttcaccgctgcgcgccttttcccttttagcctttgacaaacctgcaggtagctcattagtgaccaaataatggaaaatatccgcataccatggggggcctcagcggataacagttgctcataaaccaaaagtaagtgttctgcacaaccccttcaaaaggactctttgacttcgccgacttacatatttcgaatagccttgtccttcgtaagtgtagcgtggaaccttcggtccatagattctaccgacccgcctagcgatcaagctcttgcgtctttaggaaaactttcactctagctattctcggatcacctatgaagtgctatttttttcattgccgaccatccgccattcgcccctcgaggattaataaaagtactgatgctataagttaatcttcacatcaataggctatccctagtcgatttgataactgaaaaaggtagactctattttccggtgaggataaaggtattcaggcaaccgattctggcaggaaagtaggggagtctaatcacacaagtgtacaggtgaggacggacaaaaggcacatagccattctgctcctcccgggatcaaaagccgcagctcttagttcccattctggcatgaagacaatacggatgggctcactcactgactttcaaacaaaggaccgtggcaagtagtacgctggtcatcaaacattaaaacattttccattttcatttctatcgttcgtgcaaggtactaaaataagaaggggatcacttcactcgctagcaagcaaatgtgttaactcacgagacgaggccaacgatatatatgtctatagtgaggtttgcgaactatctaaatagaaagacttgcccttgccgcgagcaggtaaaagggcaatggaatacttgagcaacggaattgctttcttcaagccatccaggttcggcagactcgtacgagtattccgcggtgaagccaacctccgtagaatacgtgattttcgcctttccactttgaggtacgcccttgggtcttccctcattaacccagacccgcctttcggggaatatgaaagttaggtttgagagccaaatacttgtcgtgagcagggcgtgttggcagctttggcacgtgcaggaaagcgggaaaagagttgaccgagttattaagtcgcttgaagcgccaagatgaattagataagctgggaagcgaagtgcgtgaaaaaaattttatactaaaaggtcggggctcacccgatttcatgcgtttacgaacacatgccagaaactgcaacttgaatgccggaaacccagcacccgggaaagaagcactttcatcgcttcgctaactgctcgttcaaaggaaagatcggagggcgatcaaccctttttttctttcatattcgattgggtcccgataatatttgatattcattcccttgcgcctgcgcatacgttttcttgcttttcccgcatttattcgtttactttttcgtatcactaattcaggaaagtccctctgtggagtgcccgactgatgttctccgttttacggatccaaaagtgggtaacgcattgcgatctctagattttatggctgatgctgataatatgcccgctgcagaagcgaaacctgttgccatcgtcatttcaatcacaattaagttggtaggcgcttcaaaacccgcaaccggacctgcctgcaaccggagacccgcaacttgatgacccaacctatgctgaaacagccgaataaaaaacaaaaaagtcaagaggtggatcagttgatccttttctcgattgaatgcgctttctatctatctataccggtaccaggaaaagcagaataagcagttgagcaccaagaaattccagtttcaagtctgtatatctcgatagaaccaattccaatccaggtagtgtgaacagaggatgtggaagttctgtttccttgccttggctctagaagtcctgtcggctgacataagacggaacccccagtggtttgaaggcacgtagccacagtgtctaagattgagcagggggtacggtttcggaaatgacatattgaataggtctgtataccctcaagggagtgagtgatgcccttaatgggtatcaggaacggagaatagctgactttcaatctcaattctatgttgctatatagtactgaaacgataactcaagcaagtgaaacgacaagctaactttcttataagtgacttacttaaacgctagatacaactactacttaactcaacgctccatctcccaagggatgagtagtgcgctcttattaaaacttgtaatacacataaccgcactagaaacagaacagaggagtagcattgcaacgtaaacataggcgagatagctccctctacataggagtttcaagcttggcattagtcctttaggtgtaaggtcacctgggatagccaataggtaaggatagccaaatgagatatgtaggtacagcatgagtttaagcagctgccgtattagtaagctagctgacatattgatcttgtcttttcatatccgggaggatttacttgttgatcaacctgtagaaatcttcggtatcctttctagagtgccccatttcccctaagcccaagatatgagatggaactggaaggggttatgctattggtttgaagcatggggatgatcaattcaatttaagtatacgcataccttttaccaacaattagagaatacctgcaatattagtgcttactttcttccttatcttttcttttccttaatacttctcctcgagtaggggaaatagcataccatacttctttcgctgggcactgtactttatgacctttcttcgacacagcatcgcattcctcctctctcaggcattgaggagttggctcatccatgctatgctatcaatcgataatacgtaaaggatcaggtattacaggtaaactgtacctgtactccaaagcaatgaaaccaacagggaactctatcgttctagagacagatattgtttcctctcggggagggaagaatatcggagttgagataccctttcctgaattgacctattcgattgaactaaggactatggacagtttccttcttgtgtttgcagtttcattctattgattgacaaccaggatgcttggactacttctattctagcttttctaaccgattgaaggaaattcctcgcctatcttattctttttcagttccgatcatcattatacgatccaagtcgtggaaaagccgagtaggaaagccgaaaccgagggttctatggaccgacccttagccgttgaaaaccggataggaactactgccgtatctccacttcagccgcaagcgaacgatgtcctttcgaggaactacaactattgcgaatccgcggataggacccgtgccttgtctgcttagcccttagccgtgctcttctcggaacatggcaatcacaagcatgccttgccaatacaaccattgaatagatttcacccgtacccttgacatccgcgatgagccgttggaaggaatccgttccgctaaatcctaattcgtatgcttcgttggatagcagcaatcgaggctaaataccaattggcatggttggatgggtaccgtaccccctaacccacacaggatagccgccaaattgacggaaaagcgcccatgccgattcatcccacccaacaaacaaactcatgcgtacatattccccttcccctggtctaagggatagcgcttggtctaaagctcgccatttattcgctcgtaggaacctacaccgtcattggaaaagtgaaacaactatttcaatccgcagcaaggttcgctatcgctgttccgctattggatttggaaccaccctttccgagggtagcattagtttagtttaagcagatttcccttttctattactcagtaagattagggtttttttccaagatcagtccggcctttactttttcaaacttgctcatatactcccttacagatccaacctaatgtcattttcttaattcatcaactgggttacagatttggatgcacagaaacctattcttgacctcactaatcaaggtgtccctattaggatgagggttagtgaccacataactcctgtaccactcactagtttacaacattgaaataagcgattctttttgcaatgtgtctctcagcgtttttatttttctcctttttcattatcattttccctctcaaaaaagatcgaaaggattcactccggtgctgcttgctggtggaggttgactatctccactatgaataagtctttctcgagtaactgagactcaacgtgtaggcgttggaagctgaaataggagatgggtcgttccagctcggcaagaggattccggaacatccaagtcctagctataacacagacaggaaagtgtttttctttcattgcaatgtctggcatcgtttcgaataggctcgctacatagttgcaggctcgctcgctccattcttacgctcgctggctggtgaggcagagttggtatggcactggctggctgctaatggtcactcaggatctactatgcgcgatacgccgacgacattttgtttgggattccccgggccaaagagatatacctgttccattccaagtgaaagaccagcagctgcgcgccttaccttctagtaaagggcgaatgagggtctgaaagaggtttcaatgcacagatgaacccgcgaggcatatttctgagttgaggaacatctgtttgtgggtggtaagcttcatgttccgctttacatttaggctgtgaaaaagttctagccaaaaaagcttgtaaatatcggctgtgagttatgatgtgtgtaggcagcccgcctatacacctggtctcagaagattttagtcacatcttttgcgctggggtcagaagtggctgtcatctcgtaggtagcaaaggactcggctttacttaacaatggttcgctttctgggaattccatcattcccactaggcaataatatgtaaactaggtatggagtatgtttttaacggtgtaagtaccccttcattaaagatccctttccccagtctaccttcagtggccccaggcggataagccaatctacacctaggatcattgcatcacccctccaacattcttacttttgaccttctaacttggcatcgcatctcgtgtcagtcactattattgtgaaccatagtccacttgacgactttaccccaccgggttgttttccctaattccaggaatagagtagcattctcaggcactaccctcagttgcagcctcagtccatataaaacagtcaatctaccagcagcagaggctgcagatacatgtccaccacctgtttaactactaccataagcgggagcagttgcaggtaaagagtgttgtgagggcttttatttgcgcgttaagggctgtttctgttatagcactagaaatcagtgccgttagtcccttctcgaacagcagttttagcaattgaatcagctgtttcctaatagactaggctgttagcaggatttgcaggcgagacagatgaggaggcatagaaggaggaattccattatgtgctaaaggctgcggaataagagctcttagtcctttcggcgtagagaacgaatcctctgttgcaagaagaagggcaatgccgattgtaaggttaagtattacgtacgtaaaaaaccagtcagtgactcatttaagtgttgtgcgaaaaggtagccttttggcaactgcaaccatccatagcgagcgacggaagatcaataggcagttttttcataagttgataaaaggagagagcagcttaaggagaaaagaaagaaccgcactcaactcaaaccacccctcgcctatcttattcttttcttgtcttcttgttttcttcttctccttgttttcatttcataactgcttccatctctggatccgagctcgcccttcggggattgaagaatttattcaaaactaaaatccaatcttatttaaattcgggttaaagctacccacccacctagtcgcgaaacaacctagagagtgccagctttcctttcctacctgttcttaaaatccttgctttcctacctcgctagtgacgggaagagcggactactctactcttattgcagggccgactttttcccttatttcatttctcttgttagctttagctgctaatccactattaggtttggcccagcccttgctttgattgaattgacggagggcagcctgccaagcggcgtatgatgatcctagcttctgcggatcctccctttctatttgagtaccttgccttggtaggaaactagaatattcgttgtcccaactattccttgcttgcttttgaagaaaagctaatgcccatgtgaaaggaaagagctgagctcataactactacttttgggaatcaatcacacacaccctttcatttctttccttactgaagtcacataagcacgttccaatgtcacttctcaactgacgaatactccttactttagcgtttcccactaggctatgaacttactcgcctaattactcctaagtataaaagccatattggttgaataagcaggtaattttgttgttttcatacattcctcaattcgtaaatcagtagttacaataggtgattccctcctttcggcaggaagtactacataagatagctgtggtttcctactgtccattcggcaagaagaagtaagtacatagcgatttccgcccttttcaaagtctatttcctccccgctaaccgcagtagcttgcgcagtagcttgagtcctgacaagtgaaattcccaattcacacacagaggtgagaaagcttatgtgtccccttatacccgcatagttgttgcaaggctttcgtgaccaaggttacattttcatcccttctctctacacaaatagcatctcttttccagatgttcaatccacaacttcctttaagaatgagttggtctggtcctctttttaacgacaaggtcaaagacttgttctcccaataaaaggggcttatggtcttcatccactccatcccaagaactacatcatatgttcccaaatctatcaccctcaagtctacctgaaatgaatgacctnnnnnnnnnnnnnnnnnnnnnnnnnnnnnnnnnn

SEQ ID NO: 638 - DNA, 3525 bp, Oryza sativa
ccttttcttcttttacttcacacacaaaaaagaaatattgaagaatatataatatattagaataaatgggcaatagttaggagaggtgcgccagaaggtaaggtggacagaccagaagagtaggggtgcttccgatatcaccatgatcggtaatggaacgctacgcccttgctttctttatgcctcaagggtaattgaatgaattgaggtttagtaaaattcgattgatcagaaaggaaggggaagctggtgaataacttaacccatcctcgctggctggagttagagctttcttaggttaggaatccacataagaaagaaattctcatcgttgaccacgagccattctagacagtgcggacgggaaagcactttttaatggttttggtagttcaatttcagtaaattagccaaggcataaggtatgtttagacgaatcggccctatttatcactcttgctaccagttgcatagaatctatcataagccgttgtaaacaaaggattttcctattaataattgggccaacctaccaaatagtagggtttttcgcacggtacgggagtaggtctctccatctaggaaaagcaaaagctggacgatcgagagaaagtaggctcatattccggttcaagtacaagtagaggatcacgcccaagcctacatagttccattccaacctccgagggtctcaagaaatcgacaagaaagcaaagtaatcggaattcttaacttcgctgatccaacaacaccagttcctcgatcttgagagtatttcagtactggtacttcggaatctggagcaagcaggtttcattcctggtaaaggtgattggtcggtactcccctctgccaacccacgagctaaaggaaaaggaaagaggagaaggaagtagacaaaagtcgtgatttcttcattaccggagccttctcgggtagtctacttatgacatggctcgttcagagggctcttcgcgctgtcttcaatattactatttctccaaaccaaccagtagtagaaattaagaaatggtaagatttgagactatgaaagacccgtttgtttaccaattcgtcaactataaagaatttgttacgaaatgaatgagcaaaccagcagaaccaagaaatgggagggatggggtttaaggatttgaattatttaacctcctagcgagacaagcgtggagaatgctgcaagaacaagaaagtttgagcgcaagggtgcgaaatgtatttccctgatgaagacttcctaagagcagacttggttcaactgtattgatgtacagaatcagcggatcttgcttgtgtcacaagagtgttgtcctctatatttacgtaataaaaggagatccctctggccaaaccaactacgaagtacgagcagtgggctaagataaaagctaggaagttggcatcgggaagtaagaagttcttgctagactgaagatgatcaatgaaagatagggtttgacaaacaagctggggtaaacggatcctgttaggaagaagaagagcaggatgcaggtactctttagtaaagaaggaacaatcctcgtattgaaaccggtcgaggaatatccctcaccctcgtatttgaaaagaagtgaatcaaatacaatagtaggtaggaaagaaaagccatcctttgagtagtaactttaccaaggtagagatagtcgagagcaggatgccgcccttattctgtttagaagaaattgattcaccggcaaagaaacgactactgcgagcaggagcgatgcaaccgacgggaatcctaattggattggcggactagtgaaatgaatgtaatttagagttggcaatgggagctggtgataaacaggtaaggaagcactcgacgaatagtgacatttatgaatgcaaagcggggccaaggcagatatacggatcaggggtataagctaaaacaagcagaagcaaagcttgaaccttctcactgggattgaactctatgtttcgattgaggctaacggaacccaggtttcctattgaccaacctcgttcgctctacgtaaccttacccttatgggcaagaacacgtatctcgaactccaaccttctgactaccttagggcattaggccttagagtggatccaaggtaggggaaagacaggacaatgcatgcttacttatcttcttatttccccattccgtgcatgagttccaaggtggagtggaggaaaactcaactaaatgaatgcgcttacctccctctcttatcaggacaggataagagcaagccaagccaacccaagcccctacctattctatattataatctattgtatattataagagcaaacctagcctacctattgtatattcctccttgtggttaactagaccagtgatctttgctacctatttatttttatcttaatagataatgtgagagataggcgatgaaatgctggttctaaatacctcctaaattaatgatataataaaactcctgctaaattcattgtgcaaactcatctacttgtaaattcattgtgcaaaataactccaggataccattacctctgttacctattatattccatgactgatcacatcaaccagtgagtgcttaacaacttctactgataccgtgattccaatgaattgacgtatatgagcgtagttctctggtacgccgagagatggattccatccctgaggatagtgattgatggtatagagttttgatagaaaacaggtatcaaaaatataccaaaagaaagaagagaaagtcgagccttgattccagagagagagagccatctctctggactgcactcttatagtcgacagctctatgtggcttgtcaaccaccggaccgtagctcctcacaccgagaaacccagtcttcccccagaagactgtcttcctcgactatacattctcctaccccaaacactctaacccagacagggattagttttcaataacacctagttcggggcatgatgactaaccttcctaacaaaagaaaagagagataggaagggaagacccacctatccatatagaaagaaagcaccctatccctcgctctgcccagccagggcatagatcactctctgtttactcctacttctgtgaagaacagaggcatccaaaaagagacgagaagaagcccgcgcctttgcctgcttccttagctacgtcagaaggtagggcctgattgacagacggctccgaagtagcaggggcctgtttgacagaaggaagggcctgaatgaagagcggaccagactcttctttgtttcagctgctcccacgcacgcagaccggaagatcccagttgtcctggactagacaagtacgtagagatcttcgtggaaccggggagggagtctcaatcgatcttttctaggattccaactcacgccacgcacgaagatttttctattgatagagttaagggctcggctcccccgactctaaaaggttaggttactaccagcttgcctctacggaagaggtgtactttgtattgtctgggggtcat

SEQ ID NO: 639 - DNA, 697 bp, Oryza sativa
ttgatatatgatagccgatgtgtttacatcgccttgagatggctgatatggttatattgcccttagctgtttttcgtattgtaatcggctgtggtttgccgatgtacaatggccgatatggttatatcgcccttagatgtttttcatattgtaatcggttgtggtttgccgatgaataatggccgatgtgtttacatcgcccttagttgtttttgtaattttctcaatgcttttgacattataaaatcagggggcacatatatacaaaacaaatgaaaatttttgagcaaatttagaagttatattaattggcacagatgattgtcaagacagtaaagtactggagtatcttagccaattacaaaaatttctaagacctattatacaaagagtcactgagacaaatagtgctggatagccgatattgccctttgcctaatctgttctacttcttcaatggcttgggcgtcttgagcatcggttccagggatgattttcaaagacttggtcagctcagcaacattcttgatagccgattttaatcgtgacttctgttcttcaacggattttgggagatcggccagctttttatgttctatatccagctcggcattgcgttcttcaagctgtgccaagagctcaatcttgcgagcctcaagccgatcaatattagatttgattgggccatcagagctga

SEQ ID NO: 640 - DNA, 1170 bp, Oryza sativa
ttcttgaacgcgcacgctcttgagccccgtaatcgcagcaccacgtctcctctggttatcacccgtgttgaaacgcggattacctcgccgagaaggctaatctctgtttgccaattgaagaacacaaacaagaacgagatagaaaacaaccaaaattgcagatgaatgattaagctcacgagttggggtcttacaaaccgatctagcggcgaaactgttcttgacagattaatctaaggaaaacccaaaaacctaaagatggcggcgggtactgatatatagagtttagggttgtgcaaccccctctcaacgcaaccctaatgggttccaacacgatacacgggccaaaggcccaaatacggtgacacagcaccgctacagattctggacgtcaacttgtttggtcaatttacattgacccgaaaagaatttggacatgggaccaaaaccattggaaaggatatcttgttagctttccatccatataaagaatgccccaatccgagcacgtatgcgacctgggcgcccattttagtgcagactggtcctggactccgaattgcacccggcgtcgacttggtttgggcctccaccttgacttggtcgtactcgatgatcctccatggctctaagtccttctccaagtgtctccttgtcccctccattgttcctaatcacaatataatcattaggtagcaatctattctcgaattcatacaaagaagaacataggaacgaactcacctctaaatttaattgtcgcgcacaagctcttgttatcgctcattgaatgaccgttggaggattgttgtgtgtatccgaggtagtgatgtccccatcaggcaaagacaaagagcacatgtaataagttggaagggatgacataatagaattgaccaaagtgagtctgtctccataggataggaaggctgagctagctgttaatcttctctcaattctatcagtgagtggggagaaatcgaccactttgggtctagacgttcctaggggtaagccaagataagtaaatggtaaggtcccaattgagcaaccaaaagttgaggctaacatgcacgacttctcctctgagatatttaatggaatcatacaagatttggcaaagttctccttgagtccagaaggcaatgcaaaagaattaagtaaggcctt

SEQ ID NO: 641 - DNA, 6072 bp, Oryza sativa
  unsure (1)..(6072): unsure at all n locations
nnnnnnnnnnnnnnnnnnnnnnnnnnnnnnnnnnnnnnnnnnnnnnnnnnnnnnnnntttatgttacttttgagttccatttgattttttttcccttagataaggtatattcatcaatcatgaggcataagctattgaagttgttttactttctgcatctacaaatattcagataatgattatttattgttattctggaagagcatatcaggtcccaattgctctccctcttaattttgtgaattggatgagcaaacaatcatttcatatttagttggaaggatttgaaaatttgaactgaaaagtagtataaattagaagaaaaaaagtagtcatcaaagaatatatgacgtaatgccaggattgcagatgatatacagtctttccttcttcatccaatctaacttgcagtttgtacaccttactatgtgactctgtacagaccattctgccttgctggacattggtctcacctttagtgttttgattgcctcatagaatcagaagctagatggcatcattaggggtgcaaaacttagatgaatatgttgaaactgttgataaaacttctgcatttttctaaactttgctgaaccttgtgagatccaacatattttgacagatttcaactgctttcttttacctcatatcttgcaccttcaggctatctatactcctttgaaaagaatcaaatggtggtgcattggatctgccacgccacctattcccgttatagtttgtacatattacacgataaacttcttaacaatatgtaagaaccaaatctaaatggagagccacatataaaattaaattaacgtgagtattacttatagctaaaagttgtgtaacatatttcatgaaaaatatgcttttacttattataggaaatgttatgggttttcttttcgttctatcagtggctagttgtttgtaaaagataaacatagcacatagcaccctttgtttcagggtctcaatgacacctgaaacaaacttataaaatgcatcaacctgggatgtttctttcctagccatgcctcaatcaaagacaaaattataaaaaagaaacataaaagctttaataaatgtgagactatttcataaaacgatgagttgtgccattctagcgcacatggtacgtttgaaacagtatgatgagaagccatgctgttgcaattgcaaatcttgccattgccagattcgctagcaaatgctatcttgcgatttaggtatcatagcaagatccccaatatgttgttttgaccttgcacatgtgcacgtcgcttcgctcacctacattattttggttgtcaatttcacaggccactgataaaactatacttgcgttggtagtgatggctctgagccttgcaatcgtgcccacaaggttgcttgtcctgatgatgtttctagaggtattcacgaaccactccccacctaggagagcaagcacagaaaggtggaccagaaggttaagagagtggtggttcagcattcctgcagctccagtagtcgtggagaaggataaagaagacaagaaaacaaaataaaaaatgtatatgtatattcaatgtaattatgtgccttgtttggccgatgggttggggtggatcaccaacgctcgtcttgtacagtagcagttagtatttttaataaaaatgcgagttctcacctagaaattaattgcttacctcgtattttgattatttcatatgtagtatcatcgggtgatcagggatgttttttttatcaaaacacagtgagggaggctcccacgatatatattaaagaataaaagagtatatacaatggcaagcaaaaacaaaaaaaaagaaatattacaattgatcaatccatgattgcactaaaggtttatgcacatccttgagtctagataaatgtagactcgatctgacttcaagtttttcttccaagaagaaactgaaagcagaatgccctgaaaaattagaccattcctttccttccaaatattctaggccacaagcagaaagagttccatgaaacaaggaaaaggaaatgaagcattttgagtttgaatcatttgatgaaagtccaaagaggtcgaccaaatccagcccaaactactccaacaggcaaaactgaaactgctgaggaaaaaaagatgatctctggtctccttgacatttagagcacaattagaacaatttgctgaggcattcagaggagcacaatgtttcctatccaaaagatccctggtgttaactatgtccatgaaaaataaccagcataagactttaatattcatgtttattcagctctgccagatccatttgaaagttacgggaggagataaaagaccagaaaattgagcttataaaatttctcagaagaataatttgatgaacccagatataaacccaagtgtcaattgaatcaaacagagtaaccagttaaagatcatgcaagagaatctcatattcatcaaacgcctgatgggataaaggaaagtgaaactggtcatcaggatcccttgacaagtgccgagcaacagaatcatatttatgtttagcaaaggagcacaatctagggaatttattagatcttacacaaccttcccaaagatcatcccaaaagagaatggcctgtcttgagccaagcactggcttagctattcccctgaaaagtatatcaaactgaaacacatccttccaccaaaatgaaccacaacatgttgccgcatgagggacctcaaaagaatagtaggaagaccatatcagattcacccaagggacatttatctttttgtagaacttatgcaaatgcttaagcaacaaagccttattctgaattctcagaaaaattacacaaagaccccatttttcttctcggttgcacaatttggacgatgcaaccaaatatttcttggtagaattaagatcacttcctctccaaaggcaatgccttctggttctatcaattgcatcaattacagagatgggcaatgatgtgcactagggttcccaatcttccgaaaaggttctgataaacaacaatttgggcggaatcgcgacacaaatcaatccggcttcttgaacgcgcacgctcttgagccccgtaatcgcagcaccacgtctcctctggttatcacccgtgttgaaacgcggattacctcgccgagaaggctaatctctgtttgccaattgaagaacacaaacaagaacgagatagaaaacaaccaaaattgcagatgaatgattaagctcacgagttggggtcttacaaaccgatctagcggcgaaactgttcttgacagattaatctaaggaaaacccaaaaacctaaagatggcggcgggtactgatatatagagtttagggttgtgcaaccccctctcaacgcaaccctaatgggttccaacacgatacacgggccaaaggcccaaatacggtgacacagcaccgctacagattctggacgtcaacttgtttggtcaatttacattgacccgaaaaagaatttgacatgggaccaaaaccatttggaaggatatcttgttagctttccattcatataaagaatgccccaatccgagcacgtatgcgacctgggcgcccattttagtgcagactggtcctggactccaaattgcacccggcgtcgacttggtttgggcctccaccttgacttggtcgtactcgatgatcctccatggctctaagtccttctccaagtgtctccttgtcccctccattgttcctaatcacaatataatcattaggtagcaatctattctcgaattcatacaaagaagaacataggaacgaactcacctctaaatttaattgtcgcgcacaagctcttgttatcgctcattgaatgaccgttggaggattgttgtgtgtatccgaggtagtgatgtccccatcaggcaaagacaaagagcacatgtaataagttggaagggatgacataatagaattgaccaaagtgagtctgtctccataggataggaaggctgagctagctgttaatcttctctcaattctatcagtgagtggggagaaatcgaccactttgggtctagacgttcctaggggtaagccaagataagtaaatggtaaggtcccaattgagcaaccaaaagttgaggctaacatgcacgacttctcctctgagatatttaatggaatcatacaagatttggcaaagttctccttgagtccagaaggcaatgcaaaagaattaagtaaggccttcagagcaaagagctatggtgctgaagcttccatgaaaataagagtatcatcagcatatttttatttgaggtgaacgatggcagaagacctgccggaatttaatttaagggagtcaaaaaaaaatcacccaggaaggcctgggaaacgttacaacaaaagacaattagggtggccagaaagccactttgcgcaaatccaagtcttgttttacccgataagctactgacaactccgaactagataaattttggaagattctactatttctttctagccaaacgttccaccaagttgtcaggatagcacctcgagcgagtaattttttatcttctgttcctgcatccttaagctcatcccagcagcaggtagagacacaggatggaagggaattgaaaaccgggggcaggttttgccacgaatgtactgtagaccatacttgtctcataaacgggcattccgcgaacagatgattggtgtcttcgaaggcggaggtacacaagcagcaaatccaatcacacggccaatgtcttatgagcaagttttgagccgtcaaagttctttgatggaggacaagccacccgaaaaattcaattttaggctcagcccgggctttccagagtgaggtaaaatcgcttgtagtgtatgaaccagcaaattggtataagtaggcactcttggttgtataagttcgagattcagtccaattccagactatgtcatagacattttgagtgagttgaacctgttggagcaggccccccaattgcaccagctcatgtaattcttcgactgaggtaatttgtctgaaggatgaaagccagttattgttcgtcaactcgaactgaacccttctattctttctttttgctaaagagaaatagaagggggctaactcttttgggcacctcttgtgcagccaattatcatgccaaaaactagttttagtgccgttctccaccgagattgtggttgccgcctgaaacaattttttatctaaatcatcgcaggggatattcataccaacccaaggtttgtcgtcggatttccaagaaaaccacagccagcggaggcgcaaggcccttgcgaatctttcaaggtcaggaagaccagccccccctagagattatggtctgcaaactagttgccagttaatcaaactgtcacctggattagtatgatcagggtcctcgcctttccaaagaaaggatctgcgaaaacggtcaatccttttaaaaacccacttgggagcgcggagggccgttagatggtgaatcggtatagagcttagaaccgaatggcctagagttttacggccatcagaggtgaagaaccgccccttccatcccagtagacgtgacccaatcttatcaataagcgggatgaaatcaatcttccttagttttcgatagtgaagaggaagtccaaggtatcggcaggggaaggatttaatcatccccgggaaacttgaaagaagattgttcaaatctatctcatcacatctaataggaaagatttctattttgttgctgtttggatggagcccagaaatttttgcaaagaaatcaaggatgtgagagggaagacagttcggcactatttggatttgcaaaaactgccacatcatctgcataaagagaacatctgaatcttgcattgcgtccatttaccggttgaagaatagtagcatcttcagccgctttaagaattcgatggaaaggttccatggctaaaatgaagagcataggggacaaagggtcaccttggcggagtcctctagcattgttgatcaagtgacctggcgaaccatttagcaggacctgagaaggggatg

SEQ ID NO: 642 - DNA, 6285 bp, Oryza sativa
  unsure (1)..(6285): unsure at all n locations
nnnnnnnnnnnnnnnnnnnnnnnnnnnnnnnnnnnnnnnnnnnnnnnnnnnnnnnnnnnnnnnnnnnttatcaataagcgggatgaaatcaatcttccttagttttcgatagtgaagaggaagtccaaggtatcggcaggggaaggatttaatcatccccgggaaacttgaaagaagattgttcaaatctatctcatcacatctaataggaaagatttctattttgttgctgtttggatggagcccagaaatttttgcaaagaaatcaaggatgtgagagggaagacagttcggcactatttggatttgcaaaaactgccacatcatctgcataaagagaacatctgaatcttgcattgcgtccatttaccggttgaagaatagtagcatcttcagccgctttaagaattcgatggaaaggttccatggctaaaatgaagagcataggggacaaagggtcaccttggcggagtcctctagcattgttgatcaagtgacctggcgaaccatttagcaggacctgagaaggggatgttgccaggatatgagagatccagtttatccatctgttcccaaaatcgaaatttcatagagcttcaagtaagtagggccagcaaacagtatcaaaggctcttgctatatccaccttgatgaataagctttgcttttttgatctatgaagcagctgtatcatgttttgaacataaagaaaattgtcatgtaacgctctcttccgaacaaatgcactttggttctgggaaaccaactcattaagtcttggagctagtctattcgccaaagttttagtgattttccttgcaaaactatggaccagactaataggtcggtaatggtcagcgccagaagcgtcatctttctttggaatgaaacatataaaggccgaattcagtttttccagttgagatgtgttaaggttcatgaacgaattgattgccaccatgatatcatccttgataatctcccaggagactttgaaaaaggatccaataaaaccatccggacccggagccttttcgggaggtaatgagaagatcgtcgcttttatttcctcctccgagaaatcctcctctagttccgaaagatccaaggactggagccctaaagcagcccagtttagacccaatgatctttggttatttgtcccaggtctggatttgaaaaaacggaacagctcgtcttccttgtcttgtgccgatattgccactcctgagggagtttgaagtgattggatgtaattttttcttctcctagagtttgctttgatatggaaaagttttgaatcaacatccccctctttgagccaagtgagcctcgagcgctgcctaattttaattttattaagggttgagagacctagaaatcttgatttgagattggagaggagtaggttctcttgatcagatagtgacctggattctcgagctagctaaagctggaaaattacttcagctgcaacagctaattgcaatttgatgtctcccacattgcagcggctccatctcttaaggtcacgggctaaacgccgaagctttaggcgaaagatggctagtcggttagatgacaaaatcggcttttgccaagagtgttggaccacttctagaaaacctggaacttcaagccagtaggattcaaatatgaagttggaagatttgctcctcttttcattacccagtaaaaagagaggtgtgtgatcagagcatgcagaggacagagggtgcataatggagctctcaaacatcaagtcccaatccacagaagcgaaagcacggtcaatctttgtttgtgcaggatttgatccctcacctgcccaagtgaaacgccggcctggaagaggtaattcttttacctggatcttgtctaagagtctgcggaaatgttgcatcatcgctctgttaaggcggctattgtttttatcacaggctttgtaaataagattgaaatccccaataattaaccaagcaggtttcaaagagacttgaatattttcaagttcagctaagaagtttattttgtcagcatcaagttgtggtccatacaccacagtgatagaccaatttagtccttcttctcgcatggacaccgtagcagagagggagtactgaccaagaaccacttcggagattgaaaagaaattttcatcacatgctagaagtatgccgcccctagtaccatctgccggcagaaaagcatgttgctgtacaaactggtgacccaaagtgttgagaataatttgattggagatagcagaaagtttcgtctcctgtaaacagacaatcgtcggtttatattgctagatgcaaactctaacagagtcttgctttactttggcattcaaacctctcacattccagttaaacaggtaaacattgtcttgtgacataggaccaaaagggcacagcaactctactctcgcagaaacactcccaacgacgatgagagaaacacagcaagagaggtacaaaatagggacagcccaatacaacacaggaaactagacagtaggaagcagcttgacatagtggcaactgagacttgaacatcagggttggagacgtcatggatgttatgctcgatgacatctcagtagtaggggcgcttacaggggtgccacgaccgccttcttctttgcagccttcaagcggatggctttgcatccacccttctccactagctcggagattgtcttcaaagaggctggggataaaggcttgttgaagtgctgcaagtaaagctttttgacattatcatcaaaagaagcgtgatcatccatgaaaccaaattttttagaaataatttcttgagcaaaattctctaacttcgcgtctgaacgccgcttggaaagcaaacgagcactatgtctttgcgctgaagcaattgcaggaactgctactttaacacaggcatggcggtgagtgttgacgtcgggaacaggaagaagcgccggccggattggggtcgaaagctcagcaaggaaaccatccatctgatttccggaacttttgatctttggatttggactgacgagccaagagccatcccgaggggtggtcctttctcccttacatctgctgatgaagaagggttgccgacagacatcccgctccccgacctagagccccatcgcaatccgccgccctctgagcccaaagaaggctggacctacaatgtcctgatccatgtcgacacacttgaagacctccactcgcgcaaggcccgtgcctacaagtgggactacgaagttcaagatgatgggtcaaggtacaaggagtatccgctgccttgcagagcggaacctgatcctgctcggggtcccagggacgacaatgatgacaacgatgaccagtccagggggcgccataggagtcgttccctttggaatcgccttggtggacactcctcaagtcgcagtagggaacctgataggagggatgtgcaaaggcgtgaccaagagaatattggatgttcatcagcatattggatcactgggaaattatcatccccgtgaacagggataggcaaagataatatccccctctaatgtgcttatagcctgaagaagatctgctcctatggcaaacagaaggggggacaaaggatatatcgatccccttgtcttacacccctcttacattgaaaaaatttaccaggaacaccatttaatagaacaactgttgaggtagacgagaacatactcgtgatccattcattccattggggagggaaacccatagctgtcatttcattcagaatagcatcatgatcaattgtatcaaaagctttttcaaaatcaagctttagaagaactatctccctcttagacagcttacattgatggatgtattcgaaagcccatgctaagtagtcctcaatagagtttcctttaataaatccatactggttttgatggaccagctttgtcaggattgattgaattctatcagcaagaactttgcacataattttcactgagaaattcattaaggaaattggcctaaaatcattaggaggctgaggagccattttctttggaacccatgtgatataggaatagttgattgcagaaagatcagctgagttcccacaaaagtctgcacaaagccgatagaaatcttgagcaattagtccccaactggacttgtaaaagcatccattaaagccatctggtctaggagcttcatcaccagggatccttttcaccacttcatctatttctttggtagtgatttgtaaacaatgggacataaggtcacatttatcctcaataagttcactcagatcaaaaaccattttaggtttcatagaaacacccattctttccctaaaagcattccaaagaatggcagctttcccctcatgatcagaaacttggtttccaacagaatcaatgagagaagagattgcgttaattctaaacctctcagtagccatagcatgaaagaattttgtgttttctctaccaagaagaaccatttgtttatatctctgcctccaatattgctcttgccagttcacgaagttcttccaaacgatcaaacgaaagaattactttattacaattctcaatagccttagagagccagaagaaagaagaactccattttttttaagaaaccttctgagcttcttgaacttggcatagattagtttggtctgatcctgaatatacccaatatccacccaagcattagagacctgctccttgaaaccaagctaggaaatccaaaaatttttaaaacgaaaaatattggattttgggatcattgtagcaatctgaattttaattggggcatgatcaaacacatttttggctaacaccaaagcctgagtgttggggtatctagaaatccaattggagaaggtgaagacccaatcaagttgctctaaaaggggatcaccctgcatgttactccaagtaaaagcacggccttgaagagggatctcaagcaaactgagaaaaatgatgaattcattgaaaataaagatatcattcatgtttcctcctgtcttatttctgttcaaaaccgatctataaaaattaaagtccccaaggatcatccaatagtcattatcaatctggagatcatgaagccaatcaatgaactcatctctctcaggaccatgggatgggccatagacatttaccaaaacctattcctccccatttattttaaaaataaattgaacctctagggcaagttgagtctgttgcaataatacccccagaagctccaaccgaaggagaaaacaaataattatcaaagcgtcttagagccaaggatctaatgaaactatggtcaaagtgatctttttttagtttcctttaaacagtagatcgaacaagaactctcatcaattttctgcttcacggcttggcagcgaactggagaatttaggccacgaacattccaacataggacattgcaagatatatttggaggattcatatatcaaatatagacaggttacccaatcccatgcgaagcatggaacaaaagcaaggaagtgtatatttaaaatttataaatgatctctgatggagacaaaacatatataaaagttgtagatatagatgacatctacaattttgtagttgataaaattttcggttgagcacatatatgctgctaaatatagattataaatttggataacaataatcacaaaacaatagcatggtaagaatctttagaagcatgtctatgaatatgggttgcaaaaatcatttgatatgtgggaagcgaagtgtgaccttacaggggcgtaatgaaaatatcaaatattttttcatgtttcttagcgcctataaaaataacgagacaattgcatatttgaccctgttttgaaccctaactaccaatttgaccctacttcttgaagtttgcttatttaagcctccttttcaaaaacgaagctcccgtatgaccctgttctgttaagggcatctaacggtgttaactgaagtacaaaatgtctcttctgcccttactcatttgaccctattacatgtgggacccacccgtagttctctcttctcctctcctctcttctcttccttctcctctcctctcctccattgggcggcgactgatggggcagtggcggcggcggcgctctgagggggcgtaaggagggagcggcggcggcggcggcggtggcggctgacggagggggcgagttgcggcggcgcacggaggtggcgagcggcctcgctggctcatggagggagggaggaatgacggcggcgcaagcgaggaaggagggagg

SEQ ID NO: 643 - DNA, 5083 bp, Oryza sativa
  unsure (1)..(5083): unsure at all n locations
ataagtctttgcggaagacttttgcccaaacatatctctaaggaaattacataaaatatcctaattaatagagacaattcccttcttaggactctattaatgtgtggcaatcatcttgaagcatatcaactgaacccgatgtcgcacaccaaatcgtattgtcggaatcagctgtatcggcttacccagtctgactcggactcagccgattctgatcgtagccgatttggactccaaccgattcttactctgtttccgcaacgatcttcaccttcgattccgcttcgattcagtcttcttctccgatactaatattaccaaacttggtcgttaacacatgccccccaagtccggaatattggataatgtttcggattttccatatgccgattccgaaagaaatccgctcttgtcattttccgaccgttactcccatgctttaaatactaaccgttacccccaagaaatctcacatcatcttcttccgttttcaccgctgaagcaaattttgccctctctctctctccggcgattcctccgacgcaaaaggcgatcccagggcgattccatctccggccagatctccgcctgcagtgatgtcgtcctccgacaacctgcctactgtgccgtcaaccgagtacgatgaggtgagttcccatcggttagatctccttttcccgtatcggattgatttcccttttcctcatcttgttttcttcttctcggttcttttggatttgcaacatctttctaatttgatcgcaattccaagcctatctcacgagaatcattattttcttggtccaatcggcaaccttgatcccaccgagttcattattggtgaaacaaataggattcctttcagattagccaacccagatctacatcactggaagaacacctttaaatcttggccatcacttgagaaaacccacccgagaagagctggattacatggtacaagcgcgtatggccaacaaaaaagttcattgggataagatcggaatcggccaagcgcttgcccttaccatagccaactcagctaaggacggacctctgatggctgccgctacctatttctggtccagcaccatcaatgcctttctgttcaaccatggaccgatgactccaactttgatcaacaccaccatgatcactggattagatgtaacttcatcggctaaccctatgagtatgaataccaagaaccaatttgacttcaagaccaaaagcataggaggttggtctggctatgtagcggcatatatgggcaaagggcctatcactcctcgggagcatgtagctttcttactaatgtggctagaaaagttcctcttctgtggatccagctatggtcctacaaccaattggcaatttgtagccgaagccctggaatcaaagaagcaatttcccttaggcaaaatcctcctcggcaatctataccaaatgctgaataatgcatcagccaagatagctgtcggctcagtagtgggagtaggtggaccatggtggctgctgcagacttggctaaatctgatggtcatgaaagttgtcaatcggccatctgtgacaaaagctgaatttccaaggttggagccgattgtggaagatgcccgggtttggtttccttatgaagactcagcagaccttgagcttccatcggactttatatttgaatacatcaatcatgaaagatatcaaaagtccagggatgtgttctcagctgcaatcagcccatgcattcttcctttcggcattcatcaaggaagaaacattcaagtctcttatgaattttatcacccgatgagctcagctagacaacttggagtgggtcaactcccaatcggcttattcttcgccgataagatccaatgccgaggagaaatttcatcaaccttaatgatggatcggctgctaaaaaactaaccatatccatggcgactctcttctctggcgacgtccatggcgactctctctagaagatggtcacgccggcgccgcctactggatgggatttctccacgggggattccatccgtgatgaagtttggagccgttttggttcaccggttcacttttcctctcattttagccgttctacgtttcgattagtggttgatgttcctcgttcttcgtttcgattgacctcgtcctcggtggcgcttgctcttagagcggcgattggtggttctccgtctgatcttcatgttgatcctttgattgatcgaagttttacttttctggtgtgttctaagaaagttggactctggatctactctctcagatccttttcttgtaaggatttctcggttcggtattttctctggaagaatggaggtcctgattggagacgggaatgggatctctggcaagctgagcaatataatgaatggaccattgtaaagcggcgatattcttcgggtaatcgttctcagcatttgataaaggcttcttctgtttttgatcgtcttaagtttgatattccatcatctccgaagaggattactcagaagtctgattctattgtctccaaggaaatttttcttgctaattctgatccgaaaggtacgcatcttaatcgtgataagcgcggaattcttccttttcaaattagaaccgatctgggctggtttgttttcggtgtttgggctctgatcacctcatccgggattgctgctcggaggttagatgtttgcattgtaaaagtctgggccatattaaaaagttttgcccttctgttgggcttgttaagtctccatggcccaataaagtggtgtctgctaggggcttgggaaaaaaactgtctgtcccaaaaaaggagcaacccttgcgcattaaaactccacctaatcaggtctgggttaaaaaaaataagaaacccccttcgtcttctccttaagttgctcgctctctagtagtggcgtcagaatcgcagcctcaacctaatcctttccctgctccaatggcaaatactaaccttaatccccatcgcttcctgcgtgcggggcaagtggtacatcaaggtggtgatcgtgtgccaagaatcaacctctctgctgctaccaagccgccaaggtctcatgaagagtatgccagctttggttgagcccatcttgccggaggaactttgggatgatcatcggattctaatttctgaatacattgagcaggtgcagcactttactgttcgccgtagttttcctcatgcttcagctgtgggtctattcaagtttggttctgccatggttagggacctgctagtttatgctcccccttttatgtatgatggtatacatcaggtcaactttgtcagacatgatcagagtcctaactggcgtgctgctccatttactagaactgtctggtttttattgctcgatttccccctagattacatcaacatgcagtacatttgtctggttgtctcttctttcgggcagttggaggaatggtatcaaaatgacccaatagagggcaaagttttggtcagagctatgttcaaggactttgattcagtcccaaggaaaattgttcttcaagatcccacaagtggtgctggtgaatcctggaccatctctgtttttaccttggagggtgattttgctgatatttttccccctgatgaagaccttccccctactggtccaaataatgatgaaaatcctgatggtaatgatgatgacgatggtaatcaagataatatttggcaatttggcccacatcctgtggttcttgcagaaagaagaccaggcttggaatcaggctgctgtgggccatcaggccatggaccttgaacaagctgctcctgagaacatgggccagattgataacaaccatggctggaatctggttgctaacagaggtttaattttcacccttgctgatgctttcaaagatgccttcaattcctggtatgccaactctctggcaaattcagcccttcatcctgcaaagcttaattttaatttgggaaatgaaattgtgccgtatgattctatttcttttgaatcttctgctataatcctgagccgagaacctctagctgtcatccctccgtagtctgtgatgcctattttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttagggatggtttcaagaatattctgcaagaggatccaaacatgggtgttggaaagccaagagggaaggcagttaaaaagctgaaacagttggctgaggtaagtggaattattttcccatccgattcattatcttctattgatttaaatcctgatatatcttgtgaatctgaaagtgatcttacatctgttatacctgctaattgtgatatatcttttctccagaagattggatctgagatgtgtgggacttcccttgaggaggtttcaagcttggtggacttgggagaagctcaggtcatcaagctgaaaaccattggaccatccaatgatgaagcctagttctatcagacttttagggctgctagttgcactctttaggggcatgtgtttattcctttatcaacccttttattttgtgtttaagttatgtaaactctatgatggtactatgtgttggtgtgcttgggacctgcatggattattcctgcttgttatctttctctcttcaagactagttgtcaaatgaattcggctatgagaaattggaatgtcctctgctggaatttaggggtctgaattctgatgacaaatggttagccactagaaataaaattgaggaaagtggttgcgctgttttttgccttcaagaaacaaaaagatcttcttttgatcattcttacataaagaagtttgctcccaaacattttgacaagtttgctttctctccatctgttggagcttctggtggcattttagttggctagaacagttcagtttttcggnnnnnnnnnnnnnnnnnnnnnnnnnnnnnnnnnnnnnnnnnnnnnnnnnnnnnnnnnnnnnn

SEQ ID NO: 644 - DNA, 4063 bp, Oryza sativa
  unsure (1)..(4063): unsure at all n locations
tcaagaaacaaaaagatcttcttttgatcattcttacataaagaagtttgctcccaaacattttgacaagtttgctttctctccatctgttggagcttctggtggcattttagttggctagaacagttcagtttttcggggatcagatattgtaattgaaaggtttgctgttaagattactttcacctcaaatcattctggtttagtttggactttcgtttaagtttatggtccctgcactggtcctgaaagaaataacttcctgtcctggctccaccagttgaacattcctgatgatgacctctggctcattcttggagactttaacttctatagatcagttacaaatagaaataggccgggtgcagacatgaatgacattttcctgtttaatgcaatgatcagtgatctgggtctagttgagttgcccctcaagggaagggctttcacttggagtaacatgcagcatagtcctctactagagcaattggattggttttttacctctactgcttggaccttaaccttcccccataccttagtaaagccacttgctcggtctacttcagatcacacaccttgtgttgtgcaaattggaactaacatccccaaggctgacatcttcaaatttgaaaatttttgggtagagcatgatggtttctttgatttagttcaatccatttggcaaaatcatgggtatgaaggtaatgcagccaagaatatttctgttaaattgaaggctttgaggaaaggtttgaagaagtggagtaaatctctctctaaacttcaattgttgattaaaaattgtaatgctgtcatagcttttttggactccattgaaaacttgagagatctcactgttcttgaatggaactttagaattcttatcagaaacaagctactactatacctgaagtataaacaaatttattggcaaaagaggtgtactatcatatgggccaagtttgggggtgagaatacaaaatttttccatgctatggctactgagtcttttagaagaaatgcaataccctctttagtagattcttttggtttagtttgtacaagacatgaggaaaaggctcacatagcgtggagtgctttctcttcaacaatgggttgttctcagtttgagtttatgccttttcagctgcaagaacttttccatgcaaatcaatctcttgcttctttggatcaaccctttggtatttctgagttagacaaaattatacagaatctgcctatagacagagcccctgggcctgatgggtttaatgggatgtttgtttagaaatgttggccaatcatttgtcaggattattatagacttgcagctgagttctactatggtacactggacctggatcctttaaaccattcttttatcatcttggttccaaagaaatctgtgccaaaaggtataaatgactataggacaatatcactcatgggaatctctcttaagatttaaacaaaagtcctagctgatagactgcaaaaggtgatattggagataatcagtcaaaatcaatatggattcataaaagggagaactatacaagactgtctagcatggaactttgaattccttcatcagtgccatcactccagaagggaaatagtccttctaaaattggactttgagaaggcttttggcactattgaacatgaagctattttgcatgtaatggaagccatgggttttagtgctacatggtttggatggataagaaagatcttttcttctgcttcttcttcagttctggtcaatgggatacctagaaaaaatttccactgcaagagaggagtaaggcaaggtgatcctctgccacctttactctttgttttaggagctgaacttctccaggtcattgttaacagagcttatgcaatgggtcatctatcaaagccttttccatcagactttgacccaaattttcctattgtccaatatgctgatgacaccctgctttatttgaaagctagtggttaagagctctttactctaaaggctttattgcaaactttccagctgggaactggtttgaaggtaaattttaataaatcttgtctcatcccaataaatgttgatgaatggaaagctcagaacttagctgcagttttgggctgtcaattgggatctttgccttttacatatttgggtttaccatttggtaccactaagccaaaggtaatagattttgcacctttagttgacagaattgaaagaaggcttacatcaaatgcttcattcttgtcttacggagaaagacttacactggttaattcagttttctcttcactacctacttattacatgtgtactttaatgttgccaaagacagtgattgataacattgacagagcaagaagacattgtctttggagaggctctgaggtcaactccaataaaacatctttggcagcctaggataaagtgtgtaagcctaagagaaaaggtggtttaggagtgctaaactttactatccaaaatcatgctctgctcatcaaatttttggacaagttttacaataagaaggatttgccctgggtcaatctggtttggtttgcctattatggtaactctgtccttcatttgacaaacttgaagggctcattctggtggagagatatttgcaaactaatggatgtctttagaggtattgcaaagtgtaatatgaaaagtggaaatacctgctccatttggtatgatgtatggatgatcaaccccctctttttcacactatgccaaagctttgttcttttgctcaaaaaccaaaatgcatctgtctctgtgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggcagatgcatgattaatgcaagggggtacaaggggtaataatataggggttaagttttgcagaaagcagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccannnnnnnnnnnnnnnnnnnnnnnnnnnnnnnnnnnnnnnnnnnnnnnnnnnnnnnnnnnnn

SEQ ID NO: 645 - DNA, 3042 bp, Oryza sativa
catcatccgaggagacttgatctgacccttcactatcagatactctgccaccatggcttaggaggtgctgggtcaactgtcgtgcacctcggaaagtatttcctctttgacgtctaggaatagttatccctgctggaggccattcggtgctggtaatagtcatcttacgtacttctgcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctgcaatcatgacaaaaggggacatcctcttctggcattggaagctcattgacctgggtggcaaatgctcgatcaaacacatattgattttggtcttgacttccaaccaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagataggaccttaaaggaactaactcttcttgttgatgtgttgtttgtttcacttattctgcaagttgattaagcaaacaacctagcatggttacatcacaacccacagatgcaaaccacgcgctacacacacaagcaaggaaacacacgacaaacgaaacactagagggtggcttaggttctgcgacgggttcccaagatcttcactcctgcttcacagctggcttcactgcttcctccgcttcgctagcggatcctgcagtcttccggagcttcggcaaacgactgacgatgtcttcttcttcactgacctgaccatctagtactagttgaaaatccgaagaagggagaacggagtaaaccttttgcaaatagcattaggggaaggagaaaaaggaactttcacaaatatatttatttataaaatatgtccttaggttttatccacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccactccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccaatccgtgtacttttgtttataaccagactgaaccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaatttcatagtgtccaaatgatatgagaattcccaaagtctaaagttataaaaccacctaatattgcctaattaatcagcgaagcatctacctaaattcatactagtggaaccataaatagagtacccactagttggggttttgtttatcctagggtgaacaaggtaatagtaacaatagcaataataatgaggtcataacaaaggtaaataggcatggctaaataaaacagtgataacgcgggaatttaaataaagcgataatgcattaatttaaattaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagtttagccatttgaagttatatgctctttaa

SEQ ID NO: 646 - DNA, 3784 bp, Oryza sativa
  unsure (1)..(3784): unsure at all n locations
atctcggccgccattgatgacgccggcgagggtttcgggaataaatccgagcgaatccgagggagagagagaggggaaagaggggggaaagagggagggaatcacggggagtgatttccccctctttatggcgcgcggggacggcgggatgcggcggattcggcggcggcggcggcgctagggcacgggcgggcggcgggtgcggcgcgaggacagggatgacaggtgggccccacccgtcagcgagggtggcgggcgggcccgcccgtcagcggcgcgcgcgcggggagaggccgagtgggccgcggggaggaggagagggagggaaggagctgggccgagccggcccagtaagggaagggggggggaagaagactttttaggatttttctttttataaaaccattctaactttgtttatttcttaataattattatttgtgctctgaaaattccactaaaatttgagggctccttttagaccaaggagaatttaacaaaaattctccgggccacatttgaatttttcttatacgcattttagtgtttaccaatttcttttcgaattttaattaattctattattccttttagagaatgatttttatttcgggatgaatttatcaggacgtgacaaatccaccccccttacaagaatctcgtccctgagattcgaggaggctagcatgaagataggttgggcggtcttctcttcttgtctgacttcttccgctccgtcttctataacaaacttgcctaacaacacttctccactctggactgcttggctcgatctcctgttgcaggtggaatcttctcttcacccgacttgtccctagttgaacctttagctgacttcgactaggttgcggcacttgaagatggggcttcagttccagaacttcttataattcatatcttcggcgtcaacctcacacaagttatcaacttcatatcatgtgtcgtaacctgcttgtcattactaggataccatgcttggcgtttccttccagcttaccaccatatgctttagactatgatatcccacttaccaaggataccatgattgacaacttgccattaactgtctcattttagctttcctggtctccggtgctaggtacttctgctattcgatgcaagggtcaaccactctaactataagttatgcttcccaggagaaccaatttatcccacttgacatgctttgacgtcttcccgaatgactttgctgctggacttgttattgtctgatcgtgatcctgccagatctgaagcttcgttgttacaggtgattttaatctgacctctgtagactatcttcgatcatatcacttggttcataactgggaatagctcccacgaacaagcagctcggattcactttctttacattcagtttacttcccattgttatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccctgccttcatagaaacacttttacctaggtcatattgcttacttaatgacaaggtgactgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagtgaaaccttgatgtggttcgtcacaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaattattgatgtctcctggatcttcttaactgtttgcaggtatatccgaacttatcaatgtagaggcatggcgggtacccttatgggtttcatccaacaagccttatcttgatctgtaaaaggcgtatccaaactcctatccccaactactgtctcattggctttttaacccaacacagtttaattggttttcttttccatccacaggttggttattaactcgaggttagaatatagttcctctgacacgagaccctaggtctcctttgtcagtaaacaattatacacctgatcacatatccgcatcttccaaaagaatcctcttagaacttgtctgtattacacatttctcccttattacacgaatacaaggcactgccttaaacaaaaagggaaggtgcttatcatcgatacattgtatcctcaacatgaatcatccctaaacatagcaagctcactgtttacaggcatgaatatatttatttattacatgattgctgcaaactttcgattacacattgataagtagcgaactggaaaccacaaacatggatacatagctggcattgttctagtgactgcatccttgattggttctgtgatgatgtgataggactgcatattgctattattcaccggagaagtttccttctgattgctggttgaggcgaataacggtcttctgctcggtatcgccctccggaggttgattgccctttgcttggcctggagtaggtcggggagagacacaacttctttcatcgacgacaattctttgctgaggctgtcggtgcagagaatggttggtgttgaaggtattatcgctatgatttattgcagagtcaggtgcagcaggaggagcattggtgctggggatgatatcgtcgatgttgctgttggagctgactagctgatgagacaatcgtagggttgttcgttggatttctgcggtcttggtcaacaacaccctgagttggcaatccttgggcacatggtttgcaccttcgcacagaaaacatgtgaccttgcgggtgggacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcatcatccgaggagacttgatctgacccttcactatcagatactctgccaccatggcttaggaggtgctgggtcaactgtcgtgcacctcggaaagtatttcctctttgacgtctaggaatagttatccctgctggaggccattcggtgctggtaatagtcatcttacgtacttctgcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctgcaatcatgacaaaaggggacatcggnnnnnnnnnnnnnnnnnnnnnnnnnnnnnnnnnnnnnnnnnnnnnnnnnnn

SEQ ID NO: 647 - DNA, 2041 bp, Oryza sativa
ttctattattccttttagagaatgatttttatttcgggatgaatttatcaggacgtgacactctgattatctgtccattgaggctgaagaaaattttacactacctttatctgctcaagcagctcacttcttcccttctagatatcgagctgattaatgaaaatgatgtttggtcttacatttggggaagtatgaaatattcttcacagaaattctatgcactgaatttcagagttattaagccaccagttcattttctatggttatggaagtgcaaagtagtttcaaaagtaaaaggtttttgggtggctactcatgatgaatagattaaacaccaagttcatgctagatcataagaattgtgctcctccgaattgtgatctttcttgtgttctttgtcaatcggcagctgttgaagacctcatgcatctgttctttttatgcccgtttgcccaaaatcgttggagtcttctaggcattatatgggatactaatctatctttggaagcaatgtttataagggctaaattggattatcaggggagctgtttcatggagaaattcctttatgctacttggcatatatggaagcaaagaaatgggttcatttttgagcaaaagatcccttctttcatcacttggaggcaactcttaaagggtgacctcttccttctgttgtttagaatttctgcgagatatcacgatataatcataagttggattaatgggttgtaactttgttcttgttttcttaataaagtttttctaacagtgggggcctcccctgctatgttctttcaaaaaaaaatggatcggctgctcaatctccaaggacctcctctgggcagtattgaaaatatcgagctggcgggattcaagagcaaaaactttgacagatggtggggcgagtggaaactgcatttattccaccaatcagcttctatgtatatgatagatctttttcctgatgtcatacctctggtaaactttgatctcattagttctgtttgaacaattatcagccgattcataatttgactaaccctctcttgtattttgtagacaacataattttcccctccacatcaaagcaatagtagagatatcaaatatgccccaggtctaattcaaaatggaggtggaccatctcctctcgtcatcggctataatgcccccaagacctcaacccttcttcaaggcctcatcagagaaaaccagccgatgcaggcaagaagagaagaacaaggtcatcggctgcggacacattagctctagcctcaaagaagaaggctaaactcaagaagcctaaaccaactgatgatctgcctgtcctagatccatctattgaacaagctctggatgaagaagacatcgaagatgatgttgatcaagctacagccgaagtaagcaatacagaaaaaacaccatcggcttctcccaagcagactcctccaactccttctgccccaactcatttttcaagagtaagcagctctctttaatcctttttgaaatcacttcattttttcggccgattaatcacatatcgtatagctgcagaagaagaaaactgctataaagaagaaatcagcagcaacaactatcaaaccagctccaccagtaagacattcctaatttttactagttgattatagccgattttgtctaacacttgtatcttttacagcctcctcctcctccttctcctcttgtacagcaatcatcaagtgaccgaactccatcggctgtggggagtcaccacattgaggaagaaatacaaccagctgctcctgccatcccggtaagtcttgtcttataagaatcttgaatcggccatatgactcatgtcgagactcaatttaaaattctttcttgcaggcgttagctgatctgttttctttcgacattaaagactatcttgacgaagaaacagaagaagataccaccagcaaatctttacttcccttgtccgatgatatgaagaaaacccttgaagacatctctcatcggctggaagcatcatcactggaaaacttggtgg

SEQ ID NO: 648 - DNA, 4018 bp, Oryza sativa
  unsure (1)..(4018): unsure at all n locations
gggcgatataaccatatcggccattgtacatcggcaaaccacagccgattacaatacgaaaaacagctaagggcaatataaccatatcagccatctcaaggcgatgtaaacacatcggctatcatatatcaacaacatcagccgatcatgcattaacccaaacacttgggtaatatttcttcaaatacttgccatttagcgctcgtccataaacctctccatcgagtccttgcaacatgtaagctcctttagacaccactttatgaatttggaatggtccttcccaattcggcgaccacatgccgaatttgctatcccgagtcccaatcggcaaaatcaacttccatacaagttcaccttcggaaaaatctttaggtactaccttcttgttgtaatgccgagcaacccgttctttatccttggtaacctttgcgagggctcttaatctagactaaaccaagtcctccctttcatcggccataaggttacaatactcatcagctgttaaattatcttgcagctcagttctgcttgagccgattctaacctcgcatggcaaaacagcttcatgtccataaacaagcttataaggagggacttggatcgatccatgacaagccatccgataagaccacaacgcttcagccaaccgagtatgccgttgccgaggataatcagaaatctttcttttaatcagtttgttcaaactcttgttagatgcctcagcttgcccattagcttgtgcataatatggcgaagaattcaacaatttgacacccatgctgtcggcaaactgaacaaactcatcggatacaaaaattgaaccctgatcggttgtaatggtttgagggataccaaatcgatagattatatgttcttgaataaaatgtatcgcatccccagaatcaaccttcttcaagggaatcgcctctacccatttggtgaaataatcggtcgccaccaatataaacttatctcctttactcgatggaggattaatcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatcggctgttattgctgcgacctcgaccttaacatctttgatcatcggcttataccccgatgccccctaggccaaatcattagcttcaatattttgttctcgagatacatgcttcaaagataaccaaccgaaattccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaagagccgacgacttagataaaacacaactctctctttcccttcaagctcctgaatcaaaaccgagccgattgacttctcaccggccgacagatataaccgaaaaggtacccccttctggggaggaatcaaaactggaggagagctaagatattccttaatatcgtccaacgctttttgttgctctaccccccaagtaaactgttgatcggcattcaatctcaacaatggtgtaaaaggctctaatcttccagacaaattagaaataaaccttctaacaaaatttatcttgccgatcatctcctgtagttctatcttgttcttcggaggctgaatcttcttgattgcattaacactcctttgagttacctcgattcccctatcgtgaacaagaaatcccaaaaactggccagccgatatgccgaaagcacactttgtcgggttcatctttaggccatatttcctggttctctcaaaaaccttccttaaatcggctatgtggtcttctacctctttagactttacaaccacatcatcaatgtagacctgaactaaccagccgatcagatcgtgatatatataattcatggctctttgatatgtagcccaagcactcttcaagccgaaagtcatcacaacccactcaaacgagccgattgcaccaggacgcctaaaagttgtcttatggatatcttcttcagccataaaggtctgattgtatcccgcattaccatccataaaactcaaaattttgtgtcccgaggcagcatcaactagctcataggctactggcattggatattcgtctgtcggggtagccttattcaggtttcggaaatcaatacataccctgatcttgccgtttttcttgataacatgaactatactagaaacccactcagcatatcggcaaggacgaataaaacaagcatcatataatcgttaaatttcagcctttacgggatcaagcatatcagctttgcatcttctcggaggttgttgatgtggtctaacccctggtttgataagtagccgatattcaacaatcaatcggctgaggccaggcatctcataatactcccaagtgaagcaatctctgaattctttgaatagctctatcaacatggttctaaactctggagataaattcttactaataaatgtcggccgtcgtcgatcacctggactgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagacacaccggagaatgcatgattaatgcaagggagtacaaggagataataatacaggggttcagttttgcagtaaacagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatannnnnnnnnnnnnnnnnnnnnnnnnnnnnnnnnnnnnnnnnnnnnnnnnnnnnnnnnnnnnnnnnnn

SEQ ID NO: 649 - DNA, 1113 bp, Oryza sativa
  unsure (1)..(1113): unsure at all n locations
nnnnnnnnnnnnnnnnnnnnnnnnnnnnnnnnnnnnnncggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataaaccaacaattccatagtgtccaaatgatatgagaatccccaaagtctaaagttataaaaccacctaatgttgcctaattaatcagcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaggatgatgtgacttgccttgctcagagagaacggacttccgatccttcggcgacgaccgcgaaccacgcttcgggaacctccggaacgacagaagctacgcgaagcacacaagcaaagctacaagcctataaagaagcaataccaatacataaaaacaaagcacagggttctttaggttata

SEQ ID NO: 650 - DNA, 5544 bp, Oryza sativa
  unsure (1)..(5544): unsure at all n locations
nnnnnnnnnnnnnnnnnnnnnnnnnnnnnnnnnnnnnnnnnnnnnnnnnnnnnnntggcccccctaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtacggttgttcaggatggttgggcctgtgcagcatgggtgtgctgttcagtgttgattaaaatttctgattaattactccactgttttacttctcttaaatctttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgagagtggagccggagcttcgctagattttattttccgctgcagttttcttcttgatgaggactaagtgcctcataagtaggtatttatcgttttagttaatttgatgaatctgtatattaaattgttagtttgtgtacctcggttgattcctggacgaggattttatgcacaaattagttcggaaattactagtgaatttccgggcgtgacacctcttcctcgaatagaccaattggtgaactcaacagctagatgtgagttgttaagcttccttgatgcttactctggctaccaccaaatcagcatggcgaaagaggacgaggagaagacagcgttcatcacgccattcagcgtattctgttatgtcaaaatgccgtttagactgataaccgcgggaaacaccttccagctcacggtccaaagggcacttaatgaccagcttggaaacaatgtcgaggcctacgtccatgacattgttgtcaagacaaagacaagcgagtcattgatcgatgacctccggcaaacgttcgacaacctccgacgatatcgtctcatgctcaacccagagaagtgcacgttcggagtaccatcgggcaagctccttgtcacgcccggaagtttccccctttttcatgctttaaaattttgttaaataaatcgtctggagaaattgttttaattaacctagagatgagttccttaattaatgaatgcaattaataattggaattggcattgtgggatttttcttgagttccacatgtcacaatatattaacaggatttttagtggaattttcagagccttggaaataattttaaccaattaaaaatcaccaaagtgcaattttaaatcccacgaaaaatcctttcccctttttcccctttttcccttttcttttcctctttttccctcttcttgggccaacggctcagtccgccttcccttcctcccgcacgcgctcggccttcctcttgttgggccggcccatgcgcccctccctcctctccctgggtcaccgacaggtggggcccacctgtcggccccgtcttccttcttcagccggccacgccccaccgtcgaaaccgtcgctccccacgccgtcgtggccacgtcgctccttccgcgcccacctcgccgaccaccttcttcaccttttccgcatcagcgcgcccgattagaggccgtgattcggtttgaatcctgtctctcctctctctctctcttcctccctactcccccacgtcgccggccaaatcgagagggttcccgggcacgtcctcccctccctcgcctataaaatccttcccctgagccccctctctcgtttcccactctcgccgccccctcccgtgcctcctaccgagcccgcgccgcacgctgccgtcactagagccgtcgcttcgccgcgcaatcaccgcctttagcttcgccgccgcgagagctacctcggccgccgctcgctttccgtccgccgccgccgaaccccgattccctcgcatcgccggtgaggactacctctctctcctccttcctttcctctctctcccgtgcacgccgccgccctccgcacgtgcgtcgccgcgcttcggccatgcgccgccaccattcggccgtcgccgccgcttcgcgcgccgccggtcaccgccgtcggtggccgtgcctcgccgccgcctcgcctcggtcggccggtcggccttggggccgagccgagcccggctgacgcctcccccctcccttttctccccttcacgcgtgcgccgccgcctttggccgtgccgccgctccggccgtccgccgccgccttgtgcgccgtccgccgccgtctacccgcgccgccagtcaccgttggtggtcgtgtgccgttgccgctcgccatggccggccggccggctttgtgccgggccgagctatgcctagccaccgcccgcaccgtccgatcggcctcccgaccgatctggatcatcggtctcgtggaccggcggtggacaccccgcgtggtcccggtccacggtggaccggccgccttgtgccgctgacccatggggcccacttgccggcgccccctccctctctcttgagccgctgacacgcggagcccgcctgtcggcgcccccccttttgatgacgtcagccctgggtatttattgcgcaataaaaaattaaggactttttctttattagtaaaacacaatttatcttctaaaattcataagtaattcatccgagctccgtttaagtctatttaagtctcagtaaatcaagaaaaatgcaaagaatccattaaaaatggttttgtttcctgtttcagtagtcttatagcatgtttggcttgtgtgctttgtttgtcgcgtagatttcggccgtttcgtcgatccgcggtttctcgaagacgttgctgaggtctcatcagtgcgagagcaaggcaagtcatgcattacaattgatcatattgtacccaatttacaaatatcccgtatttctattaaatgttgcattcttttacaacgtcacgtgggatgggtcttattacttagccatttattgtttaccttatgccattgataacttgggtatcaaaatgactagatgttggtttagaaattgcttagccacgcctagctgaactagtacacaaatggggatcacattattacatagactttgactatgagcatagttttggattggtgccaccacaatggtgttagctaattaaaatgcactgaatggtgggctgtgggtgcatggttttgctggtcgcacccatggcagttaaggaccggttcacgggaaaccctgggagacttaccgtgcttaccacaagcgggagtgagtaactgcttgatctgaggtatagctcgaccctttcctaggcaccggtggcaagggtgagcgtgatggagttgggtcggccagggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggtgacatgtgtggaatcgtgtcttatgggtataggtgtacacctctggccagagtaaaactattcgaatagccgtgcccgcggttatgggcgatcaaccagattcaccgtgattagtctcacacctagtttagtttaatgaactggtgtagttcaggaggttggttgggcctgttgcaacgtggtgtagcgttggacagtgattgattaatactgcttaattactacaactgttttactgctttcaactactgcttttaaatgcctgctttatgcaaaagaacctttagccttctttggttatatcatgcatcatacctcctcttctggtatgacttgctgagtacagtgggtagtactcagtcttgctctcttttcccccacactagagttgatgttcttctcagttggagccgtctcagagaggttggtttcatcgctgccgtcaaggattgcctgtggagtggagtcgccccgctaatgaagtcaagtttccaagtctagctcgttttatcttttccgctgcaattgcaatcttttctgtttttgtaagacgtggatctgtatgtcaacaattgccgtttgtgtaccctggttggtcctggacagggatttaatgcacattcagcttagaaattctagttcgagaatttctgggcgtgacactcctcagattcctcatctctggaagagggatcgaagcaaatcccgagaagatcaaggcaatcgagaacatgaagtcgcccacaagactcaaggaagtccagaagctaactggatgcatggcggcactgagcaggttcgtcgctatgatgggagagcgaggacaacccttcttcgcgctgctgaagaaacaagacaaatttgtgtggacacaggaagccgaagatgtgttcatcgcactcaagcgctacttgtcaaatcccccagtacttgttgctccccaacctaatgaagaattattcctctatattgccgccacaccatattctgtgagtaccgttattgttgtcgagagagagaaggtgcaaagaccggtttattatgtcagtgaagctctccacgacgcaaagacaagatacccatatatccaaaagctgctttatgcagtaatcatgacatcgagaaagctacgccactacttccaagcccacagagtcacggtcgtttcctccttccaccttggagaagttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataatcattaatgagtagtgtgagactaatcacgaaaaacattgctcaactcacccataaccgcgggtacggctattcgaatagtttaaactctgatcagaggtgtaccactgtacccacaagacacaaccccacatca

SEQ ID NO: 651 - DNA, 6589 bp, Oryza sativa
  unsure (1)..(6589): unsure at all n locations
ttcacaacagtagctcgcganccggtccttaattgtcatgagcccaacatcaaaaccatatgctcacaacccaccttaccaaggttttaattatcaattaattaacatcacacgatttaccatcgtgagctaccatttaatacaatcatcattattaataataatataacatagtttataattaatccctttagttagctaatgtttctaagcatggctaagcaaacctatatatagcatttagctgaaccaaaccaatatataaggttcatgctagtcaaattataacccctaggaaaataaagccatcttcggccaataattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaaagaaaaaagaaggagatgatgacgtcagcatgacgtcaccccacggcagctggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggtggagctccggtggttggcggcgaagggggacgggcggccgaggttcccctcaccacggcgcacctaacggcggcgacggcaagcggcggcgacgttggaggcggcgcggcggcgcggctggagaaggccgacggcggcggcgagctaaagcaacgcggcggcggcgctacggtgcacgggagaggacgagagagggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttccgccggctggaggtaggagatggatccgacatgtgggccccacatgtcggtctcccgagaggagggcacgggcggctcggctgggccggcttcggccgcgcgggagagagagagtgttgggccaaattcggcccaacggcttaaaggaggggatttttggtctttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacagaagtcgtgagaaacaaagacatcgtcggccgcattgcgaaatgggtagtcgagcaaagccagtttgatgttcactttgtgccccgaacagctattaagtcctaggtcctcgccgatttcgtagccgattggactatgcctgacaacatgtcagatagtcagactgacagcgagacatagacaatggcgttcgacagcgcactcaatagccaaggagcaggggtagggttcatcttgacatcacctttaggagatcagttcaagcatgcaattcacctcaacttcagggcgaccaacaacacagccgagtagaaaggattactcgccatgataagagcagcagccgcactaggagccaaccgataatcgtgaatggggattcagaactagtcgcaaaccaggtgcacaaagactacaagtactctaaccccgagttacccaagtacctcgcagaagtcaggaagctggagaaaaggtttgatgggatcgaggtccgaaacgtataccgcaaggacaacatcgaaccagatgacctagcacggcgtgcatccatacgagagccactcgaacctggtactttcttggacgccctgacaaagccatcgatgaaagaagaaaacgacgaaggtagcatagttgtccccgacatcagttcgggggctacaggggcagaacaagtcgttgccgacatcgagaccacagacgactggcggaccctgctcaacaaattcctgagtagcgacgagttgcccgaggacgacgcagaagccgagaaaataacccgacaagccaaaaaggggccaaacggggtacttctcaaatgcatttcgttcgacgacggcaaacatctcctcctggatatacacgaagggatctgccggtcagacattggtcggaaaagcctttcgacaagggtttttctagccaactgtcacgccctaaaaatcgactaaattaaaaatgcatattttaaatcatttttagaaattattttaaaagcctacaggctaaaccctaattttctaggaaaattttcaacataaaaatgagctagataaaattttattaaatactatgcttgctcctctattttctagatttttctgggaattatttgagcaagggaagtatttttaataattaaaacaacatttcacaaattgttttatttcaaaaagttcaaaaaacccctccctaagccgttgggccgaattcggcccaatactctctctctcccgcgcggcccaggtcggcccagccgagccgctcctcctcctctcgggagaccgacaggtggggcccacctgtcggatccatcccctacctccagccggccgacgccaagccgagctcgagccgccttctttccgcctccaaatccgcctcgatctctcctctccgagtccggatttttgaggggttttgttcctctcgttctcctctatctttcccctcaagaaacggagcaatccgttgagtatcttgcccgaatcgaattcgtttcgatttaatccctaaaaccgagtttgaattcttcccgagtcgattcctctcgtttggagttcgatctcttcaatccaatgctatataaagcatcccctcgtcgtcctcttttgtttgccctctctcccgtcctctctcgtgcaccgtagagccgccgccgcgcgctttaagttcgccgccgccgccggccatcttcggccgcgtcgcaccgccgcctccgtcgtcgtcgccgcttgccgccgccgccgttaggtgcgccgtggtgaggagaacctcggccgcccgtcccccttcgccgccgaccaccggagccccgtcgacgccgtcaagccgagccgccgcgccgcctcctctcgtcgccggccgtcgtcgttcatcggttgtcgtcgtggtgagtaccgttgggttcgcctcgtcgtcctctttgtgtagatgccctccaatttcccggccgatcgccgtagctccggcgagctcgcaagccctagccagccagccagggctgacgtcagcatgacgtcatcatcccctttcttttttcttttttccaattttctaatagattaaaacttcggaaaatcataactaaataaccgtagatccgtttcaggtggttcaagttgctaaattcttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagctcaaggcaagtcacacagatcccaaacaaccctttgagcatgttgatcccgtttaaagctattattttatttcaactgtgcattgttttcgaatgtcatcgggtggtgaacctttcccagttaattattggccgaagatgactttattttcctatgggttataatttgattagcatgaaccttatatattggattggttcagctaaatgctatatataggtttgcttagccatgcttagaaacagtagctaactaaagggattaattataaactatgttatattattattaataatgatgattatattaaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtatcgtggtggtattgaggcgcatggtgacatgatgtggggttgtgtcttgtgggtacagtggtacacctctgatcagagtttaaactattcgaatagccgtacccgcggttatgggtgagttgagcaatgtttttcgtgattagtctcacaatactcattaatggttataatgtgataattaatttgactcctggtttggaatggtaaattcctggtttggagggttaatttgttcaaccggggttggttgttcaaatgtggttgggcctatgcaacacaggggtgttgtatggtgtttgtttaatattgattaattatacaactgttttactattctcttaaatatttattaaatgttgtttttgcaaatgagctatattatgccattctttgttatcctgtgcacttgcatatttgctgtgtggcttgttgagtatgttatatgctcattcttgcaatattcattcatcagaagaggagtgtctcagtgaaggtgatgatctggaggattaggcttgttcttggttaagatgcctgtggagtggagtcgccatagctgttccgtagattgttatcgttttatttttccgctgcgtagaatgttatttttttttgagaggaactatctacctctgtaatcttttattatttgcgagtattaaatagttatttatttgtactctattatcaaattgtcattgtgtgcctcggttgattcctggacgagggcttaacacacatgtaagcgtttggaattttggatagaaattccgggcgtgacaccaaccgcgctcaaagacgcttgtgacatggttcagcggtgtgaagcttgtcaatttcatagcaaatacacaagactaccagcgcaagcgctccagactgtacccctcttacttggccgttcttgtgctgggggctcgacatactcggaccattcccacgaggacagggcggctacaggttccttttcatggcgatcgacaagttcacaagtggattgaagcgacgcccattggagaaatcaaggccgacaatgccatcaagtttatcaaagggatattctgcagatacggattgccctcaccgcattataacagacaatggctcccagttcatcagtgccgacttccaggattactgcattggattgggagtcaagatttgctttgcctcggtttctcacccttagagcaatggacaggtcaaaagggcaaatggcatagtactacaagggatcaagacccgtgtctacgatagactcatgtcacatgacaagaagtgggtcgaagaactcccctctattctctgggccatgcgtaccacaccgacaacatccaataaggagacacccttcttcctcgtgtatggcttagaggctatgctccccacggagctacgacatcagagcacacgagtacagaagtactccgacgaggaacatgaggagcagcgaagcgacgatgtgaatctactcgaagaacatcgagaaagagttgacgtcagagcagccaactaccagtaggcccttcgccgataccatgtgtggagattatggttatctcatatctacatggcggttatattccagctggatatgtcgcgtcccaaatcgactctaaaattcatcctcgaaattgtgcaaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttgaaaaggtttataaa

SEQ ID NO: 652 - DNA, 3595 bp, Oryza sativa
  unsure (1)..(3595): unsure at all n locations
gttggtcgccgtcgtcgaccatcggggcgcgggtgcgcgccgctcccgtcggccgcgccgaagagcccgccctcgggcgcgccctcgcggctgccaagtgggcccgggcgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatccgtttttaattaaaatttaaatgaagaaattcgtaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctaggcaaacaaaacctcaactagtggacactctactcatagtaccactagtataattttaggtagatgcttcgcaagttaattaggcaacattaggtggttttataactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcataggcacagggctggtgtcctgctgctaggggctcagtcctgcctgcctgtcccgggtattccggccgtaggtgggattgggtcggtactcttgtctatggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcgatgggtttcttttctggcatcgacgacttcgccttccctcccgggcaggcgttccagttcggcagcctcaacttcatcaccaacgacttcggcaagatctctctccttgactcggactcaaaccagtcggggagagaccaggtccccgtggcattcggtattccgaactcggccgaggcctactccaagatcatctctcccgagtcggcttcaaaccactcggacgagatccaatctactcttccgcgaccagatcaagacgacgggtcctatccctcaatcctgatgaaacttcctgatgatttggccgttgtcttcactgccaagacatctcccacccgaagatctaggcgagctccggcttcggccccgatctaatctagatccagagaggttggcgttatactccaacctcttgggacagtctcaacggaagagttggatggttaccttagctcccccggcttcagttctcgaccaaccgagatcctcgactatgacaatttcggctaccactacgaccacggtgacctcgacaactttgacgacagctatgaggataactacacgcccctcttcttcaacgtattcatggctgacaacgaaacggaggaacagcgtcaagcccgagaagcagaccaagatagcgcacggcaagaagctgaacgtcgccgactagaggaagagcgacagcgacaggagcgagaacgactacagcgtgagcaacaagatcgcgaacggattgcaaaggaggctgaagatcgacggcaacgcgccttggaatctggacgctgagtgagagagctcattgggcaacaagacgtcgatggaacagcggtctttcgcaccccccagtagaacgcggttgcagctatcactctcctcgacaccctcgtcaaggaagacgtactcaaccaagctgatcatgttgtcaacatcttgaaccagacgaagaccatgatcgctgcctcggttccagccaactnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 653 - DNA, 21575 bp, Oryza sativa
cgtattcatggctgacaacgaaacggaggaacagcgtcaagcccgagaagcagaccaagatagcgcacggcaagaagctgaacgtcgccgactagaggaagagcgacagcgacaggagcgagaacgactacagcgtgagcaacaagatcgcgaacggattgcaaaggaggctgaagatcgacggcaacgcgccttggaatctggacgctgagtgagagagctcattgggcaacaagacgtcgatggaacagcggtctttcgcaccccccagtagaacgcggttgcagctatcactctcctcgacaccctcgtcaaggaagacgtactcaaccaagctgatcatgttgtcaacatcttgaaccagacgaagaccatgatcgctgcctcggttccagccaactctgcaagcacccacaccccgactggtagccgagtccctcagctccaatctcatgattatcatcagccaagcctcagcatcatcggcataggatctagtcgcaggagcaggggtcacgacgaacgatctgttcactcgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtcgagtggattggccagccggctttaagccgactggaatcgagaagtatgacggcaccactaatccggagtcttggctcaccgtctacggactcgctatccgcgcagcaggaggagacagcaaggccatggcaaactatctacctgtggtcctagcggactccgcccgatcctggctccacggattaccccgtggcacgatcggatcatgggcggaacttcgtgatcacttcatcgccaacttccagggcacctttgaacgccccggcacatagtttgatctctacaacgtcgttcagaagtctggagaatctcttcgagattacatccgacgcttctccgaacaacgcaacaagatctccgacatcaccgacgacgtcatcatcgccgctttcactaaaggcattcgccacgaggacctagtcggcaagtttagacgtaaacctcccaggacggttaagcagatgttcgaaaaagccaacgagtatgccaaagccgaagatgctattccggcgtccaaacagtcgggcaccacttgtaaagccaaagaaggacactccgaccgtaggagggagtggaagtaccaaccacaaggatcgcaagcgtaagcccaaagagcttgtggcgaccacctctccatcttcccgacaacgttcccgcgtcaacaccttcgacaagataatgaactcccaatgtccgcatcatccaaactccaaccacgtggccaaagattgcttcgtctacaaacagttcgcggagcaatacgtcaagaacgcacgtaaaccttcagacggagatcaaggcacatcaaagaagaaagatgatgaagacgatgctccgactggttttccagatcatcgcaaagaacttaattacatcttcggcggaaccctggcttatgagtctaagagaaaacagaagctaacagaacgggagatcaatgcggttcagcctaacacgccccaatatcttcggtggccagagatagcaattaagttcgaccgctcggatcatcccgaccgagtagtccacctggggcggtaccccctggtactagacccagtggttcgcaatgtcaagctccgacggactctcatcgatggtgccagcgcactcaacatccttttcgctaagaccccggacgatatgcagattcctcgcacggaattaaagccgagtaatgcacccttccacgatgttatcccaggattgtcagctacaccagtcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgatgatgaagatgcctggtcctggaggagtcatatcactacggagcgacatcaagcaggccgtcacatgcgacaaagaaagttgcgagatgccccaaacccacgagactactctcgcccgcgaagagatccgactggctgcgaccacggcaagcgagggagaagtgcctgcaaccaagctgacgaagaccgaagaaagtgatgccaaaacgaaaaagattcccttagatccctccgatcctgataagactgctgtaataggcgctgagttagattgtaaataggaaagcgcgctcatcacctttctttagaataataaagatatttttgcgtggaaaccatccgatatgcctggtatccccagagaggtgattgagcactctttacatgttaaggaagatgccaaacccatcaagcaacgactccgtcgttttgcacaggacaggaaggatgcgatcaaggaggaattaaccaagctgttagcagcgggcttcattaaggaagtccttcatcccgactggctggctaacccagtcctggttcggaaaaagacggggcaatggcgcatgtgtgtcaattataccgacctcaacaaatcttgtcccaaagacccttttgggttacctcgcattgaccaggtggttgactcaacggctggctgcgagttactcagcttcttggactgttactcgggatatcatcagatccgactaaaagaatctgactgcttgaagaccttgtttattacgccctttggggcctttggggcctactgctacatcaccatgccctttggattgaagaacgcaggagcaacctatcaacgcatgattcaaaaatgttttcaacccagatcggtcacaatgtcgaagcttatgttgatgatgtagtcgtcaagaccaagcagaaggatgacctgattgcggatttagaagaaacttttaaaagcattcgtgctttcaagatgaaactaaacccggaaaagtgcatcttcggagtaccgtcagggaagttgctcggatttatggtatctcaaagaggcatacagcccaacccggagaaaatcaacgccatcctcagcatgaaaccgccaagctcccaaaaggacgtccaaaagctgactggttgcatggtggcgctcagccggttcgtctcacgactcggcgagcgggggatgcccttcttcaagttgctgaagaagactgacaatttccagtggggacccgaagcacagaaagcctttgaagacttcaagaaacttctcaccactccaccagttttggcctcgccacatccacaagagccgctactgttatatgtgacggcgacctaccaggttgtgagtacggtcctggttgtcgaacgtaaagaggaaggccatattcaaaaagtccaacgtccaatttattttgttagcgaagttttagccgactccaagacaagatatcctcaggttcaaaagttattatatggtgtcttaattaacgtaggaaattatctcactactttcaaagtaactcggtcacggtgatcacatcatttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggacaatgcattttgatgggtcgaagaggctcacaggcactggagctagggtcgtcttgatttccccgactggagaaagattgagctacgtattgtggatacatttttctgcatcccataacatggcggaatacgaggcgctactccatggattaaggattgcaatctctttaggcattcgccgattaatcgtccgtggagactctcagttggttgttaatcaagtcatgaaagagtggtcatgtctagatgataatatgaccgcttaccgacaagaggtatgcaagctggaagataaattcgatagactcgagctcacccatgtccttcgacataacaatgaggcagccgatacactggccaattttggttcaaaacgggaagcagccccttctgatgtgttcgttgagcatctttatgaaccaaccgtgcccaggaaagaagcaattgaagccatggatactcaaggcataagcatgattgaagccgactagagagaacctctcataaaatttttgaccaaacaagaactccctcaagacaaaaatgaagccgagcggatttccaggcgcagcagactttacattattcatgaagctgaactgtacaagaaaagtccatcaggaatactgcagcgctgtgtatctttggaggaagggagacaattgttgaaggatatacattctggtatttgtggtaatcatgctactgcacggaccattgtcggcaaagcttaccggcaaggttttttctggcctacagctgtgtccgatgcggacaagattgtgtggacatgcgaaggttgtcaattttttgccagacaaactcatttgccagcccaagagttgcaaaccatcccgttgtcctggccctttgcggtctgggggcttgacatggtcggcccgtttaaaagggcagtcggcggttacacgcatctctttgtggctatcgacaaattctccaagtggattgaggctaaaccggtcatcacgatcacaacagataaagctagagattttttcatcaacattgtgcatcagtttggggtacctaatcggatcatcactgataatggcactcaattcactggcggagcatttaaagacttttgtgaagacttcggcattaaaatttgttacgcatccgtggcacaccctatgagtaacggacaagtcgagtgcgctaacggcatgatacttcaagggatcaaagcacgagtttttgaccgactacgtccctatgctggtaagtgggtagatcagctgccgtccgtactttggtctttacgcactactcctagtcgggctaccggccagtcgccgttctttttggtttacggcgtagaagcaatgttgccgagtgaagtggaatttgaatcactacgatttcggaacttcaatgaggagggctatgaagagggccgagtagacggcatcaatcgattagaagaagcccgagaagcagctttcattcagtcgactcgatatttgcaagggttgcgtcgttatcataatcggaatgttcgatcgcgagcctttttagtcggtgacctggttctgatgaaaattcaaacaacacaggatcggcataaattatctcccttatgggaaggaccattcataattgctgaagtcactcggccgggttcttatcgactcaagcgcgaagacggtactctcatcaacaattcttagaatattgaacaccttcgtcgattttacgcttaggcatttcgtttgtatctttcctctttgactgctaacttcaagtttttccttgaagttttcagtcagggggctactataataataatggagtgtgatttttatcaatccaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttaagatatcaagcacagcataaattcatcagtattgtacaaattgtgcctccatcatcattaattatcaacatcattggtacattaatcagtatcagtcttttcatcatcagaattatcaggaccagtcggtcgaagatcggtgtcctgaaatctctcaactacatcagctgctatcttatcagcagatttttgtgcatcgctgatgaggtcaagagcagctccttcgctcgtcccgtctgcaaagccatcaatggcatcaacgtcaaccctcggataaagagatttggtcatcgccaacgccagacttgctctcatacttcaagcttctttgatgctcttgaaatatgtatccagagcaactctcagcttgtcgaaaattttagaagcatcaagtgcactcaggccgttgttattgaagaacatcgcttgaacaattggggcagcagcgttagcaacctcatcccgggctccttcaagttttttgatcttgccaaccaggacgtcgaattgagcttgagatttgatcttgcggtctgcatcaacagatccacattaataagtcagcatatggaggataatggcttttgaggtattgattgttgataccttcaacttcctttaaagccaggtctctttgtcttgccagttctgccttgtcattttccagaatttgaatctgcttccccaactgagatatcttggcagcttgcactacattgattacggttaatcaagattgcaaagataacagtacgagtcagttgagcagagtttgtgcgtaccttttgatgagccactcagttcaaaatttgattcctggagctcagcgatccgatctttcagataatgttcattcttcctggcaagttctttcgcttcgtgcagttgattcctggtggcttcgagggttccgagatgagggactaacctttctaaggttaccgttttggcttcgttcctaagatgaatcctctgcaagacagtttaattagcgcatgaattaaatggcaaacaagatggttgagatcatgtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatccggaggatttcttattcatcaccaattattggccctagtgtatccatgaatgaagatgaagcagccaaataaagtctgttggatcaagatgatttcagatagcgtgtctacctgtgatgattcccggtcggggatgagtggactttggtgtcttcacaggagatttggtttctgattcactgtcagcatccttcccgagaggactgttcgtttgagcttcaacctcaggaatcttttggtttggccctgcatccgactggtttccagtcgggggctcctggttagcaccgacttcagattcggccgactggttcccagtcgggggctcgttgctgggttctacattgtcggttgtcggttgtttgtcactcggacaatcctctgcagttggcccggtttcttttgaagggtttgcctttatgtcagccggctcggggtctttttcagaaggatctatgtcagacggcttcctacgagtttgagttatgctgttagtattatttcaacagtgggtaagctgcaagacaaggaagatggccaaatgatttgtacctggaagactttctgatttttggcaaaggatgactggaggttttcttcttcggattagttggcttcggggattttccggtcgctcctttgtcttcgagccttccggtgtcatcgccttcctcgtcgcttagaaccagcttcctcttgcgagcatttgactggccgactggatcagaagcacttggtcgagcgtcagatcgaatttttggtcctccactcgcctgaccagtctactggcgaggtaatcgacgttgagcaattggaggatccgatttcatcaaagcaaattcctgggcatgatatttcgaactttcaattagcttaacagagggtaaaagcatacttttgaggaaggttgaaatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctatgcgggatctctctttgattggagctaatcgacttttgatgaagtgcggagtgatctgttctccctgcaaaccttgttccttcagttttagcatgcgttccatcaattccactgcctgagcagcttcatctcacataggcaatgagttccatgtgtcctggtaaaccggaggaagacagcagtactcagggagtgcgggctcaggattttgaacatagaaccagtttacatgccagcctttgtttgaggttttgaagggcatggagaaatatttttggctcaaggttcctctgagttggaaaccagctcccccaacaacgcacggtttgcttttgtttggctggggcttgaggaagaagatgcggcggaacaaggtgaaatgaagcctaatgcctagaaaagcttcgcaggcatggataaaattggcaatatgcactatggagtttggattcaagtgatgcaagctaatcccgtagaagttcagaatcccccggaagaatcttgaggttggaagagaaaatccgccatagaagaaatgagcaaataccacgatttcgtgtgtgtcaggggtccggaatgcttcgccgaacgccggttgccacccgataatctccatcgctgggagaacgccgtgcgccaccatctccttcagattatcttctgtcacatcggagggcgcccactgactctcgaagctttctctttcttccgccatgaatgtgaactggatggtttaatttggtccgagatatggctggagaggaatggggaatcggagtggtggacgcggggagaaatttcgtgaagtttttgagggtgggttggagcagattgatgaaacctagcttcgtcggcgcggttctgtactgtagcacggagtggggaatggcgagagtctcggcggggaagactaaacgacgtttggacttcggtgtttttagggtatcgggagtactaatgggcctgggcctgtacagtacttcagcccaattatgttttcagcgtggcctgttgtgatccctagggacttaggcgccttttgctttggcaatatgtgctcacaatgatgcggcccgatgctgttaaaatcctttttaacgcgattcaataattctttggaattaatatgatgcacatgaaaaggtgcccgacagaaaggtattataccatttttgtaagcttttttaggctacaaaagctgttgggttaatttgggatgactggttcattagtagtcatcctcctagcatgttatatgtttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatatttttttgtccttgatatattcaagtgagaagcagtcggctgagtatcttattgagtaccatgcatgcttcgatataaaatcgctcggttcttgactatatgtttagtttttcaactaatcacatagtcgggggctacacctaattaggtgcatctacttgatgcaccatgttttattttcgcccttcacagtcttttagcattcggcaagccggagcaagttgaattgaagcactcagattattgttttttgtttcgagaagactattttggtcaactgcgaaggtctcgggggctactgtggagattatggttatctcatatctacatggcggttatattccagctggatatacggtaccaaatatagatagaatatctttatgaggactcgggttagattctaaacttgtatgccaggaaaatacacgggatcctagtcggttacgattgtattttatctgtaatcccatattccgttaggatatggactgtactttgtattacggatcccttcccctatataaggaggggtccgggttcctctcggggcgattctttttctcccaatcatacaatcaataacacacttggcagaatcatccccggacaggagtagggtattacttcttgaataagaaggcctgaacctgtataaaattccttgtctccaaacccatccactttcctagcttgttagccacccccttttattattgccgaaatcttgtttcgacaccatgagaagcgcatcagagcatgcacactttcgatcgacgattacgtcctccgatgggttcaaagccaagcagggcgcaacaagctctcacccaaatgggaaggaccatacacgatcacacaagtcttgcggccaagtgcattcaagattgcagatggtgatggatgcgagttagcaaattcctggaacattgatcaattacgtaaattttatgtataaatcaatagtgtccatatttgtaagacatcttacgatttcaataaagttgatttcaggtaaagattacggtcaaagtgttccttcccgacgatcccttaccatgacgacacctagagttgaaacctatcctcatgtccgtttacaccgtcctgacaaggcctctgaggaacctaagggaacttcggctggggacgcccagagcggataaggccttgtcggatcatgtagagacaaacgaccatgtaagaccttgtcatgtaagagttctcaccgtgcgtattaaccaagccgtgtaatcggaaattgagttttccaacatcacggctgggcgctagggtcagtgctttttcaaccaaggcaggtcaagggtccaagagccttgtcatccgagaacgattctctgacaacaaggctgggggctagagagagtgtatggctcaactgactgatcaaagtcgcaaagtgagaaaacgctcatacacaacacacctagagtaagaaaacttagttagatagattccttctctattttacaagtgtttcttacaagtcataaatattccaaaatattccatgtttccttgagatattttttacaagattcaaaaactaccaggacggccaatgccaatccatggactgaaaaaccttctctgcaagcggtgccatcgattgcgcgagaccgtcgatctccgcgggagtcctccgagaatgcgagaactgttcgtggaggaactcgaggtgtagctgcgggtggtgatctcggatgcaggccagcacatgtcctccggcgtaccggcttgatcgacgacactcctgcttcagggcctcgtcgagacgtttgccgatcccttcgagctgtgcacaagccccattcagccacgagatatatccggccgccgactcctcgggatctccacggggaactcgaagctccttgtagactcccgtcattgccgtgcagcagctcttaaggtatgagttgaaccacacctcgcgacctcgaagagcttccacggcccggtccttcttcacttccaccatggtcctctcgagttcagccacctcgagcttcgtattccaatattggattcgacgatctcggtcagccaacgcatcctcgaggtctgcccagcacagaaaggactaagtcaggctgttcttctctcccaagaacacaacaaatcaagtcaatccgaatataaggagtgaaggagactaagacgcgatcctagggacgtcatcgccatatttgcctctgcggacgggctttgactgacctcctcccgcgacacgaatggctcgagcgcaagcgccgaaatgatcaccggcatgccaggctgcccgcgctgctggacactctcgatatcaacatctctacaacgacaacaaagtactttacagcatgatgtttaagaggtacaggggaaaacaaatatcctactcttcaaaaagggggaggacgaactcccccaagtcactgacttcttccatcacgcacttgcgtgtgtcatcagcggccccctgatccaaaaccttcttaaggtccaggtcagggtgcgccagcctcacgcacgcgaggacgtggcacgccccgttgaagaccccgttggacgtctcctcaccaagcctggctgcgtgcttggaggggatctcctccatcgccgtggccaactccacgagcgaggacgtcagtgagaactcatcagggttcgccgggatggtagtcgtgacaccacactccccagcgagctggtgtaggccggtgtacgatattcgcagtgagcctcggatttctgacagattgttctcgagctccgatatccgatgctcgagcccttgccgctgcctctcgttgccggccaccagcaccctcatcttcaggaggtcctcgcgggcctctgctaggtcacgtgccagctggtcggcacgctggtttgctgacgacgttgccgccttggtcccaccttgcgccgccttcgcccgcgccgccctacgaagagtttcctctctttcataaagctaggcgatcaagatttcgtgaatgagaagacttcaaaaacgtccacttacttctcgctgatcatcaccagcctttgccttcgctgaggtgggggagacgcgtccgattcctaagtaagatacgacggtgtgaggaccagtcattctgactacacgttaaaaaataagagggaggtttaccgctaggtttggcgccttacgacgggtcccgagtacggacgagaatttcctccccttcttcaaaacattgctgccacttgtggtagcagcagcagcggcaacgtcggacgcttctttggtgacgccctccttcaatgacgccgccacctggtggtccgcgagtggttcgatgacgtctgtcagagggagagcctgcataacgtgaagtcacaacgcgatctcgaggagaaggatgcaaaggagtcatcgagtacacttacattaattgcggcggcacgttcggccggacccttctcgcaaagggggatcgggatgtcgcccgccactgagggggcgctgatcatcacctggctgacgcggtgtcccacggtgtcactttccagacctgtaaatcaaggacaagaactcggtaagtcaggagaaacagacgcactcggagtaaaattcgaaatacaagaaaaaataccccgaggagaaactcggatcgcgtcctctggcacagagtagtcaaaggctggatgggcgcaggcctggagcggttggatccgcctacctacaaagtcggcaacgacttcgtaccctggcaacccctgtgttcagaggtcatcgatgatgtcgatgaaagaccggagagagggagtcagggcgggtttggcagtccactctgggattttgtctagttgttcttcagggacaacaaggacgggatccgagttttctatctgaagatagaaccatctcgcccgccatttgctgcaagaagaggggcactggaaggggatgtaacgcgacttcaggcaatcccgaagtcggaatccgacacatccagatacactgttgggttccatccgacgcaagtcatagtaaaagcggaagagatcaaggaagggctctaccccaatgtaggccttgcagatataagaaaagattctaaggaatgcaatggagttggggttcaaatgaagcaaagaaaggccatagaggttctagtcgagaagaataaattcggaaggcggagaaagaaacccgcaagaaatataatcttcgaccacaaccatatggcccaagatgggttcgggttcaatacctcctgtctccctctgcatggtcccgcgaccagggagggcgccgtcgtcatacaatttcttcaaagacgcggtggttgaggtggacttgtcaagatccatcgccgccggaggatcgccagagaacaaagcaagagaaatgggctagggttttctgtgcggagagcggagaagacgaggagcgctagaaggcaggagaagttttctggcaaacggacttttaatggattcccaaaatccctttaaataagcgcactaccgacggtgcgtattccaaggaaaggagagagattgccgccgggaaattctgggtccgttgcacgcagtagttttcaagacttcaatttaaattcactcatgaccgttgaacttcatgcggcgttgtcgatgactctttgtctctacggttctcatgccaagatcgaccagatgagaacgacaacgatttcgacatcagaagtcgtgattgattacatgagttcatttaagcagaagtcgggggctactatcagggttacggataaggtataccctttatccttggataaacgatgagtactgatacggtatgcccgcgcttatacggataattcctatatgcgttaaggaaatatatcacatgatagaaacataatccacgtatggaaggagtcctactcggacgagactgggtctttaccatatcgtgaggggttcgatatctccgagtcctacttggagatcaactgacccgcggtataaaagggaccccctgggcaggacctaaggcatcgaatatcaccgctaacacatccaccacagcctacgaagccggagcctacaggagctaagtcgtcgggtgatctagtcgaaccaactcgactacggtctcgtcggtaccatcgagttctgttattccctttgtaatatgtggtttccatcatataatctcataccaactggattagggctattacctaccaaggggcctgaaccaatataatccttgtcttatgtttgcttgatgtcgtactacgtagatcctcgtaccaacgtaccccaataccctctatatccggtctacgggtatcccgcgtcgacaatattcccatgcatttatgtcaggtctacctttaaaaatggtaaagcatgaaaaaatggttaatgttttggaggaatcccaattgttatcctacttcagacactgattctaaattcagagtacaaactagtaggttatgtatattaactgatggaaatataatagtatcactatatgaacaaggatgtaaagatattcaataatcagataacctgcttgctattgaaccattgaacttgattgtgcaatctatgtccatgcctatataatggtatgcaccatagtgcatttattcattctccaaaattgtttacatagtatggtaccataaatattacaccctggtccctgtattagcaggtacaactttgagcatgtaaaaggatgctccctcactagaaaattctacggcatatagttttggggctcatagaccaaggaagccaactattttatcttaatacctccatttattcttgttgcatgcacggtattaatgcatcacctcactaaaatcatctaactgcatgcatgcatacaggcctctttaagcatgggcactgggtaaatcatcgacagggaaggaaggaaggaaggaagggtacaaggagatctgtgcgccaaccgccccctgttgaggtaaggtgaggtgaggatggcgatgatgaaccggacgcgggatctgctgatggaggggttcgagggcctcgtgcgggagggctccttcacctggggcctcccccgccgcggggcttcgccggtgggcgacggcgatgaccccgacagctcgtcctcctccggcaagcaggcctccgtctccggcctctcccccaaggccaacgccgtcgtctctcgatgcgcccggtaatgacctagacacatgggtgagacaattgccttctactgaaattttgcctcgccttcgggatttcttgggtttctagggaagggaaatgctctgggacgaagcattttgtttctgatatactaggttaattgaatggaaagccactgcgttggatgtgacaattcttagaaaatctgcaaataagtggttgttcggtggctttatcagcaaccaatattacattgcatatgtttgaagatcgattattataatatgtagtgctcaggatgtgcagtagggcctatgagttcgtgtttgatctgaatgggtttggtttatgatgtccaaagtccagacatgaactgttgtgtgcaatgtagttcgttgcgtccattgtatacttgttccaagggaattctaatatagaatcaaaaccatagctgtttaagatctccctaaactgggtttttgttaagatatctggatgttggtaaatgaataacttgtgtgagctaatatagtttatgtcctttgagaacgatctgtaattcttttattagcttgattggaaacatgttgatgagcatcctgcttcacggaaccaatatgatgttgtttgcatttgctactgttctgttaagctaataggcataattatgtaatactccatccgtcccaaaatatgaaattttatataattagtattttcattgttatttgatgataaaacatgaataatactttatgtgcgacttatctttttaaattttttcatatttttttcaaataaaacggacggtcaaaacttgtacacggaaatgcataaataaacttattttgggatggagggagtattagttattcaaaatctctatgtcatgtaaaatcaattcccttttcatgcaaaaacatatgtaataccagtttttctttaattaggtgctgaacttatgccttttgtgttaattacatttcagggtacttggtacttccacggatgagcttcgatatgactttgatatgcaagcatctgattccataaagcagcaaataaattatgcaagaaattttttggaatattgttgtttgagggcacttgcacaggcctcacaaattgcagggtatctttctgacaaaagctttcgtcgcctgaattttgatatgatgctagcttgggaggttccctcttcttcaagccagctcactgttaaggttacaattttcttttctttacttgcttaaatagttttcttttgttcacaccttatataatttgttagcgttgcattaataaattttcccaggttacttcctcgtattaagggcttttaagaatctttctacatattgaatttcatctcctttcccttgcaggttgaagtagagagcacagtcagtttagaggctttttcaagaatagcacctgcaattccaacaatcactgatgtggtaacatgttcaaatctatttgatgtactttcatcatcaagtggaggccggcttacatttccagtatatgataagtaccttacaggattggacaggtcactttctctactggtctgtccattcaattttatttgttcatgttttcgttatttacacatggttagcaatagacagtgacgaactgccttttttaatttcatatcagcagaataaacaaattgaatgttatggaagttctcttgatgaaatgtctaccactagtaatatataatttatctgacaaatctaaatagttactatatgcctcttagttgtcaaagattgaatgcttgtaagcaaatgttgtaaactgatgtccttttgagaatacggggaggcagggagtattacttaccataattatcatacacattgacttatactttctcttttgcttaccttccaatcgtacatatagaacttagatttacatggcgcggtgtagcagaaacaactagtttcttgtcccatgatgaatatttttttccaaaatgaaatgcttctcttcagtgcttattcttatcagggataagcggataatccactttcttgatttaatatagtgaaaatttgggcaaccattataggtctatagctcttcatttctagatgtttaacctgctgttacaaccttacaatagatgccattatcttcctactttgcactgagaagtatatcacctgtttgagttaagattgatgtagtagatccccttcttaactactccctccatagaaaattatagggcgtatttcctcaagccctctgttgaagattatagaaacacacatacttcccaatccatattttgttggtaattttcccatagttcccatacttaaagaggcctgtatgcttgcatgcagttagattttagtgtggtgatgcattaataccgtgcatgcaactagagtaaatggaggtatttagataaaatagttggcttcctcggtctatgagccccaaaactatatgccgtacaattttctagggagggagtacccttttacatggtcaaagttgtacctgctaagagcaagtttaataatatagcgcactactagctccaattcatttatagccaatctaatagacaattcataaaataattgcttactatactattaatatatggtcccacctgtcatacacacattacgtcttggagtccgtactgcagctggctacagatctgtagcccgctgctcttctctcttatcttttatctcattaaaatatgtctgtagctagctaatattctactattgttcctgctctaatacagtgaccagggtgtaatgtttgtggtaccatagtatgtaaacaatattggagaatgaataaatgccctatgctgcataaaattatataggcatgtacatagattctacaatcaagttcaatggttcaatagcaggcaggttatctgattgttgaatatctttacatccttgttcatctagagataccattatatttccatcagttaatatacataacctactagtttgtactttgaatttagaatcagtgtctgtagtaggataataattgggattccttcaaaacattaaccatttcttcatgctttaccattgttaaaggtagacctgacataaatgcatggggatatggtatagcatatttgccaatttttgttaccaaaataagttcagttatgctcctttttctgaaggtagggtatgcaagcatataactttctgttggatcttgtttcataaagtcaggactgagagtatgttttatctcatgtagagcgattaagaaaatgaaaggacaatccgagtcctcgctattatctggccagcggtctcagagaggagaaaggattgtagaaatagatggaacattgacgactcaaccagtacttgaacatgttaggatttcgacatggccaggtatgtctagttttctcagtgaggagaaacgatttcttgttgtttacatgctggcatgtttttttaacttgccttgttacggttttatatcactgggtttcagcttttcctttgctggcacaggaaggttaacacttactgatcatgctctttacttcgaagcacttcgggttgtgacctatgataagcctaaagcttatgagcttgctgaagatctaaagcagtctgttaaacctgagctgactggtccatggggctcacggctatttgacaaagctgttatgtataaatcagcaactttgtaagttctttcacacgtagcaaagctaataagcaatagagtacatctatactactaaaaatgtcagtagtggtggtgtccattctgcaacaccacccctaccactgatatgtaggcccaataatctatagtattacaccaacctccaatgagtcctctcctgtttcgctgttggtttatcttaaactttgaaatcacctacttattcactctacactacaaatgtcagtagtggtggtgtctgttctgtcacactacccctaccactgatatttacgccccacaatccatagtattacaccaacctccaactagtcctctcccatttcactgatggtttatcttaaacttcgaactcatctacttattcaattaggaaaaacataaaagtgttaatttgactaaatatgtgcctaattgacttaataagctagaaactgaattccttttccgttgcaacgcacaggttcttggccagtaaacgtaatagctgattcctatagtggtattttgctaattagttttaatttacaagtcattgctatccattcctttttattcggagatagtagcaacatgtatccctataaccttatatctttatgactagcacatagatttgctcttattacctttagttacatgttttttctttttgttaatgcaaatgcagaacagaaccagtgatcttagaatttccagagttggctggccactttcgtcgtgactattggctggccattatatcagaaattctttgtgtccacagatttgttaggaagtttgacataagtggaattgacaaagaggaaacaattttgaaagctgtactaagcattctgcggctacaagctattgaagagttagccattccagtttctaatcgattcgagtctcttttgatgtttaatctatgtgacaaacttcctggaggtgatgtaatacttgaaacactagctggttctatatcattgagaagatcagctcaagttaaccaacctggcattagcagtgcaaggcattcaatgtccccatttactgttctgtcgaatcttggagtggtatcaccaattaataagggtgagagactctttgttggcgagatagttgttggggaaatgagtgccttgcagaaggtagttactgagtcaatgaacaactataagaaggttgaattggcccaagccacagttgatggagtcaaagttgatggcctagatacaaacttggcagtgatgaaggtatactcacaacagaattagccttttctcaactgttaaagatctgttcaattctatgtttggggtttagttactccctcgtttttcatgagcagtcttcctaatctgtgacggtgcctaattaatcagaataaattgtggtttatccaaattgattccggcaccattttgatctgttaaattattcagaacaaatctaacatatttagagcttgtgcatcacaaaaatataaagtaatttttgctgaagtatatatattcatggaaatcgaaagtaatctgcaatcctttatttgtgaccatcattcaccaaatgtggtttttagacctcaccgagatccttattccaatgtaatatttttgctgaagtatttcgttgcagaaatttgcctgatcctacctatattttccagcttttgcatatttctgcatgatatataaaattccaaaattatttcctctattttggagattgtatatgaattagagcttaccatattaccacttgttttgaaaggtgtgaatgtagtaatttgaattttgatgaagagagtttattcgcttatggaaatttagaaggtatacgcatattcactgcaaatcccattgtgtatgtactccctctgatcatatatatttgatgtttaggacaagatttggtccaacttttcaaactttgatcatcagttatttctcaatgcttagtttaaaaaggaaaaaaatggtaagcatagattttccttgaaaagtactagcatattttttttatgattttataaacttattctagtataaagttgatggtcaaaatttcaaaagtttgaccaaatcttgttttaaacatgaaatatttatcaccagaagatgtatattgcttttagccagaaggtttttgttcacagtattttatactatgattgcttgaaacatgtctag

SEQ ID NO: 654 - DNA, 2545 bp, Oryza sativa
  unsure (1)..(2545): unsure at all n locations
tattcactgcaaatcccattgtgtatgtactccctctgatcatatatatttgatgtttaggacaagatttggtccaacttttcaaactttgatcatcagttatttctcaatgcttagtttaaaaaggaaaaaaatggtaagcatagattttccttgaaaagtactagcatattttttttatgattttataaacttattctagtataaagttgatggtcaaaatttcaaaagtttgaccaaatcttgttttaaacatgaaatatttatcaccagaagatgtatattgcttttagccagaaggtttttgttcacagtattttatactatgattgcttgaaacatgtctagcaactatacagattcatgtttcgttttttttttgtttaatcctcacttgcatttaggaattgctatctcccgtaagtgagctatggaggtttttggtgttgctggcatcttgggatgagccgattaagtccatggtattttgcttttcatcgtcttatatcattatcaggtatgctaaactcacatggatattttctttttgactttattctgcatgatgcttttttaactgtggtacactattgtgatttttttttataattttgtgcaacttactaatataatgcaatataaatatatatcactagctcctttggagtgaatgttgcttcgattgcctctaatataatccttcccaaatttaactagttcacgtgctttccatccaccttgctgctgctccgttgacttgaattcaaggataccatatactcccatttgagttgcaccatggagtgatgtcatctgaggtggtggaacagtcgatggtgctataggaagctcctcatatatattaaggccttgtttagttcccaaaaagtttttttcaaaaacatcacatcgaatttttggacatatatatgtatagagtattaaatgtagattaaaagaaaaactaattgtacagttaggggggaaatcacgagacgaattttttaagcctaattagtccatgattagctataagtgctacagtaaactacatgtgctaatggcggattagttaggctcaaaagattcgtctcgcggtttccaggcgagttatgaaattagttttttcatgcgtgtccgaaaacctcttccgatatccggtcaaacgtctgatgtgacaccaaaaaattttcatttcacgaaccaggccctaagaagagcggtgtggatgttcctcatttctttattaaacacttgaatgatgattatgccttcctgcttataattacgatcagcgtaaaacctacctgatttaggaaggaggttaaactgggtagagggtggaagccaaacactagaaaagtcctctccttagtgcttattacactgcattgcaatgcatacaaaaagtgattctcaacagtacatcacaaattcatcagtaccttattgcagtgacacattcagcctagtaccacaccatttctaaatgctgtatccaacatcaatccatcctaaacagatagcctgattacctggtgaaaacaaccgtaaccactggattttgacattggttgaatactgagcatgtattaaattttttcaatgaacaattaagaatcatggatcagctgtgaggcatattttcatagtttacacttgcagcaaattacagttaataggattttagcattgctaataattttatctctaataattattacctaacaatcttagctataatggcattcttttgtaataaaatattttccttgaaatccaaggggacatgcaattcttgctgttcctagaagaatgtgtccataatatgatgaatatttgttcttttgtgatgcatactacacaatttttgcattcttcacatttgtaaattgtaatatcctctgtttctgtgatggcacagggggtggttagtctattttcttgttttggtgctcttgttttcggcaactttcatgttctttacaagactaactagccatgtaaatccaatgatggaggtcaaagtgacatctccacctccaatgaacacgatggagcagctcttagctgttcaaaatgctatttccaaagttgaagagcttgttcaggatgcaaatattgttcttctgaagattagagctttattgttggcttctccctcccaggtaactatatttcttagttcttattcttcaatccttttagggagctagtactttgttcattcattttttgtgcttcctaggctaacaatatatgtgcgctattcgttcagcttgttgatgaatgatgctatggaaagaaaataatgatatgtgaacacaagaaaaaaatagatacaactagaaattgatgaggttaactaatcatttgaaatcaaatttactacccactctgttttttctaagcgtagtacaacatatgcatctcgtctgatgtactgctaattattccacacatttagcatatcaacatnnnnnnnnnnnnnnnnnnnnnnnnnnnnnnnnnnnnnnnnnnnnnnnnnnnnnnnnnnnnnnnnnnn

SEQ ID NO: 655 - DNA, 2322 bp, Oryza sativa
  unsure (1)..(2322): unsure at all n locations
nnnnnnnnnnnnnnnnnnnnnnnnnnnnnnnnnnnnnnnnnnnnnnnnnnnnnnnnnnnnnnnnnnncaacttctcactgaaatatgcaacgggctgtccattttgcatgagaacgcctccaataccaatcccacttgcatcacattcaacctcgaaggttttagtgaaatccggcaacacaagcaaggggccttcggacaatcttttcttcaattcttggaaagctttctcttgcggttctccccattggaaggcaacacctttctttgtcaactcgttcaatggtgcagctatggtgctgaaacctctgacaaatctcctgtaaaaaccagcaagtccacgaaaacttttcacctggcttacattttcaggagttggccaatcctttattgctttcacctttgattcatcaacctgaattcctaaacctgaaacaacaaaaccaagaaacacaacctgatctgtacaaaatgtgcacttctcaaggttagcatataattgttctttcctgagtacatccaaaacttgctgaatatgagcaacatgttcctccaatgtcttgctgtaaattaggatatcatcaaagtacacaacaacaaattttccaataaatgctcttaagacatggttcattaatctcatgaatgtactaggtgcattagtcaaaccaaaaggcataactaaccattcatacaacccaaactttgttttaaaagcagttttccattcgtctccaattttcattctaatttgatggaaaccacttctcaaatcaattttcgaaaatatcatagacccactcaattcatctagcatatcatctagcctaggaataggatgacgatagcgaacagtgatgttatttatggctctacaatctacacacatcctccatgaaccatctttctttggcaccaaaatcacagggacagcacaaggacttaaactttctcgaacataacctttatctaaaagtgcttgtacttgcctttgaatttccttagtttcttcagggttggtgcggtatgctggacggtttggaagtgtagctccagggatgagatcaatttgatgttcaatgccacgcaatggaggaagtccaacaggtgtttcctctggaaagacatcttcatattcctgttaaacacgtgcaacaacactaggaacagaggttaagtcgttagctgaaagtaatgtgtccttgcacacaagtatgaataatacttgttctgggtttctcctcacatctctcatttcagatttggtggctatcatcactaagttctctccctctcttttcttgttgtctctcatgtttggcttgtggctctcactcaccgatttgtggggggcactcaaattatttttctgtccttcttttgcactctcattcctcacttcagagctcttttgcaagtgctcagctagaatttgctgcggtgtcatgggtttaagaatcaactccttgcccttccacttgatggtgtattgattggttctaccacaatgtagagatgaccgatcatattgccatggtcttcccaacagcatgtgacacactgtcataggtgccacatcacactccatggtgtcaatatattcaccaatcttgaaaggaacttttactctttgtgcaatcttaatagaacctgaattattaagccattgcacatgatatggatgaggatgttttagcagcttcaaaccaagcttttcaaccatttctttgctagcaagattgtggcaacttccaccatcaatgatcaccttgacaactttatcttgcactttagctctagtttgaaaaagattgtgccgctgtccattttcagcatcactcatttgtacactcaaaatttgagttacaacaagagcagcaccagattcaaattcacagatatccttctcaagattattctcctcttcactatcttcttgttcttcctcactagtagattcatactctccttgatcattcacaacgatggttctattgtttggacactctctagcaacatgaccacgaccaccacatttgaagcattgaattccactactcttggtggaagaacccactgaagtagatgatgtgtttgctgcatttttcctctcatttggagcagccaaatctttcccactggaagtaccataattgctagatcgtgcaccaccacttgagctagaaaatgcacctctatttccactacctcttgatgtgaatttgcttccacttgctgcattctttgtgctgaaagacactcctctattggacttcatgtcttgctgcaattgacgttcagctttgctagcttgatgcacca

SEQ ID NO: 656 - DNA, 2275 bp, Oryza sativa
gcaattgattgctcttcatcttcataaacattggctctaatcattgccttctccatctctttataatattcatcaacactgaggcttccttgcttaaattctgcagcttgtcaaaaagatcacggcgataatgtttagggacaaatcttgccctcatttctctcttcatttcagcccatgaacgcacatcgccttggccagcttcttctctttcatttagcatttgctcccaccagattagagcatagccatcaaactctagagcatccccggcaactttcttccgctcagaataattatgcaaacgaaagattttatccaccttcaactcccatgtaagatagacttcaggatcagatcctccttcaaacttgggcatggtgaattttaatttgccaaatctctcttcattgggctgatttcgcccacgatttcctcggtgacgacgatcatcacgatgaggctgttcaacctcttcgtcagtcccactttcttctagtccatgttctcttccacgatcagcacctctaccaccatttccacgaccaggatgtggaggtcttcttgcatttgcaacaacacgatctctccgtcttcttcgttgttctcttgcaaggcgagcagcagcttctccttcggattcttcatcttcttctccatggtgacttgcatttgcatcttcaggaggaggctctggcaatcgattcataagtgcttgaacattggctgttagtgcctccatgctttgcttcatctcattgaattgtgccatggtgacacaatcctcaatctcaacattagaacccatcttcctgtcaagttagtgatggcttgcaacaaatatttgtggaatatgtggaataggaaaatatatgtgcaatcacacaacctcacctctctaccgaagctcaagtgagttccctgcagattacagaggaccaatgcgaggtggtaacttgagaatgatggttgggagaatgcaagatcagcgttcctatgacggtggattacttgtggagcttggtggggatatattttacaaggaatgcaatctgaattctcgctattgtaaagttaaatcacagtccaaaatgcttagtgctgaccacaagatatgaataacgtaaatagatcaaacacacacgcaaagataattcagttttgatgcaaacaaggagtatgcttaggatgcaagtgttgcaatcagacctaagcaaaattttgcaccaaaagatagataacaaactgattgtgcaacttgatataaaattcagaacatgtgcacataaacaaactgatctttcaacttttctttctcaaactttcctcaactctttttcttctctctttttttttgtaacttttctttcttctctttttttttgataaacttttttttatatatataactaagaacaagaacagatatgaaacttatacacttttctttttgtagaaacaagacacgaccgtcagcgttctaacttgataggatcaaagtttacgcgaaggatgataccggtttctgaatttttttttatatatatggatttgcagatgtatgaaagaagctcaaaggacacgcaaaggagaatatgatcagcaactaaaacaagactctaatggactgaaaattaactaaactcacaagaataacagattgaaacaaagggctatagcagaatatttttatggctttttcagtggataggacgaacacaaatatatatgtagctaagggtaaaaatcctaccgttgcaaccgaggctctgataccagatgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgcccaaccacactctcaaagaaccaacctacgcaacctaaactcgaggatcaggagcacggattgggtgccgatgacgcggccgcttctgtaatctccgcgaaggaaaacacaagagaaaaggggtagagaatctctctctggggtttgttagcacacagctgaacaaagggttccgaattggattatcaaaagtctgagtttgcaatggtcttaggggttatttacactagcaacagccctgctagataggtgtgaattcgagatggaaatgaaaagactaaaaatgtgaaagggcctccacgaaatggcttctgaagtgggttcgcgaggct

SEQ ID NO: 657 - DNA, 4944 bp, Oryza sativa
ctgcagttggtccgttttgcttcactggtccgttctgtactccagtgatagaatccaccgatccactttcatcctcctcatgttgtatgttcctaagcacaactaaagtagaacacttaggtagtataacattctcagaagtactgaaattaaaatcagttaggaatgaattcacctgaacttgtagtttcttggcacgacttcttgtaagtggaccttgaattgtatcctttgtgtttgatgatggttgcttggtacttgaagtagcatgcacggttgggatgtcctcatcatcaaccctagatgctgatgcaataaatcccttttccttttcaaaaataattcattattgcgtcataattcaattaaaatccatataaatgctttaatccggtttaatctttaaaaattcatatctaattcattgtaactcggtttaatgtggttcaagttgcaaaagttgtataaaataaagatctacatattaaaattattcataaattgaattaaatttatttaattttttttaaatgggctttaattagattaaatctagtaaaattcataataaattcatatgaagtcagaatgaggccgttcaagtctcataattcatctaaaattatgatctacatgtttgtttactttatgtgtattgtttatttggagtttcttagtgttttcctcgttttgcgttttagcttgtcgtttccgtcgttgcgaaggttcgcgagtgcgccggaagtgttcaagaagattaattgaagaccgaatattgcaaggcaagtcacacagatcccaaacacaattcctttgagcatgttgatcctatatttaaattctctatttatttcaactgtgcatttattttcaaatgtcaccgggtggtgtgaacctattcctttgttatggcctgtttgcattgattaccctatttcttgattacctcgggttataatttgactagttggatttatatattggttcaactagatgtattagatataattgcttagccatgcttagaaacattagcacatgattgggataattaatgtttcactattatttaatgatggatatttaatagctcacgatggtcaatcgtgattggttaattaattaatgtgccaactaaaacttgataatggtgggttgtgagcacatggttttgatggtcgtgctcatgaaaattaaggaccggttcacgagtttcggttgtgaaacattaatcgttccaaccacaagccagagtgggcaacggctggacactttgtataacaaggctcattgcggagcaccagactgagaagtggcggagataagcccacgggggtcgctggggagtccatgactctggtttttgagggggtgactatgatccgggaacggtgcactgctttgggttgagttatgcgaggggtcttgtcacaactacagaaatggtgacatgttcagcatgggcacatgatgatatggtgacatattgtggagttttgtcttgtgggtacagtggtacacctctagccagagtaaaactattcgaatagccgtgcccgcggttatgggcgggtcgaacaatgtctttcgtgattagtcccacactactcattaatagtaatgtgataattgatggtaattaatttagctcctggtttggaatggtatattcctggtttggagatagatctgtacaactgggtatggttgttcaggatggttgggcctgtgcagcatggatgtgctgttcagtgattgattaatattgataattaattactctattgttttactactcttaaatgtttgctaaatgctgcttttgcaaatgagccctatattatgccatcctttggtatcctgtgcacttgcatatttgctgtgtggcttgctgagtatgtcatatgctcaccttgcaataatcaatcaaacctcagttgaagacaagttgcgaaggagaagacgtttggcttataccccagttgagctacctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttctgggcgtgacataaactccgcaagcgtccacacgccgactagcagccgagttccgcctcttcgatcccaagattatcaccaaccaagcctcagcatcgtcgcgggatccagtcgcaggagcagggaccatggcaaacgatctgtctactcgcctcctgactggcacaaggagcatcaagccgaacatccccgctccccacgtcgcaggcgtcccgtcgatcttcgtgaaactatcaaccagtgctgcgcggcaagaggctacatcccccgccattcaccagatcgttacgacgaagacgtagatggagttgctgccttcacaagcgacctgcatcgagtagattggccagccggcttcaaaccgactggaatcgagaagtatgacggcacgacaaatcgtgagtcttggctcaccgtctacagtctcgcaatccgcgcagcaggaggagacagcaaagccatggcaaactatatgcccgtggctctagcggattctgcccggtcctggcttcacgggctaccccgtggcacaatcggatcttgggcggagctttgtgaccacttcagcgccaacttccagggcacctttgaatgctctggcacccaatttgatctctacaatgttgtccagaagtccggagaatcccttcgagattacatccggcgttttaccgagcaaagcaacaagatttccgacatcaccgacgacgtcatcatcgccgccgtcaccaagggcattcgccatgatctcttagtcggtaagtttggccgcaaaactcccaggacggtcaagcagatgtttgaaaaagccaatgagtacgcaaaagccgaagatgccgtcatcgcatccaagcagtcaggcaccacctggaagctgaagaaagatacgccgactgcagggggagcggtagtaccaatcacaaggatcgcaagcgtaagcccgaggaacttgtggcaaccactacaccgtcctcccgacagcgttcgcgcatcaacactttccacaagattatgaactcccaatgtctgcatcatccaaattcaaatcacgcagccaaagattgcttcgtctacaaatagtttgcagagcaatacgccaagaacgcacgcaaaccgactgacggagatcaaagcaagtccaagaagaaggatgatgaagatgccaagacccttgcaaggaactcaaccatatcttcggcggacccctggcttatgaatctaagtgaaagcaaaagctgaccgaacgggagatcaatgctgttcaacccgacacgccccaatatcttcggtggtcagagacagctatcaagtttgaccgctcggatcatcccgaccgagtggtccacccggggcggtaccccctggtactagacccagtggttcgcaacgtcaagctctgacgatctctcatcgatggtcgcagtgcactcaacatccatttcaccaagactctggacgacatgcagatccctcgcacagaattgaagccgagtaatgcgccctttcacggagtcatccccgggctatcttctactccactcggccagatcaccttgccggttactttcggcactcgggagaactttcgcacggagaacatttgcttcgaagttgctgattttgagacagcgaaccacgctatactcggacgcccggcgttagcaaagttcatggctgtcccgcattatacctacatgatgatgaaaatgccaggtcctcaaggagtcatatccctacgaagcgacatcaagcaagccgtcacttgtgacaaggaaagctgcgagctgtcccagacccacgagatcactctggctcgagaggaaatccgactggctgcgtccacagcaaccaaaggagaagtgcttgcaaccaagatgccaaagaacggagaaggcgacgccaagaccaagaaaattcctctagatccctctgatcccactaaaactgctgtaataggcgctgagttagattgtaaataggaaagagcgcacatcacctttcttcaaatataataaagatatctttgcgtggaaaccatctgatatgcctggtattcctagagaggtgattgagcactctttacatgttaaggaagacgctaaacgtattaatcaacgaccgccgtttcgaacaggatagaaaggatgcgatcaaggaggaattgaccaagctgttagcagcaggcttcatcaaggaagtcctacatcccgactggctggccaacccagtcctggttcagaagaagacggggcaatggcgtatgtgtgttgattacaccgacctcaacaagtcttgtcccaaaaatcccttcgggttacctcgcattgaccaggtagttgactcaacggccggctgcgagttactcagttttttggattgttactcaggatatcatcagatctgactaaaggagtccgactgcttgaagacttcattcatcacacccttcggggcctactgctacatcaccatgccttttggattaaagaatgcaggagcaacttatcaacgcatgatccagagatgcttttcaactcagattggttgcaacgttgaagcttatgttgatgatgtagtcgtcaagaccaagcagaaggatgatttgattacggatctacaagagacctttgcgagcattcgcgctttcaagatgaaatttaaccctgaaaagggcattttcggagtaccgtcaaggaagcttgttggcttatggtggtctatagaggcatacaagccaaccccgagaa

SEQ ID NO: 658 - DNA, 5257 bp, Oryza sativa
  unsure (1)..(5257): unsure at all n locations
nnnnnnnnnnnnnnnnnnnnnnnnnnnnnnnnnnnnnnnnnnnnnnnnnnnnnnnnnnnnnnnnnnnntgtgttgattacaccgacctcaacaagtcttgtcccaaaaatcccttcgggttacctcgcattgaccaggtagttgactcaacggccggctgcgagttactcagttttttggattgttactcaggatatcatcagatctgactaaaggagtccgactgcttgaagacttcattcatcacacccttcggggcctactgctacatcaccatgccttttggattaaagaatgcaggagcaacttatcaacgcatgatccagagatgcttttcaactcagattggttgcaacgttgaagcttatgttgatgatgtagtcgtcaagaccaagcagaaggatgatttgattacggatctacaagagacctttgcgagcatccgcgctttcaagatgaaattaaaccctgaaaagtgcatcttcggagtaccgtcaaggaagctgcttggctttatggtgtcctatagaggcatacaagccaacccggagaaaatcctcaacatgaaaccgctgagctcctagaaagatgttcaaaagttaactggttgcatggcggcgctcagccggttcgtctcacgactcggcgagcgggggatgccttttttcaagctgctaaagaaaactgataatttccagtggggacctgaagcacaaaaagcctttgaagacttcaagaaacttctcactactccaccagtcttagcttcgccacatccgcaagagccgctgttgttatacgtgtcggcaacttcccaggttgtaagcacggtcctggttatcgagcgtgaggaagaaggccatgttcaaaaagtccaacaaccaatctatttcgtcagcgaggttttggccgactccaagtcaagatatcctcaggttcaaaagttgctatgtggtgttttaattactgttaggaaattatctcactattttcaaggtcactcggttacggtggttacatcgtttccacttggggatatacttcacaatcgcgaagcaaatgggcggattgcaaagtgggccttagagttgatgtctttggatctatccttcaagccgcgaacttcgatcaagttccaagctttagctgacttcgtcgccgagtggaccgtatgccaagaagacacgtctacggagaagatggagtactggacaatgcattttgacgagtcaaagaggctatcaggcactgtagcgggggttgttctaatttccccgactggagagagactaagctacgtattgtggatacatttttctgcgtctcacaacgtggcggaatatgaggcgcttcttcatggattaaggattgcgatttctgtaggaattcggcgtcttatagttcgtggagattctcagttggttgttaatcaagtcatgaaagagtggtcctgccttgatgataacatgaccgcctatcgtcaggaggtatgcaagttagaagataaattcaatggccttgagctaacccacgtccttcgacataataatgaggcagccgacagactggctaattttggtacaaaacgaaaagcagcttcttccgacgtgtttgttgaacatctttatgagccaaccgtactaaggaaagaaataatcgagaccacggacactcaagaagtaagcacgattgaagccgactggagagagcccctcatcagatttttggctaaacaagagctccactactggagagggagaagctccctggtgctaaaaacacccggcaacaatggaaaaacacccggtaatcactgttgccgtgtacctcactccggaatcattacccgggagtgaaaagaaacggcggcgattgcgtagtgcgtctaaaaacacgggaagccttaatttacggagcgtgcgtacgcctggaacacccagcaaacaattttctgttaccgggtgcatagcatctaacacacgataagtctcagtatttgcggagtgcctataaaaccatacgttcatttgatactctgtaatgttcccgactctggcattatttacagtattgatagtgcaatatttgcttattcatttattatttgcaccagaacagcagcatccaaatcacacatcaacacagaagaatggattgaaatgcattgacatccatgttcagttaatcaatttgatgacaatctaatatggaacaattgaaataccaatctcagaaacagctacaattgagatgaatttgagcattacttcctctaccaacaagcttgggcaaccaggaactcttgcaaacagaagaaaacatcatatgaacggcaccataggcagtttgaccactcctcataacatagcaaataagccgattgactaggaaaacctgaacctgagattgcataaaagagagatcaatttcacataaaaaagtggtgacactttcatgtgttgtactaaaacaaagtgatgacacttatgtagaatagcactagcaaaataatatgaatgatgtatgcgcattgaaaacaaagtaatctgaacttgtacatcttttattcaagattatgtaggcttgttaaaatttaggcatagtgtcagtggaattgttgatggcgcatgatgaagcaatatgcgcccacgtgactgatttgccaattgcccaggcattacaaccaaatccaaataaatgattatgcagcttttatttgacagaacatcctgattactagtatataatgctcaatcaagattcaggaacaaaatagtgatttatcatcccagttgaaacaattgccattcatctatcaaaaacttatcttagaatccacaaggggttcataaaaaaattggatatcatgtagccagatcaaaagaattaactagcatatgaagtggcaaaatttggtagtattttacttcactgttattcggattcactattgttggcaaaatggcagcaccatatcataactaaaaacttgaaccacaaatgcagacatagtaaaaatggattaatatagatccatcttcttgctgagaatcaggtgtgagagcttacagcgcaggtgagtatctgatggaactggtgtacatcagatccctctagctggtagcaaaaagaatatctgcagaaatgatgaggtctgatttaggaacacaaatcctttatttcaaaagctccagagctaggagaatgcaatcttcatgtactattatttattgcatgatccttctaaaaatgaagtatgcaacatcttgggaacatctaacctagtggcatttggcatagcaggggcataaacaatgatggtccacctcatcatgtctccaattttgaactacatagtagtacttatatacagaaaacatgaatttatattttacaaagaaggaaacaagagcttgcatatggagctaacaaaatgagctttgtcagactatattaccaaataaaaaatgccaagtggaggaaaaaacttgcaggactcagatacaacccaatggaataattgacctggccaagatcattaattagattactcatcagacctgtggcaatgggtcactagttgatataatgctcgactatttgcgatacacatatataaatgcatgaaagaggggtagtaatttaatcttttgcacaaaactatacaaggatttgttagttactccttacaatggttgtttgtttccaacaagaatagtccagcaatgtgaaggaagctagataagtccacaagaaaagttaaagacctatattaaatgatcatacgtctttggactagactgaacaaaatgatggtagcttacattcatgggacctgcatggccataccattgtctggtacattcaacacggttctattgttgattgcgctcctatcaagaaaaagaatacagtgaaaatattcataagtgtaaatccattttattgttggtcaagctaacatggagtcatacatataccagaaaatgaataaatagttacttctataatcatagaacactgcctttacaaaaacagcttcagatataaagagtgtgacatatgaacagctggacaaaattaggaagtggtataagtttgttgctcgatggctttagataagtttaatatcacttctcacctaggaaaaataatgccatgcagtacacacagatctgaaagataagtgctgaaaggagattattactctaccaacctaataatatttagtgctgaagatttggcaatgagcacccgtcgtcggtatatttaggaagaacttaccgagcactctagcagcagtggcaggtagggaggatgagaggccagcactggccatgggaatgtggtggtggtggtaccaaagtggagcaagaggcaggtcgcagactcagacggagaagtagccatcgcagggtgtcggcgcctcttttcatgtcttggcgtcgcaggacagcaatagaggcaacaggctcgtgtggggaactgcagggacagtgaggatatggtgctgcacggctccttcgtacactaccacctccaccaggatggccgttgcggtcgccgtccctgtctcctcagctggcgtgccctcctccctcacggtagagatgcgcatctctgggcgtggtggaggggagcattgaccgccgaggaggtttcgaccacctcgccgccggcagcaccttcaactgctaaagtcagagggccgagtagccgacaacgatacgaggagcaccccccaactctgattaatcctactccaccccgaggcaccgacaggcacgagtacaattcctccctccccattctccatgcctagccaacgatgccgatgcggatctggtgcggcgaggagaggagagggtgagacgatcggaatcaaagccggcgtcgacgagctgcaggttgcagcctaccgcgcggaggagccaaggcggcggcggcggcggcgcgtgggagaggctgagagggattagggtgcgagtgcgactgtgcgagagtggggactggatttggggaggtgatggtggcacggacggctttggttgtctgtgaccgacggatcggacggctcacgcgagggatggttactgctgccctagaaagatgggggatttgtattcccgcccaccaccggaaattgggaatttggagggaaatatttggtttcattaaccctgattcgtttttttnnnnnnnnnnnnnnnnnnnnnnnnnnnnnnnnnnnnnnnnnnnnnnnnnnnnnnnnnnnnnn

SEQ ID NO: 659 - DNA, 13519 bp, Oryza sativa
ggtgcgagtgcgactgtgcaagagtggggactggatttggggaggtgatggtggcacggacggctttggttgtctgtgaccgacggatcggacggctcacgcgagggatggttactgctgccctagaaagatgggggatttgtattcccgcccaccaccggaaattgggaatttggagggaaatatttggtttcattaaccctgattcgttttttttatttgtttgtaacgtgcagttgatttattattatatcactgaaacatatacttctcatggataaaatataatttcactccaataaaatttagaatgaaaatttttaaacttctaataggataattatagagtaagatttttatactttaataattttagagcaacataatggatcttaatagttcaattcctgacattgagtgaacaaaggacttaaaaccccttaaaaagtatctaaattttatatttattgcaatttataaactaaaaccaaaactaaaacaaactcatagtatcaactagcacataacaaattaatgtaacttagtatatatttgttcttttaatttctacgtgtttttacatatatgttcctacatctttgtttataaatcatgcaattcatataggtaagtattgatcaaagtataatttgatataaatataatttaaattcctttcatttgatttaaatgctatttgcccattcatctaaattaatataagtataatttaaagccagcatatggaagtagggtgatgtcaagaggagagaagcaacgccgatgcctctgtccaactgaaacaagactaagaatgtgagtatagcaaggcgacatgtcaacgcagttataggagcgagggcaacggatagaggaggccaatatggcatgcaacctatggttttctccacatttcctgaatgaatttgggttgtcttgccgatccaaagacgaaggaaggattagttgtcctaggctaagtggcggtcaaatcgagcccactagcaagatcgaacaatcctcgtgagttagcggcttcatgctattaacagaaagtcgtagaacttctttgcagaatcactgacatcatgtcccattgcctcagcttctcatcgagcctacatggtttagagagattaatatgatggatgaaattgagttctatgataactatggaaggcacaaacaaacgaatttaatactagtaagatgaaaagttaaattttaaataaacctaagaaatatcaatgaaaatagttatcaaagaaatcaaaccatcgaattgactaaatgcgtcgaatttcaagtatttcagaaaaccattgaatttttggaaagtggaatttgaatacaattttctggtttctgagtaaaacaagaacaagtttgaaccgatatcaatcaagatctgacaatttttattaaaaccacggagagaagacgtgcaccattggttttagaaagtgaattagttttatggaaattaaatttccatgtcatactccccaaattttagggcccctttgaatcgtagggtagaaaaaacagaggaatacgaaaaattacaggattctgacagaaattgaagtgtaaaacataggattgcaaaacacaggagaaacacaggaatggtcgtttgattggagcgcaggaaaaacgctggaatcggatgagagagatagactcaaagaaaatttttcaagaggttggagctcttgctaaatttcctacaaaatccacatgcaatgtgccaatccataggaatttaataggatttggaaagctttaatcctttgaatcaaagggccaaataggaaaatttcctataggatttgaatcctatgaaattcctacataaatcctatgattcaaagggtccttaaaaggaagatatgtatagaatccaactatttagaaacattatactttatttttgttttttcagtatgtaattcaatgatttctgcctcaaaagaaaatgctacaatcagcaataaataagttaattaattaattaacagtacaaaaaatactgctcattatatggcgtctgtgtatatcgattggtctgggtgagttttgctatgagtactattttttatattcttctggtttacttttcacccgaggaactgtagcagtaacggaaagtttttcaggccgttgattgacgtgtggccctaagtaccggctggtccgttagttagttggaattaccgggtgtgtgtaccagaacacacgataaacatcagattccgttagattcggccaaaaaaatagcattcgcgccaccgtgaatattttggcgctaacgcatttctgttcgcgccaacgaaaatagcttggctgatggatgtgggccccaagatcccgggtgtaattggtaaatctcctaatgttacgtagtgtttaaaatgaacgctctgtaatgacatcagttacggggtgttcctactatacactccgtagtttactcagtgctagatcaaacatacggtaacattctgctcccacccgggagagtctctcatcctggtagctccctcaagataaagacgaagccgagcggatctccagacgcagcaaactttatgtcatacatgagaccgagctgtacaagaaaagtccatcagggattttgcaacgctgtgtgtctttggaagacggaagacaattgctaagagataaccattcaggcatctgtggcaatcacgctgccgctcgaactgttgttggcaaggcttatcagcagggttttttctggcccacagctgtatccgatacagacaaaattgtgcgaacatgtgaaggttgtcaatttttcgcccgacagactcatctaccggctcaggagttgcaaaccatcctgttattttggccgttcgcggtttgggggcttgacatggttggcccgttcaaaaaggctatcggtggttatactcatctctttgtagctgttgacaaattttccaagtggatcgaagccaaaccagtcatcacaatcacggcagacaaggctagagcttttttcatcaacattgtgcaccggtttggggtacccaatcgaatcatcactgataacggcactcaattcactagcggagtatttcaagatttttgcgaggacttcggcatcaaaatttgttatgcctccgtagcgcaccccatgagcaatggacaagttgaacgtgctaatggtatggtacttcaagggataaaagcacaagtttttgaccgactgcatccctatgctggcaaatgggtagaacagttgccatatgtcctttggtccctgcgcaccacacccagtcgggctacggacagtcaccgtcctttctagtatatggtgcggaagcaatgttgccaagtgaggtagaattcgaatctttgcgatttcgtaatttcagcgaggagcgctatggagaagaccgagtagatgatctcaaccgactggaagaagcccgtgaagcagtgctaattcagtcggctcggtatttacaggggatgcgccgttatcacaatcgcaatgtttgatcacgagctttcttagtcggcgacttggttctgaggaaaattaagactgcacgagatcggcacaagttatctcctttgtgggaaggaccgttcatagtttctgaagttactcgaccaggttcttatcgactcaagcgtgaagacggtactcatatcgacaactattggaatattgaacatcttcgttgtttttatgcttaggcattactttttgtatctttctctttgactgctaacatcaagttcttccttgagttatcagtcgggggctactataataataatggagtgtgatttttatcaattcaatttgcttacttgatttatcattgccttgtttgattttttgacttagtcaatgaggactgaaagtttttaacagcttttgcgggttctaggctcaataaggtttgacaaaaacttttaagaaatcaggagctaagtttaaattatcaagcacagcataaatccatcagtattgtacaaattgtgcctccatcatcatcatcattgtcagaaaacaatatcaatcagtttcagtcttttcatcgtcagagttattagatccagtcggcctgaggtcgttgtcctggaatctctcaacaacatcagcggctatcttgtcagcagctttctacgcatcattaatgagatcaagggcagcttcttcacttgtctcgtctgcaaagccatcgataggatcaatgttgatctttgggtacaaggacttggtcatcgccaacgccagactcgctcccatgcttccagcttccttcatgttcttaaaatatgtttctggagcaattatcggcttgtcgaatattttggcagcatcaaatgaacatggcttggacgagtggtgcagcagcgttggcgacttcatctctagctccctcaagcctcttgattttgttaaccaagacgtcgaattgggcttgggatttgattttgtgatctgcacaagtagattcgcatcagcgagtgggcatgaagatgagagtggtttcttgaagttgcagctgtgagtaccttcgacatctttcagagccgagtccctctgctttgtcagttcgcccttatctttttccagagccttgattcgcctttccagctcggatatcttggcagtttgcactgtattgcttctcattggttagttgcacatggatagcaacacgaaacaagtcagacaaagttgggagttaccttttgatgaaccgctcagctcgaagttggagtcttggagctctgcgatccggtctctcagatcatgctcagtcttcctggcaagctccttggcttcacgcagctggtctttggtggcttccagggttccaagatggggaaccaatttttcgagggtcgcggtcttcgcctgatttctaagatggattctctgtgttgcaagtgcatctttattcagtaaagtggccgacaggatgattgaagctacgtataaagagacttacatttacaagacgagtagcttggccgagtgtctttttcagaagctgatcgtatccgaagaacctcttcttcatcaccgatcattggcccttatacattcatgaataatggcaaagcaattgaagaaagtttgtcggatcaaggaaagatttggaggacatgtttacctgtaataatttccggtcgaggacgagcaggtccttgcaccctaacaggagagttggttccagggccagcaccagcgtccgtcttgggagggctgttggcttgagcttttgcttctggcatatctctattttgttcagtacccgactggtttccagtcgggggctcctgatcagcaccgactccagcttcggccgactagtttctagtcgggggctcgttgctggtatctacattgccggttgccggttgattattacccgggcggtcctcggtagtcggctcagtttctgctgaaggaccattctccgtgccagtcggcatggggtcttttcttgatggatctatgtcagatggtttcctacaaatttgagacatgctatcagctttgcttcaatagtgagtgactagcgaaattgggggaattgctagacgacacatacctggatgacttcctgattttcggcatgggacgactggatgttttcttctttggattggcttgctttggctatttttcagtcatccttttgttgcccgcgtcatcaccttcatcgtcacttgaaaccaacttccccttatgagaatctggctggttagtggacttcgcggtgttgggttggacgtttgactggatcttcggccctccgctggcttggctagtttgccggcgcggtgagcagcgtttagcaattggaggatcggatttcatcaaagcgaattcctgtgcgtggtattccaagttttcagtcgaccttacagaagataaaagcatgctttgagaaaggctgaggtgtatgatacgtaccggtggaggagggttgaaggcattgcatggcatgactggcaataagtgtgaatagctgaccacgatggcattcgagaaaattttgtacattctctcctgcataattttgaattcaagagactctgtgtcttctcggttggggtcatgcttgccgtcgaactcgaaagctgttcgggatccttccttgattggtgccagccggctcttgataaagtgccgagtaatttgctccccttgcaggccctattccttaagcttcagcatgcgatccaacaggtcaagcgcttgggcagcctcttctcccataggaagtgagttcccggtatcgcgatatactggaggaagacaggagtacccaggaagcgctggctcggggttttgcacattgaaccagttcgcgtgccaacctttgttcaaggtcttgaatggcacggagaagtatttttggctctaggtccccctcagttgaaatccggctcccccaactacgcatggtttgcttttattaggctagggcttgaggaagaagatgcgacggaatagagcaaaatgtggcctaatccccagaaaggcctcgcaagcatggatgaaattggcgatgtggactatggagttggggtttaggtcatgcaaactgatcccatagaaatctaaaatcccccggaagaaacttgaggtcggaagggaaaacccgccatagaagaaatgggagaataccaccacctcgtatgtgtcgggggtcggaaacgtttcaccacatgctggacgccacccgatgatctccttcgccggaagaacgccgtgcaccaccatctccttcaggttctcctccgttacatcagagggcacccattgactctcaaagctttctctctcttccgccatggatacgaactggatgatgtgatttggttcgaaatgtggctgggaatggatgggagattgatgcggtggttccgtgggagatttttgtggagttttggtggctggattggagcgaatctatgaaccctagcttcgccggtgtggtctgacactgtagcagagaatggggaaagtggcgagagttttggcggggaagacgaaccgacgctttgcattcggtgttatttcattagggtatcgggagtactaatgggcctgggcctaaacagtacttcagcccaattaggctatcgacgtggctaagttgtgatccttagggacttaggcattttgctttggcaacacttgctcacaacggtatagcccaatgctgttaaaatcctttttgacgcagttagataattatttggaattactacgatgcaaataaaatggtgcccaacggaaaggtgttatactaattttgtaagcctttttaggctgcaaaagctgtttgggttttgttgagatgactagtttttgaatagtcattctctcgacatgttatatgcttattttgatatggtgcgagtcatagcttaggcaatttagactcacctattgtcatgatttataccacatttgatggatcttttttgagagtttttacttggattcttatcatatgtgttggtttatagacctttagagtgtttttcacgcgggactttatatatctcctttcctggggtatcaaagctaaagcagtcagctggatgttttattaacgtcacatatgcttagctatgtgataccatggatgatccggttgtaaaaccactcggttggatgttatttacaccttggttatatccttagtttttaactaaacacatagtcgaggtctacacctaattaggtgtatctaatcgatgcacctgattttctctatttttagcccttcacagtctttgattttggcactcgggagatcaaggcagaagaagtcggagtactcggattatcgtttggattacgggagaagactatttcgtcgactgtaaatgtctcaggggctactgtggagattatggatacctcatacccacacgacatgtatagtccgactgggtatggggtgccatgtgtagatagaatatctttaaagggactcggattaaattccaaacttgtatgttaaggaaatatccgggatcctagtcggttaccattgtaacttatctgtaactacctattccgttagggatatggattgtactttgtaatacggacccctccccctatataaggaggggtccgggtgcctctaagggcacgattttctcccagatcatacgatcaataacatactcggcggatcaatccccggataggagtagagtattacttcttattaagaaggcctgaatctgtataaaattccttgtctctcaacccatccacttttctagcttgatagccacccctttagtattgccgaaatctcatttcgacagtatgaatttgacatggtgggctacaaacctagaaccatatgtatttccgacttgtagttggccatcagtgtatatatatagaaattgagaagattagtatagattctactagcgatcatagtgatacatctaagaagtaaagctatcacttgtgggctttgtggaagggaataagaaaaaatatgaggtagcactataggaataagctattacgtttactagccaagaacatgtgtattgtaacggaaaatgaaatcagtttctagctcaattaggcacatatttagtcaaattaacacttttatgtttctccttattgaataagtagatgagttcgatgtttaagataaaccattagtgaaacgggagaggactcattggaggttggtgcaatactatagattgtagggcctaaatgtcagtggtagggggtagtgtgaaagaacagacaccaccactacagacatttgaagtagtatagattgaaaaagcaggtgatttcaaagtttaagataaaccaacagtgaaacgggagaggactcgttggaggttggtgtaatactatagattgtttggcctaaatatcagtggtaggggtagtgtggcagaatggacaccaccactacgaacattttaagtagaatagatgtactctattgcttaagtgtgaaagaacttacaaagttgttgatttatacataacagctttgtcaaatagccgtgagccccatggacaagtcagctcaggtttaaccgactactttagattttcagcaagctcataagctttaggcttatcataggtcacaacccgaagtgcttcgaagtaaagagcatgatcagtaagtattaaccttgccagcaaaggaaaagttgaaatccagtgatataaaaccgtaacaaggcaagttaaaaaaagcatgccagcatctaaacaacaagaaatcgtttctcctcactgagaaccagacatacctggccatgtcgaaatcctaacatgttcaagtactggttgagtcgtcaatgtttcatctatttctacaatcctttctcctctctgagaccgctggccagataaaatcaaggactcaaattgtcctttcattttcttaatctccctacatgagataaaacatactctcagtcctgactttatgaaacaagatccaacagaaagttatatgcttgcatatcctatcttcagaaaaacaaagggagtatagttgaacttattttggtaacaaaaattggcaaatatgttatcccatatttgtcgaggttacggataaggtataccctctatccttggataaacaatgagtactgatatggtatgcccgcgcgtatatggatagttcctatatgtgttaaggaaatctatcacgtgatagaaacataatccatggatggaaggagtcctactcggacgagactgggtctttaccatatcgtgaggggtccgatatctccgagttctacttgaagatcaacttacccgcggtataaaagggaccccctgggtaggagctaaggcattgaatatcatcgctaacacatccaccacagcctacgaagccggagcctacaggagctaagtcgccgggtgatctagtcgaaccaactcgactacggtctcgtcggtaccatcgagttctgttattctctttgtaatctgtggtttccatcatataatcccataccaactagattaaagctattacctacaaaggggcctgaactagtataatccttatcttctgtttgcttgatgtcgtactacatagatcctcataccaacataccccaataccctctatattcggtctacgggtatcccctgtcgacagttgcgcgccaggtaggggaatttggtgctcaaggttttactactatgacttcaagcctcctcgacaacagcgtcgaccctgggatcaaccaaggagcttcaacttcaacgatgctggtgtggactcaagtcggcgaaatcgtcttcccggtctacaccacgatgccgatctcgactggcgcagtaatcaccagcagcgagaacggcgtggttacgaccccggtcgactccatgtcgaaagatcctcccgcaggagcggagaacggaacatcgacaacatctgcgcccgagaagggtcctaacgcggccagttcttttcgttctgacaagaagcacgagccgacaaggacaacttccgaggcgacgaggatctggtgtcccatccacaagaccaaaaggcacactttggaagcttgctcggtttttctcgacgtacaagctgaaatccgtgcctgcaaagagcatggaatccaacgcacttctccaactcgtgatgtctattgtcccattcacaaggcaaagactcatgacctctcaagctgcaaggtcattctcagcgccatgaggacgtcacctcctaaggtccaacagtcacaaatctctcctagagatgcggacaaggaacgaggagcaacgaatatttaagatcgattcgtcagggtaatcgatattgatccccacgagccatctgtcctacatctgctcgaagaccaggcctcatcatcaacaagtacaccacgcaacatgtacgccatcggtgggaccagcacgtctggaggcggcaacacggaagcggaggatcaattggctacgccagcccaacatatcagaaccatcaacgcaatactgagggaaacctctaatgatcccgtcctgaatgctgatctcgatcagtggacggaacgactacgggaatcagtggccagcctcagtaacgcgttcgaggaggccgctgccagggcaccaccagaacaaccgccgaccggcggcgctaatggggaacagcctgaacagcggacgccacctcgtcaagccacccttccgccttgcggcaccagtgatctgcgcgaccatctgaatggtcgccgagaagcgcgacgcacgtgagacaacgaaaatcattccccacatcgcgtctctttgcgacatcacgagaacgaagaacaaggaggacatccgagcgagaaccgagaccgtgatgatcaccacaaccaccgagaacatgctaatcgcgaactgtggctgccgggtgatacaagttgaggtcgacgccgcaatgacgacgacgatggaggtcgacactgggaaaacaacgatggatgacgacgaggctcacgagaacccgagcgtcgtcctcggaaccctgccccaaaaccgagtgattcgtcatcgtcctcgtcatcttcatcatcttcctcatcggacagacatccacgacgagcacatgatcgccgacaacccaccgctcctggcggcgggtgcagagctttcactcgttccctacaagaggttcgatggcctgagaaatttcgaccaggagcaatagagaaatacgatggaagcaccgaccctgaggagttccttcaggtctattccattgtactctacactgccggagcagacgacagcgcactggcaaattatttgccggcggcgttgaagggatctgtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacaggggaagactagggcgacgaccacaggcgcttgacggcaggcacgagctagacaccaaagccttcatcttccaggaactccacttctgggtttgggaaaaattgagcaagactgagtacaaccaccgtactcaacaagacacacccacaagtgcagaataaatgcaagggagtacaagggggttataatataaggggttagggtttgcagtaaacaggatttaaaagacacttagttgcccaaagatattttataaagacgatcctagagctatacaagattattaatcaaggccgtgaacccacacgaacctgccttaacccaaggcctacgatgattcagactgaattggcaaccctaccctgggtcccagctcgtcccaagccaacccaggccaaccattccacattttagttgttaagcaggttttaagaattaaaacactaacttgggtacattacttggcttgcccataaccgagggcgcggctattcgaatagattatactctgatcagaggtgtacatctttacccacaagacacatcttcctcacgtgtaaccacgtgccacataccaccacggtatacggatggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcatgtagccttcatttgccctagagatgtccatcgacccctgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtatccagatgatatgaatatttcccaaagtctatagttgaaaaaccacctaatgttacctaattaaattgcgaagcatctacctaaaactaaactagtggtgccatgagtagagtgtccactagttggggttttgtttgttctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaac

SEQ ID NO: 660 - DNA, 1715 bp, Oryza sativa
  unsure (1)..(1715): unsure at all n locations
nnnnnnnnnnnnnnnnnnnnnnnnnnnnnnnnnnnnnnnnnnnnnnnnnnactaacttgggtacattacttggcttgcccataaccgagggcgcggctattcgaatagattatactctgatcagaggtgtacatctttacccacaagacacatcttcctcacgtgtaaccacgtgccacataccaccacggtatacggatggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcatgtagccttcatttgccctagagatgtccatcgacccctgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccaacctaaaaccattttgagtgttttgaatagagggggaggtgtgaatccaattccacaataatccaaccattccatagtgtccaggtggtgagaatattcccaaagtctagagttataaaaccacctaatgttgcgtaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacttccacgaagagcggatcttccgaagctgcatcgtctacacgaccaacggaaaagaaaaggcttttactctaataaactccatataacagcagaaacaaagcacaaaaatgggttcttgacttcttaaggaaaaattagagacttgaacggtccaattccgagttcaaatggccaagttatggtcatttgaagtttatatgctctttaaatgaatatttgcgaatttcttcacttaaattttaattttaaaacggatttattgcgtcagccgaggggagggggcgcgcggaccgggtccacgggagtggggcccacgcggcagcctcatggtccacggtggaccgggtgcacccgggctcacaccggccggcgccgtgggtcccacgcgtcagccgcacccgagggagcgggcggctgacggccgggccccacgcggcaaccactcggcgcgcccgagggcagccaagccggcgcagccggcggaagtcggtgcccgcgcccctatggtcggcggcggcgcccataggcacggcggagcgccgcccgagagaggggaagggaagggggaaaaggggcggcggtccccggctcaccttaggtcgacggcgacgacgaaaaagtcgtccggagcgcaggaaggcggccccccggctcgggtcgacggggtcgacggcgttccggcggtcggcgagcgaaacggaggggtggacgaggtcgg

SEQ ID NO: 661 - DNA, 3612 bp, Oryza sativa
  unsure (1)..(3612): unsure at all n locations
atgcattttagagtcgttttgggacgtgacaatctgcacgttcacggctggttcacctcccgccctactcgatctcatcatgggcagatctgtggcaacagtttatcaccaacttccaaggtacatacaagcgccacgcaatcgaggacgacctacacgcgttgacacagaacccgggcgaatcattgagggactatattcggcgctttagtgagtgcagaaatacgatccccgagatcagcgatgcttccgtgatccacgctttcaagtttggtgtccgagatcgctacactacccaggagttggcgacaagacggatcacaactgctcgtaagctattcgagattgtcgatcgatgcgctcacgtggacgacaccctgagacgcaagaacgacaagccgaagacagcaggagagaagaaaccagccaaggatgcacctgagtcaagcaagaagaagagtagcaggagtgggtgttaacgaccaaatttggtaatccaaggatcggatgtggaggaggaattgagacggagttcgagatagagattgtcccggaaacagagtgtgcagagttcgagtcggacagggttagccgattgagccgaatccaacaatatgacacgacacgtgttgtcgggttaggttaacgtgcttcatgatggttgccacgcatggatagagtcctgagaaggcaattgtatctattaattaggatatttcatgtaatttacttagagatatgtttgggcaaaagtctgccgcaaagacttatggtatcttagagtttgttagagataagagtcgtgtccgataaggacatatcttgtaattctcgggtataaatagacccgaggcccatgtaatcaaactaacacacgttcaatacaatctcggcgcatcgccacccttttttgctttcattttgtttcgacgagttattgctttcgggttgagctgcatcggtttcgatcttcaacgagagtaaaacttgttatggcggcttgcgttcttgggattagtgtttccatcttcatgatactctaatcttgtttatgtaattcgtcgagttatcatatatcttacataatctctagctatatcgttatctaacctacaatcggctaacatctgtcagtagaaagcagccgattaggttaaatatcgatgttggtttagattatataaggtatccaccactctatgacacatccaacggcttgattgtctagatattgtccttcttttcatacttatagctacatcagttgagtttgatcttaggagtcatgattagaatctcaatctatagcctatctttggttgccgattatggtagtattgatgtttcagccgatcttacatttattttatatgcttgattgacatgttaaatatgccctttatgctaggatcttgttgcatttaagtatattaggctctccgtttggtatattttatttgctgtgatatcttaatatagagtggtatcggagtattagctgatacatgctagatctatctgatcggctatgctatgaacacatatagtctcgttattaatatatatttcgatctaagtgatttatattgtctcggcacggcgaccgatctatcccaatcacttgatttaagtatatatcgatataaagactatataccgttaatatctacaaccgatcgagtagatttagttctttcttacttattaatgaatgccgatcgatgcactatatgacatcggcttaaagatgaatgatatgtcatcggcacctagctgatcggctatcgtttatggatttaaccgcggtttctttgtctttatttattgttgattgcaggatcaaatcagctggcacgctcatacatctaaaggcaagttttggacctacactggagttaagcagatctcctaggccttgtgtttttacatcaatagtgggaaaaggaaggctcaaacagaagtcttcgcagcagagtatgcgaacccacccaagcacccagacccacaaggcgacgacacgaagaaaatatggtgccctatacacaagtcggataagcactctcttgagacttgtttcgtcttcaaaaaggcactcacaaagcaactagcgttggagaagggcaagcgagtaagtgtagtcgagaaggccgcagaagcagctactcaggactcagactcagcctacccagactccgacctccatgtttcgcacatcttcggaggttccacgatgtactcctcaaagcgagagtacaaaaaggtggagcgcgaagtttgttcaacatggcagggggctacatccaagatgaagtagttagagcagaagatcgaattctcagaggcagaccaccccaagactgctgttactccagggtgatatccgatcgtggtcgagcccactattcggaacatcaaggtcgcacaggtcctcatcgatggcggcagctccattaacctactcttcgccagcaccttggacgcgatggggatcccacgaagcgatttgacgcctactgatcaacccttccacggaattactcctcagtcatcgtccaagccattgggcaagattatgctacctgtgactttcggccaagcaaacaacttccgaacagagcagatcacctttgatgtcactgagtttgacacaacgcatataattccatcatcgggaggactgcactcgcgaagttcatggccgcatctcactacgcatatcaagtgctcaagatgcctgggccaaagggaacaatcactattaagggaaacgcgaagctagcggtacagtgcaacaagcggagcctcgacatggttgagcatactcccaacccgcctgccacagctgagccgtccaagaaagtgagcaaaaccaacaagacactgaagccagatggcgcaatcaagattgttctgctctccagtgccaaccccgacaagactgtcaagatcggggcgtcactagatgagaaataggaattcgcgctcatcaccttccttcgcgacaatgtagacgtgtttgtttggtagccgtccgacatgccgggggtccctagggaggtgattgagcacaaactcatggtgcgactcgatgccaagccagtaaagcaaaaactgcggagattcgcaccagatcggaaacaagccatacgagaagagctcgacaagcttctcaaagctggtttcatcctagaagttctccacctagagtggctagccaatccagtcatggtgcgcaaggccaacgggaagtggaggatgtgtgtcgatttaaccgatcttaacaaggcatgtccgaaggatcacttccctcttgtcacaccctgattttcgtcttaggatttataaattatttaataaattattaatggaatttatattaaatgttctttaatttacaagtaaagttaaatgtgggaaataaaattttctaaatataaagcatggatggatttaatttttattaaattctccatggttaattatactctctggaattttctcggatttttcggagctcaattattaattttaatcatacaaagagaagttcagcaattnnnnnnnnnnnnnnnnnnnnnnnnnnnnnnnnnnnnnnnnnnnnnnnnnnnnnnn

SEQ ID NO: 662 - DNA, 5388 bp, Oryza sativa
  unsure (1)..(5388): unsure at all n locations
gcacttgcatatttgctgtgtgccttgctgagtatgtcatatgctcacctggcaataaccaatcaccgtcagttgaagaaaaaggatccacagggagaagtcgtttggcttatacaccagttgacctgcctgtgggagtggagccggagcttcgctagattttattttccgctgcagttttcttcttgatgaggactaagtgcctcataagtaagtatttatcgttttagttaatttgatgaatctgtatattaaattgtcagtttgtgtacctcggttgattcctggacgaggattttatgcacaaattagttcggaaattactagtgaatttccgggcgtgacaagttggtatcagagccatctcgactgtaggataagccaagtggtcaaaccttaaggactaattttccgaaaacataatttgtgaaaaattttcctttcttccttatctagaattctttgcaaattgtttcattgtctactctcctctctcgttcaacttgagtagttctgaaactagtggttgaaacctgaagacgccaatgaggtctacttgtagaggtcagtaaagtggatcgaggaaggaccgaagtgcccagatgtcaagatagaatgaagttggcatcctaccttagaacctatgccgccaaagtgtctttgaagaatagttagtagggtagaacgtttgttgtttgttttgtgtgtaggtatagttgcattggagtagttcattgatgagtgtgtgactatactaggttgcttgcttaatcaacttgaacaatataatgaactacacacaccagatcagtggtaacctggttaaggtcttgtctttagtgtaacctctctcctcctatcttctctaatctgcaacagatggtgaacactcgcgccagtggaagtggaaacaataacaatgaagagaacccaacctttgctcaagtgctggctcaacagacccaattgatcaacctgttagtgcaacaaatgcagaaccagcaagggaacaacaatgtcaatcctccgccgccccagaacaagttagttgattttcttcgtgtgaagccacctaccttctctagcactaccaacccagtggaagcaggtgattggttgcacgctgttgagaagaagttggaattgctccagtgcacggatcaggagaaagttgttttcgcttcacatcagttgcaaggatctgcttcggaatggtgggatcatttccggatgaacagagcagaaggacaaccaatcacttgggcggagttcactgaagcattcaagaagacacatatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagttcttggaaggcttaaaggatgagctgtcagttatgttgatctctcatgactatgaggattttcaggagttggttgacaaagcaattcgactggaagacaagaagaacaggatggataaccgtaaaaggaaaatgactgttttccaggaggcacaaggtagtcgccagagacagcgtatcgagccactccaaattggtgaatctttttccgctggtcaaggacagtcgcaacagttgaacatcggtggtgagatcgaatcagagactaatgaaagcaatgaagtaaacatcgagcaagctaatcaaccggtgccagttcagcaggatcagtctcaagagaataacagtagtggaagggagcagcaggtatgtttcaactgttacaagccaggtcactttgcaagagagtgtccgaagtcaaagcatcagcagccgcaaggtcaggtcaacaacattgtcgtcacaggagccaatgcagtgccagttgcgtcttcaagagttgcgttctcaagggatacagctcagccaccagtttcaaagcagcagtagttttctttaaagccttagaataattatcggagttatggaataataagatagactgcagtttacctatgcctttttctttctagccgttccgaatctcgggacgagattctttgtaaggggggtagatttgtcacaccctgattttcctcttaggatttataaattatttaataaattattaatagaatttatattaaatgttctttaatttacaagtaaatttaaatgtgggaaataaaattttctaaatataaagcatggatggatttaatttttattaaattctccatggttaattatactctctggaattttctcggatttttcggagctcaattattaattttaatcatacaaagagaagttcagcaattatttaaatattaaattaatcatcaaatgatctaattataattgttaagtgattttcttgtttaaaaatccttaaattataaattgttgtttaaaaggaattattagaaatgattttaaaagcttaaaagagaagatctaattttaatttgctaaatctcaatataaaattgggttagataaaattttattaaatactatgcttgctcctctattttctagatttttctgggaattatttgagcaatggaagtatttttaataaatgaaacatcatttcacaatttatttttattgaaaaagttcaaaaagcccttccttagttgttgggccgaattcggcccaactctctttctctctccgcgcggccgaacaggcccatttggcccagccgagccggccgccctcctctctctcgtgtcaccgacatgtggggcccacatgtcggtagcatcttctacctccagccgccggcacaggccgagcccaagccgtcgcccgagccgctttcttctcctctcaaatccgctccaatccggcctcttttcttccggatttttgaggggttttgatcctctcgttctcctctatctcttcccccaagttttggagcaaatcgttgtgtatcttgttcgaatcaaactcgttttcgagtttatctccaaaaccgagttttgattttctcggatcgattcctcttgtttggagcccgatctcttcaatccaaggctatataaagcatcccctcgtcgccctctttcgtttgccccctctctcgtcctctcccgtgcaccgtagcgccgccgccgcgtgcacttagccgccgccgtcgccggccggtcttcggtcgcgtcgcgtcgtcgcctccgccgtcgccgccgcttgctgtcgccgccgttaggtacgccgtggtgaggagaaccccggccgccacctctctttcgccgccggccgccacagctcgccgtcgccgttcaaccgagccgccgccgtcgcccttctcgtcgccggccgtcgtcgttcgtcgtttgtcgtcgtggtgagtaccgtcgggttcgtctcgtcgtcctcttcgcgtaggtgctctccaatcgcccggccaaggtccctagctccggcgaggttgccgcccgagtcggccggccatggatgacgtcatgctgacatcatcgatctcctctttttcctttttttttaatagattaaatcttcggaaaatcatatctaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcttttgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttatttttgaatgtcaccgggtggtgtgaacctattcctttgttatggccaatttgcattgaatgccctattccttgataccttgggtaataaattgagtagcttgaaccttatgtattggtttggttcagctaaatgttatatatataattgcttagcaatgcttagaaacattagctcactaatgggatgagtcatatatactacattattatttatggttacattaaatggtagctcacgatggttaatcgtgtgatgataattaattgataattaaaacctggttaaggtgggttgtgagcatatggttttgacggttgtgctcatgacaattaaggaccggttcgcgagctactgttgtgaaacattaaccgtaccaaccacaagccagcatgggcaacggctttaccttttgtatagcatgattcattgcggggtgccagactgagaagcggcgagaagtccgtgggggtcgctggggagtccatgcctctggttgtagagggggtgattatgatccaggaatggtgcactgtggtgagttgtgttatgcagagggtattgtcacagcctctattcgggtactttccagtatcgcgacgcatggtagacatgatgctgaggctgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtacggttgttcaggatggttgggcctgtgcagcatgggtgtgctgttcagtgttgattaaaatttctgattaattactccactgttttacttctcttaaatctttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgagagtggagccggagcttcgctagattttattttccgctgcagttttcttcttgatgaggactaagtgcctcataagtaggtatttatcgttttagttaatttgatgaatctgtatattaaattgttagtttgtgtacctcggttgattcctggacgaggattttatgcacaaattagttcgnnnnnnnnnnnnnnnnnnnnnnnnnnnnnnnnnnnnnnnnnnnnnnnnnnnnnnn

SEQ ID NO: 663 - DNA, 6814 bp, Oryza sativa
  unsure (1)..(6814): unsure at all n locations
nnnnnnnnnnnnnnnnnnnnnnnnnnnnnnnnnnnnnnnnnnnnnnnnnnnnnnnctgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcggaccgggtccacgggagtggggcccacgcgtcagcctctcggtccacggtggaccgggcgcacgcggctgacgccggccggcgccgtgggtcccacgcgtcagccgcacccgcgggcgcgggcggctgacggccgggccccacctggcagccgcggggcgcgcccgaaggcggccttgccggcacggccgacgggaggcggcgcgcccgcgccccgatggtcgccgccggcgaccaacggcgcggcggagcggcacccgagagagaggagggaagggggaagcgaacgggcggtcctcggctcaccccgggacgacgagggcggcggagacgacgatcggagcggaggaagatggcggcgcggttcggatcgacgaggacggcggcgctccgacggtcggcgggcgaaacgaaggggtggacgaggttgacggggacgcggcgaagccgaaggaggtgacgccgagacgggaggaggtccggagcgacgacggcggcgaaccggagctcggcggcgacggcggagagagagtacaacggcgcgagcacgaatccgacggaaagagcgagcggcgagtggcggaaacggaggagtgaggcacggggaacaattatatagggacgggagggagagagggcggccggggaggaaggaaaccggcgcggcgatctcgggctccattgatgcgccggcgaactttgcgggattaaatccgagcgaatccgagggagagagagaggggaaagtggggggaaagagggagggaatcacggggagtgatttccccctctttatggcgcgcggggacggcgggatgcggcggattcggcggcggcggcggcgctagggcacgggcggcggcgggcgcggcgcgaggtaggcgatgacaggtgggccccacccgtcagcgagggtggcgggcgggcccgcccgtcagcggcgcgcgcgcggggaggaggccgatgggccgcgggggagaggagagagagggagggagttgggccgggccggcccaagagaggaagggggggaaaaggacttattttagggtttttctttttataaaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctcggcacaatttcgaggatgtattttagagtcgttttgggacgcgacaaacctaccccccttaaacggaatctcgaccccgagattcggaagaactgacgaagagatcgggatgggctgccttcagctcgtcttcacgctcccaagtagcttcttcttcggcatggttgctccactggaccttgcaaaaacggattacccggttcctggtcctgcgctccatggtgtccaggattttcactggcctctccacataggtcaagtcttcgcgaacttcaatttgctctgagtcggcctgctcggatggcactcgaaggcatttcttgagttgcgacacatggaacacatcatgcacgttgcccaaggaggcgggcagctccagctggtaagcgacttctccgtgtcgagcaatgatacggaaaggacccacataccgaggtgcgagcttcccttttgtctgaaacctgtgtacacctcgcaatggcgtgacccgaaggtatacaattgatgttcccgcagctttcccaacaccagacggagatggtgctgatggtctccctctgattgtgagtatatcagaatgtcatcgatgaaaaccacaacaaacttgtccaagtattccatgaacactttgttcattaagttcatgaagaaggcaggtgcattggttagaccgaacgacatccccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttagtcttgtctttcttctccacaaaaatcacaggagcaccccagggggaagtactcggacgtatgtaccccttttctttcaactcttccaactgtttctttacttcggccagttcatttgctgccatacggtagggtcgcttgtgcagaggagtggttcctggagcatgatctatccgaaactcaatctctcgcttgggcggcataccgggtagttcttccggaaacacatctccgaactccctgacgatggggatttctgacagtcctatctgatgcagttctgaactactgacagaggttgggggtgcaaagaaaacaaccggttgttccggccctcggtacagagtgacagtgcgcctcgcgcaatccactactccttggaattgagccaaccaattcatcccaagaatcacatccaaattcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatgggatgaacgaggaacgtaccaacgatgacgtctggagttgtcagcacgtcctcggccgtcacgtgattcacacgaccccgaatgacatccttcccaccgttgttggagcggggaggcgcttgaccttgctgacgccttggcttcgggcatttatccgcaaagtgcccgggctcgaagcagttgaagcacagacgctgctgaccttgagcgtccctgcggccttgaccgggctgcacagttggcgtaggaggacggggcgcacgagtcccttgctgattctgctgctgctgcggctgtgggacgcgcaccacgaattgaggtcgaggcgcggagcgaggttgctgctgctgttgttgctgctgcgaagaggatccccctggatagggattggtgtagcggaccctttggttagcacactgttgattgcggaaattcgccaagcggcgcttgtgcgactccagttccttgtgcttggcctccaagcggatgctcttgtccaccagacgttggaaatccggatagtccccagagactagacggacggacagctcgaggtccattcctgccaagaacttctcttgcttctcctcatcttcccgcacatcctccggggcgtaacgggccagattgttgaactcatgcaaatactccatcacggagcggttgccttgcttcaactctcggaattcccttttcttaagagccacgactccagctggcacatgggttctccggaaagcggcggtgaagcgggcccaagtaataggttgcccctctggctgcgtagcttggaaatggtcccaccatagagatgcgggcccctgcagctggtgggcggcgaagatgactttctcctcatcgctgcactgcgccgtgtctagctttttccccacggcatgcaaccaatccaacgcatccacggggttgttggagctagagaaggtgggtggacggatgcggaggaactcggcgagtttagagtgttgtgggggtggtggtggagcattctgttgtggtggattttggaggtggtggaggaaagcagtcatcatgttggcctgctgggcgaggatttgggtgagaatggcattggtatctggtggtggtggagaaggcgaaggagaaggtggaggtgggttgccctggtggttgtggttgctgccttcaggttggttgccatcaccggtggcagcatttctcctggtcgtcaccatctgaaaaccccacacagaaccagcaaacagagaaagagctaacaattaaaactaaccacccacaactaccataattcttgaatttattactgctattaaatgggttcattaaagttcaagttgcttaggcaaataaataaagacaggctccgacacagttatgccacacaccggcatgaccatgccccacacgacccaacaagaagacaaacgaggaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcatgttgttctcgaccatcccacggggtaccatctggtggaagtcgatgcgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcgacgttctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccatgtggataccccaagaccacgcacatgcctcgcagctccaagacgaagccagtcatgtgcaaaccacgacgggtgacgctgccggccatctacaaacaaaaacaaaaagaaaagacaacattttaaaggtcagattttggcgataaatgaagcagcaagatagagagagactagacagttttcacaaataacaaaggatttttatttttgaaaatattgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagagtagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattaccataaaggggttagggttgcagtaaacagcatttaaagacgtttagttgctcaaagctattttgtaaacgcgatcctagaactatacaatgttattaatcaaggccgtggacccacacgaacctgccttaacccaaggcctatgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagctcctaacagcaggacaccggccctgtgccatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgaagaccggtccttatatggccgaggtgatactatcaaaaccatgcacccgagcccaagctaaaaccattttggggattttg

SEQ ID NO: 664 - DNA, 779 bp, Oryza sativa
  unsure (1)..(779): unsure at all n locations
nnnnnnnnnnnnnnnnnnnnnnnnnnnnnnnnnnnnnnnnnnnnnnnnnnnnnnnttttgggacgcgacaatcttctacctccagccgccggcacaggccgagcccaagccgtcgcccgagccgctttcttctcctctcaaatccgctccaatccggcctcttttcttccggatttttgaggggttttgatcctctcgttctcctctatcttttcccccaagttttggagcaaatcgttgtgtatcttgttcgaatcaaactcgttttcgagtttatctccaaaaccgagttttgattttctcggatcgattcctctcgtttggagtctgatctcttcaatccaaggctatataaagcatcccctcgtcgccctctttcgtttgccccctctctcgtcctctcccgtgcaccgtagcgccgccgccgcgtgcacttagccgccgccgtcgccggccggtcttcagtcgtgtcgcgtcgtcgcctccgccgttaggtgcgccgtggtgaggagaaccccggccgccacctctccttcgccgccggccgccacagctcgccgtcgccgttcaaccgagccgccgccgtcgcccttctcgtcgccggccgtcgtcgttcgtcgtttgtcgtcgtggtgagtactgtcgggtttgtctcgtcgtcctcttcgcgtaggtgctctccaatcgcccggccaaggtccctagctccggcgaggttgccgcccgagtcggccggccatggatgacgnnnnnnnnnnnnnnnnnnnnnnnnnnnnnnn

SEQ ID NO: 665 - DNA, 502 bp, Oryza sativa
tggtgggccccacccgtcagcaagggtggcggacgggcccgcccgtcagcggcgcgcgcgcgggtatagtccgagtggcccgcggggagaggagagagggggaggtagatgggccgaaccggcccaagagggggagggagggaaaggggacctttagggtttttttctttttataaaaccattttaactttgtttatttcttaataattattatttgtgctctgaaaattccactaaaatttatttacgcattttaggcttttaggaaatatacaaaattcctccaagccttatttgacttttaactttgcacattttaatttttggaggctttcacacagattttaattattctaggtataatttagaggatgcattttagagtcgttttgggacgtgacaatctgcacgttcacggctggttcacctcccgccctactcgatctcatcatgggcagatctgtggcaacagtttatcaccaacttccaaggtacatacaag

SEQ ID NO: 666 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnagtaggatatttgttttcccctgtacctcttaaacatcatgctgtaaagtactttgttgtcgttgtagagatgttgatatcgagagtgtccagcagcgcgggcagcctggcatgccggtgatcatttcggcgcttgcgctcgagccattcgtgtcgcgggaggaggtcagtcaaagcccgtccgcagaggcaaatatggcgatgacgtccctaggatcgcgtcttagtctccttcactccttatattcggattgacttgatttgttgtgttcttgggagagaagaacagcctgacttagtcctttctgtgctgggcagacctcgaggatgcgttggctgaccgagatcgtcgaatccaatattggaatacgaagctcgaggtggctgaactcgagaggaccatggtggaagtgaagaaggaccgggccgtggaagctcttcgaggtcgcgaggtgtggttcaactcataccttaagagctgctgcacggcaatgacgggagtctacaaggagcttcgagttccccgtggagatcccgaggagtcggcggccggatatatctcgtggctgaatggggcttgtgcacagctcgaagggatcggcaaacgtctcgacgaggcccttgagcangagtgtcgtcgatcaagccggtacgcccgaagacatgtgcttgcctgcattcgagat

SEQ ID NO: 667 - DNA, 774 bp, Oryza sativa
ccgcgcgaagagataaagagagttggaccgaattcggcccaccaactaaggaagggctttttgaactttttcaataaaaataaattgtgaaatgatgtttcatttattaaaaatacttccattgctcaaataattcccagaaaaatctagaaaatagaggagcaagcatagtatttaataaaattttatctaacccaattttatattgagatttagcaaattaaaattagatcttctcttttaagcttttaaaatcatttctaataattccttttaaacaacaatttataatttaaggatttttaaacaagaaaatcacttaacaattataattagatcatttgatgattaatttaatatttaaataattgctgaacttctctttgtatgattaaaattaataattgagctccgaaaaatccgagaaaattccagagagtataattaaccatggagaatttaataaaaattaaatccatccatgctttatatttagaaaattttatttcccacatttaactttacttgtaaattaaagaacatttaatataaattccattaataatttattaaataatttataaatcctaagacgaaaatcagggtgtgacaagagggaagtgatccttcggacatgccttgttaagatcggttaaatcgacacacatcctccacttcccgttggccttgcgcaccatgactggattggctagccactctaggtggagaacttctaggatgaaaccagctttgagaagcttgcgagctcttctc

SEQ ID NO: 668 - DNA, 637 bp, Oryza sativa
  unsure (1)..(637): unsure at all n locations
nnnnnnnnnnnnnnnnnnnnnnnnnnnnnnnnnnnnnnnnnnnnnnnnnnnactctatccatgcgtggcaaccatcatgaagcacgttaacctaacccgacaacacgtgtcgtgtcatattgttggattcggctcaatcggctaaccctgtccgactcgaactctgcacactctgtttccgggacaatctctatctcgaactccgtctcaattcctcctccacatccgatccttggattaccaaatttggtcgttaacacccactcctgctactcttcttcttgcttgactcaggtgcatccttggctggtttcttctctcctgctgtcttcggcttgtcgttcttgcgtctcagggtgtcgtccacgtgagcgcatcgatcgacaatctcgaatagcttacgagcagttgtgatccgtcttgtcgccaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 669 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnnnnnnnnnnnnnnnnnncaagactctggacgacatgcagatccctcgcacagaattgaagccgagtaatgcgccctttcacggagtcatccccgggctatcttctactccactcggccagatcaccttgccggttactttcggcactcgggagaactttcgcacggagaacatttgcttcgaagttgctgattttgagacagcgaaccacgctatactcggacgcccggcgttagcaaagttcatggctgtcccgcattatacctacatgatgatgaaaatgccaggtcctcaaggagtcatatccctacgaagcgacatcaagcaagccgtcacttgtgacaaggaaagctgcgagctgtcccagacccacgagatcactctggctcgagaggaaatccgactggctgcgtccacagcaaccaaaggagaagtgcttgcaaccaagatgccaaagaacggagaaggcgacgccaagaccaagaaaattcctctagatccctctgatcccactaaaactgctgtaataggcgctgagttagattgtaaataggaaagagcgcacatcacctttcttcaaatataataaagatatctttgcgtggaaaccatctgatatgcctggtattcctagagaggtgattgagcact

SEQ ID NO: 670 - DNA, 657 bp, Oryza sativa
aaattggaaaaaagaaaaaagaaaggggatgatgacgtcatgctgacgtcagccctggctggctggctagggcttgcgagctcgccggagctacggcgatcggccgggaaattggagggcatctacacaaagaggacgacgaggcgaacccaacggtactcaccacgacgacaaccgatgaacgacgacggccggcgacgagaggaggcggcgcggcggctcggcttgacggcgtcgacggggctccggtggtcggcggcgaagggggacgggcggccgaggttctcctcaccacggcgcacctaacggtggcggcggcaagcggcgacgacgacggaggcggcggtgcgacgcggccgaagatggccggcggcggcggcgaacttaaagcgcgcggcggcggctctacggtgcacgagagaggacgggagagagggcaaacaaaagaggacgacgaggggatgctttatatagcattggattgaagagatcgaactccaaacgagaggaatcgactcgggaagaattcaaactcggttttagggattaaatcgaaacgaattcgattcgggcaagatactcaacggattgctccgtttcttgaggggaaagatatgaggagaacgagaggaacaaaacccctcaaaaatccggact

SEQ ID NO: 671 - DNA, 756 bp, Oryza sativa
  unsure (1)..(756): unsure at all n locations
nnnnnnnnnnnnnnnnnnnnnnnnnnnnnnnnnnnnnnnnnnnnnnnnnnnnnnnnnnnnnnnnnntaaaataaatggggaggaataggttttggtaaatgtctatggcccatcccatggtcctgagagagatgagttcattgattggcttcatgatctccagattgataatgactattggatgatccttggggactttaatttttatagatcggttttgaacagaaataagacaggaggaaacatgaatgatatctttattttcaatgaattcatcatttttctcagtttgcttgagatccctcttcaaggccgtgcttttacttggagtaacatgcagggtgatccccttttagagcaacttgattgggtcttcaccttctccaattggatttctagataccccaacactcaagctttggtgttagccaaaaatgtgtttgatcatgccccaattaaaattcagattgctacaatgatcccaaaatccaatatttttcgttttaaaaatttttggatttcctagcttggtttcaaggagcaggtctctaatgcttgggtggatattgggtatattcaagatcagaccaaacttatctatgccaagttcaaagagctcaaaaggtttttaaaaaaaatggagttcttttttcttctggctctctaggctaatgagaattgtaataaaggaattctttcggttgatcgtttggaagaacttctgaactggcaagagcaatattggaggcagagata

SEQ ID NO: 672 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnnatatacctgcaaacagttaagaagatccaggagacatcaataattgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttgtgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctccagcatgaaagaagtaggccgaaaggtgattgataaacaaaaacatgctctgcatcgctcaaggaagacccctgatagtaattgccccgcaacagtcaccttgtcattaagtaagcaatatgacctatgtaaaagtgtttctatgaaggcagggagtgaaatcttcaactcggtatcagatgctacacggagtgaaaagtgcaagcacccggtaccaggtnatgccatgtcttgggagatgatccaatggaaaagacacatcaagggtaaaggtgta

SEQ ID NO: 673 - DNA, 4094 bp, Oryza sativa
  unsure (1)..(4094): unsure at all n locations
gtcaaaactgaaccctcatggattatatactcccttacctgttcctagtgctccttgggaagatattagcatggattttgttttgggattacctaggacaaagagggggagggattcgatttttgttgttgttgatcgattctctaaaatggcacactttataccttgtcataaaagcgatgatgcttcccacatagcttctctatttttcagtgaaattgtgaggttgcatggcatgcccaagacgattgtttcagatcgtgacaccaagtttttgagctatttttggaagaccttatgggcaaagcttggaacaaggctgctgttttccaccacttgccaccctcaaacggatgggcaaactgaagttgtgaatagaacactctctatgctgctgcgagccttgataaagaagaacctgaaggaatgggaagagtgcttgccacacgtggaattcgcttacaacagggcagtacactctacaactaacatgtgtccatttgaagttgtatatggtttcaaaccactttctcccatcgatttgttgcctctaccattgcaggaaaggagtgacatggaagcgtccaagcgtgcaacttacgttaagaagattcatgagaagaccaaagaagcaattgagaagaggtccaagtactatgctgcatgggcaaacaagaatcgcaagaaggtgacatttgagcctggagatttggtttgggtacatcttcgcaaagaccgttcccacagaagcgcaaatccaagttgatgccacgaggagatggaccattcagagtgctgtccaagatcaatgacaatgcttacaagattgagctacctgaagattatggtgttagttcaaccttcaatgttgctgacttaacaccattctttggactagaagattcagagtcgtcgaggtcgactccttttcaagagggggaggatgatgaggacatcccaaccgtgcatgctacttcaagtaccaagcaaccatcatcaaacacaaaggatacaattcaaggtccacttacaagaagtcgtgccaagaaactacaagttcaggtgaattcattcctaactgattttaatttcagtacttctgagaatgttatactacctaagtgttctactttagttgtgcttaggaacatacaacatgaggaggatgaaagtggatcggtggattctatcactggagtacagaacggaccagtgaagcaaaacggaccaactgcagtgcaaaacggaccagttcaaagaactgctcataactctcaatttacagaagctatggaagtaaatgaggactctttggaaagcttatcaagtcagctttccaatgccaccaataccaagtactttggacttcacaccaatgagaaccaagtacgtttgtgaagactgctctgaaggccaggagtctgctgagtcagcacgttggtacaagttcatgttcaaaactgtaccaatctacaatgtttcgtggtgcatgtatacatggttcaaaacatagtgaagttaactttccaacgcaactgacggtgcatcatttggacttcccaagttggagttattgccaaattactgaacaccactccagaagaccaacagcctcgcgaacccacttcagaagccatttcgtggaggccctttcacatttttagtcttttcatttccatctcgaattcacacctatctagcagggctgttgctagtgtaaataacccctaagaccattgcaaactcagacttttgataatccaattcggaaccctttgttcagctgtgtgctaacaaaccccagagagagattctctaccccttttctcttgtgttttccttcgcggagattacagaagcggccgcgtcatcggcacccaatccgtgctcctgatcctcgagtttaggttgcgtaggttggttctttgagagtgtggttgggcgaatccttggttcaggctgccgtatagagacggtggttggctccttgtgcgtgtcgtcaggttgcactaattatcgctgcttgcagcaagttatcgcacggtctttggctagttatcaagatcaatcttacgtcgtgaagatcgggacaacaaccttatcagttgacggaagaccgaatgcatggcgacggttcacgaaaacggacggcggagattcatccatccaaaacggacggccaagatccatcggtccacaaccggaccatggcggactgcaacgatgacgtcggcgatgacgtcatcaccggcgacggctcggcctcgcgtgctcgccggcgaacgacggcgcggcggcgcaaacggaggacacctacgcgtagcggacggcacggcgaactcactggtgaccaaaacgacggcggaagatcaacggacgacgacagcgacgaggaagagcggcggcgacgatcgggtcaacggcggcgacggtgctccggcggctgacagcgacggcgaaagggcggacgaggacggcgacgcgacggcgaccacggcggtgacctccccgagcgacgacgacgactggagcgatggcggcgcactgctggagtggcggcggcgacggcggcgcgaggcggcacggcgctagagctctaccggcgacgagaggctaaggcgagggtggcggcaggtataggggagcttggggggtcaatttatagggtctagggagcggcggcgaaggcccacggcgaccggtgacgggaaggaaggtttagggttcggaggagacaaatcgatccgaatcgaactcaaatccggcgatttccaaagcgatttagacgatgtttccaaaagggaaaaggtagagtggatcacggggatcctttcccctcaatcaatttcaccggaaacggaaagggatggccggatttggaatggcggcggcggcgcagctcggctagggtttcggcgagaggaagacgacgactgacgggtgggacccacctgtcagcggcggtcgcacgcacgcgcgcgggcggctcggcttgggctgacttgggccgagggagagagagagagagagcggtttgggccggctttcggcccaaaaccaaaagggacttttaaaaacctttttccatttaaattattcatgaaatgcaattccatttattaaaaatacttccttggctcaaataaaccccagaaaaatctaggaactatagaatcaagtaaagtatttaataaaattttatctagcccacttttatattggaatttaacaaattaaaattagatcttctcttctaggcttttaagatcatttctaataattcccttttagacaacaatttataaattaaggatttttaaacaagaaaagcacttaacataattataattagatcattaatgattaaataattactgaactgttctttgtatcatttaggaattgagctctgaaaaatccgagaaaatttcagagagtataattaatcatggagaatttaataaaaattaaatccaaccatgatttatatttaggaaattttatttcccacatttaacttcacttgttaattaaagaacatttaatataaattctattaataatttattagataacttataaatcctgaaacaaaattcaggctgtgacagtttactggaaccgaagcggtgatcatggtcttggtctggttcaagatgttgacgacgtgattggcttgattgagtgcgtcttccttgaggagggtgtcgagaagagtgatcggtgcagccgcgttctgctagggggtgcgaaaaaccgccgtcccctcaacgtcttgttgcccgatgagctctcgtgctcgtcgctcggcctccaaggcacgctgtcgccggtcctcagcctcctttgcagcccgttcgcgctcctgttgctcacgctgcaatcgttctcgctcttgtgcttagcgttcctcctctagtcggcgacgttcggcttcttgtcgcacgcgctgttcttctgcttcttgggcttggcgctgttcttctgtctcgttgtcggccatgaaaatgccgaagtagagaggtgtnnnnnnnnnnnnnnnnnnnnnnnnnnnnnnnnnnnnnnnnnnnnnnnnnnnnnnnnnnnnnnnnnna

SEQ ID NO: 674 - DNA, 2314 bp, Oryza sativa
cttctgcttcttgggcttggcgctgttcttctgtctcgttgtcgcccatgaaaatgccgaagtagagaggtgtgtagttatcttcgtagccttcatcgaagtcgtcgaggttgcggtggtcgtagcggtagccgaagtcgtcgtactctacgatctctgtcggtcgagagtcgacaccgggggagctaaggtagccgtccaattgttccgtcgaaaccgtgccgagaggctggagtatgatgccgacttccctagagctagactggatcggggccgaggtcgggtcccgcctaggcctacggggagaagacgcccttatggtgaagatggcagccaagtcatcggggagtttcatcaggattggaggataggcgccatcgtcttgatcgggtcatgttggagtagattggatctcgtccgagtggtttggggccggctcggttgtgatgatcctggagtagatctcggccgacttcgggataccgaacggggcggagacctggcctctccccgactgtttcggatctgagccgaggagagaaatcttgccgaagtcgttggtgacaaagtcgaggctgccaaaccggaacgcctgcccgggagggaagacgaagtcgtcgatgccggagatgaaacccatcgcactagtcggcgaagaacttgacgctacccctacctggcacgccaactgtcgaaacgagatttcggcaatactaaaagggggtggctatcaagctggaaaagtggatgggttgagagacaaggaattttatacaggttcatgccttcttaataagaagtaataccctactcctgtccggggattgatccgccgagtatgttattgaccgtatgatctgggagaaaatcgtgcccttagaggcacccggacccctccttatataggggaggggtccgtattacaaagtacaatccatatccctaacggaataggtagttacagataagttacaatcgtaaccgactaggatcccggatatttccttgacatacaagtttgaaatttaatccgagtccctttaaaagatattctatctacagatggcaccccatacccagtcagactatatatgccgtgtgggtatggggtatccataatctctatacatacctcaagatatggagctcattgtactgaaaaaggcaatttgatattggctgtataggggcagagatttgcagtccatactgactactgaaacttaagagtgcctctagaattccgcagcaatgttgggtgagtaaattgtagggcatggctaccagaatgaagatgttgacatactgtcccagcactatttcgaacaggtccaacgccatgtcatccaatgtgtacataatactatacacatgcaaaaagagggcctaaggcaccacgggcatcttttatggaagtattctccctacatgtcacactctcagaatcgcttaatttaataattcattctttaatgcattttttagaaattattttaaaaacctacaagataaaccctaataaaaactagcaaaatcgcacataaaattgagatagatacaattttattaaatactttgcttgtttatctatttcctggatttttatgtgaattatttgagcaagggaagtatttttattaaatgaaatagcatttcacgaattattttaattaggaaaatttttaaaatcctatcctaatctgttgggcccttttccggcccaactcttcccctcgcgcgcgcgagccacgcggccctgccggcccaggccaagccgcccctccccctctctctaagccgccgacatctggggcccacatgtcggggccatcccctacctccggccagtcaagccgagcccgaccaccaccacctccccaccaaatccgccgctggtcgtcgctcccgagttcgattggatgagggaaatttatcccctcatcgtcctcttccttttcccctaagaatcggagccgaatttcgtgtagtttatccaaatcgaattcgaattcgagtttatctctccacctaaccctatagttttacggctttgattcctctcggtgtgggatcgatctcgagcttccgtgcctatgtaaatgatccccttgtcgtcctctaccattgccctgaagccacgtcctccgccgtggtccatagcacagccgccgcgtccgtcctagtggtcgccgcaagcctagccgccccacgccaccgttgtggtcgccgccgccgctcactattgtcgccaatcggttcgccgagtggagccgcacccccgccgcttcttcgtttgcggcgagacccgccggaa

SEQ ID NO: 675 - DNA, 2172 bp, Oryza sativa
  unsure (1)..(2172): unsure at all n locations
nnnnnnnnnnnnnnnnnnnnnnnnnnnnnnnnnnnnnnnnnnnnnnnnnnnnnnnttgtttatccaaatcgaattcgaattcgagtttatctctccacctaaccctatagttttacggctttgattcctctcggtgtgggatcgatctcgagcttccgtgcctatgtaaatgatccccttgtcgtcctctaccattgccctgaagccacgtcctccgccgtggtccatagcacagccgccgcgtccgtcctagtggtcgccgcaagcctagccgccccacgccaccgttgtggtcgccgccgccgctcactattgtcgccatcgggttcgccgagtggagccgcaccccgtccgctcctccgttgccgtcgagacccgccggaatcccgccgtcgacgccgcccagagccgcgccgccgttggagctcaccgccggccgccgttcgtcgtcgtccgtcgttgttctgagcaccggtgagttcacctcgtcgtcctctccacgatggtgcccttggatagcccggccgagccctgtagcaccggtgatctcgtggtcccgtgcagtgccgacgatgacgtcatgctgacgtaagaaaagcccttttccttcttcaaaataaatctttattgcgtcgtaaatcataatagttttctgtattaggttaaaagcatattaatcttacaaaattcataactaaatcatcgtaacttggaatgttttcttttactgggaaaactaccagagcattgtctagtagtatattttcattacatagagcaaatatgtacaaaagttacagggaaacacaaaagattacaaagtttgtaaccagtcaaaaactaattgctttaaaggatccttcattctgcagatatactgaagaattttgttcttgaaatggtttctccatgattgaaaaggaggggaaatattctgaaaaataaacccatttctctgcttccagatgtgccaagaggcaataaagaaaatttccaagaaaccctttctggcaaaattcagccttactaagacattcatttgaaagaactcatgtgttgattccatgtgattcccagatgttaccaacatcttacactgaacgggcaggtgaagaagagatgtagcctggtttctctgtgtcccccacaaccaacgcaacataaatcttagagtacgttttaagtttcctactttcatcatcttttaatgttgtgaagttaaagtgatccagaggccatacgaattttatatgattgatctaagcaataaatccagggtttacgcacaacaattactaacctgtcccaaatctacccgttctataccatatcggtacaattttgaaatatcatgatagaggagttcaaaacgccaccaatattatttatggtacagaaatataatgatgaagtgttcaacctctcatatctatcaaattttaaattttatcaacccattttcaaaacatacatgttagcgggttctaacccggaatttcacaaattcgtactagtacgtaggaggagttcgcaaatggattttaaaacctttcgcaaatggattttaaaacctttcaaaacacgttagtactggtttgtaatgattaataaatgttttggtactagtttgtactacaacttttagaaattaaataaaaatctgaaaaaagtatgggagagacagctcttcatgaaattaacaatgggacagaattttacctctgcattgcactggccattacagattgagggttatctattaacatttattgagtattgaatacaccacggttattcaccatttacaaattattaggagcaaacttttattaccaggaccgagttaaggataagtaattccattatttgctgtaatttagtcaacacataattattttttagaaaaagacatacaatattgtcgcaaaccaatcttgatgacccatgcattttctactttaaattcacttaacctggagacaaacttctgcttagctgctagtggtgttgctgctgttcccaccacccctaagctgccactcagtgatgtagctcggcttggtgaccaccttagccacatcgacatctccagtcagcattgccacaaccttcgacattggcggtcgctggtgcggtgagccctgagtgggggatcctctagagtcgacctgc

SEQ ID NO: 676 - DNA, 461 bp, Oryza sativa
ccaatttgcttacttgatgtatcattgccctgtttgatttcttggcttagtcaatgaggactgaaagttttttaacaacttttgcgggttttaggctcaacaaggtttgacaaaaacttttaagaaataggaactaagttaagatatcaagcacagcataaattcatcagtattgtacaaattgtgcctccatcatcattaattatcaacatcattggtacattaatcagtatcagtcttttcatcatcagaattatcaggaccagtcggtcgaagatcggtgtcctgaaatctctcaactacatcagctgctatcttatcagcagatttttgtgcatcgctgatgaggtcaagagcagctccttcgctcgtcccgtctgcaaagccatcaatggcatcaacgtcaaccctcggataaagagatttggtcatcgccaacgccagacttgctctcatacttc

SEQ ID NO: 677 - DNA, 720 bp, Oryza sativa
  unsure (1)..(720): unsure at all n locations
nnnnnnnnnnnnnnnnnnnnnnnnnnnnnnnnnnnnnnnnnnaatattcatttagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgatgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattattattgttattatttccttgttcaccctagaataaacaaaaccccaactagtggacactctactcatggtaccactagtatgattttaggtagatgcttcgctgattaattacgcaacattaggtggttttataactctagactttgggaatattctcaccacctggacactatggaatggttggattattgtggaaatggattcacaccttcccctctattcaaaacactcaaaatggttttaggttgggcttcgggtgcatggttttgatagtagcacct

SEQ ID NO: 678 - DNA, 18678 bp, Oryza sativa
  unsure (1)..(18678): unsure at all n locations
catctttaggagtcgaatcaaaaagacagagaaaagcttatgtgagacaaataaatcatgtgggcacaagttatcagtcaattccaccagcttactcaaacacagttatctcgtttggcccggaggatgctgaaggcatacttttcccccatcaagacccgttagtaatatcagtggaaataacacagtgcgaagtgcaaagggtgttggtcgatggaggaagttcggcagatgtacttttctacgatgcatttaagaaaatgcaaattccagaagacagactaactcatgcaggaattcctttacaaggatttggtggtcagcaggtacatgcaatcggaaagatatcattacaagtggtgtttggaggaggagaaaataagagaagagaagaagtcgtgtttgatgtggtagacatgccatatcaatacaacgccattttgggaagatcaacaatcaacatttttgaagcaatcatacaccacaattacatctgtatgaagcttccggggccgaaaggggtcatctccgttcgaggtggtcaattagcagcaagaaaatttgagcttcaaggaactccaaatatgaaaggtgtacatattgttgaacaaaaacaaggagagtacaacaagaaccaaaagccagtaccagaagggaaaacaaagaaagtagtgttggacaaaaatgaacttgaaaaatacatcttgataggagaaaatttggagaaagaagttgaagaagaaatcttaaaagtggtaaaagccaacacggatgttttcgcatggtcaccggaagaacttgaaggagttgagagaagtctaattgaacacaatttagcaatcaagccagaacacaagcctaagaagcagaagttaagaaggatatcgatagataggcagcaagcagcaaaggcagaactagagaaattgttgaaggctaaagtcattcgagaggttatgcacctcgagtggctagcaaacccagttttggtgaaaaaaaagcaaatgggaagtggagaatgtgtattgacttcacagatctaaacaaggcatgtccaaaggacgattttccactcccaagaatagatcagttagtggatgccaccgctggttgtaagctaatgagttttcttgatgcttactctgggtatcaccaggtattcatggtaaaagaagatgaagaaaaaacatcattcataacaccttttggaacatactgctacataagaatgccatttggtctgaaaaatgcgggtgccacatttgcaagattgatatgcaaggttctggcaaatcaacttggccgaaacgtagaagcatatgttgatgacattgtggtgaaaagtaagaaagcttttacacatggaaaagacttacaagaaacgtttgagaacttgaggaagttttcagtgaagttgaatcctgaaaagtgcgtgtttggtgtcagagctggaaagttacttgggtttttagtatccaaaagaggaattgtgcaaaataggaatggagccacccaaaaatacaagagaaatgcaaagattaacagggagaatggcctcgcttagtagatttctttccaaatcagcagaaagaggtttaccctttttcaagacattaagaggggtaaacaactttgaatggaacgaagaatgccaaaaagattttgacgatctcaaagattaccttcataacatgccaactttgtcaagtccacaaaaaggagaacctttgttgctatatgtagctgccacactggtgacagtaagcgcagtcttagtacaagaacagggtaacaagcaaatgccagtttattttatgtccgaagcattgcaaggaccaaaaacaaggtatacagaagtggaaaagatgatatattctattgtgatggcatcaagaaaattgagacattatttcttatctcacgacataacagtaccatcaacttatccaataggagaggtgttgtcgaacaaggaaatagcaggaagaattgccaaatgggctatggaacttttgccttttgacttgaaatacacatcaagaacagcgataaagtcacaagtgttggcaaaatttgtggcagaatggaccccagcagagttagagaaaaagaaagaagaagaaaagccgtccaagctgagataagatcattgtgctccaaaaattccttttcaagctccggagtgatgaggctaggagcaatttcatttccaagctgatgaagagacgagcgatacttaaggtcatcaagacacaacttagaacctcgactgctagtctccccatccgcgcaaaaatcaggcaaacccatcaaccaagtgccatttttcgaacatcgctcgctgaaaccaccaagtatatcttttatcaactcgggagaaggggtcattctgtggcttgatcttcaactatgttttttctggattggaaattcagattaacaacttcaggaacgttctctgtttgaacaggattgacagggttcatgtccacatcaatagcatcaatgcaaataggttcctcaacctctttggcagcagaagtaagaacgttcaagggagcagagaggtaatcagctgcagctgaaagagaattaacgttcgaaacattcccaatctcaactgaacttatctcactgatagcaggtagctcataagacagaatgttttcatcctcatcatcactatccagagcaattcgaacttttttcaagttcgagtcaacaggagaacttgaaggcatctttttacgcttcaaagcaggactcgagttttcttgcacaaaaggagcagtgtgagtatgttcgctcgactcagaggagccgctgtcatcagacgattcatcacttgaatcagactccccatccaagctattctcctcattatcagaagatgaagatgcagcatcttttggattgatattcgagtttttcttctttttcttcttcaaatcaggatgaactcgaaccatcatatcttggccgagggcacttagaatcctgttttgttttctaccttgctgaaccgcaagatatgtgccatgctctttcttggtataagggccaatatatttcttgcttggcccatccacgtccttcacaatttttgctgcaaaaaaaagaaaaaaagagaagaaaaaaagaagaaaaaaatgaattacatatatatatatatatataatgcttgaaataaaaaatacatatacaaggtaaacacttactattcgcagatatctcgaaaggaggaagcaaagaactagaaccctcaggaatttcaccaagagataaagtccagttggcagaaagaggtcgaataccaagataaatgaactcctcgaccaagtctcgaacactaaatttagagacaagttcttcaattcgagggcgaatgtcagcaaagtcttttgacaaagtaacagctggatctgagatgacactcaaagatttacaagaaaacacaaaagggcatttttccatggttttcagatctgctggaatcttatgatagaaccattttgactgccaatgagttccccatttggtccacataacagagacaactggccaaggacaaccgcgatttaagcgtggcataaagttaacacacccaaattgggagttttgccttgtatagcgccgaatggtgtgaaaataagcaaaatcgcatccatgcggagtaccaccgcaactccgaataatccattcaaaaattccaagcttaacaagggtgtttggtgtaagctgagaaaactcaagtccatatagcctaaggacctcaacaagaaatgcactgcaaggaaacctgaagccagcttcaaaaaaatcatcaaacaccaaggtgtagccggcccgaggtgaaggactcaactgtcacgcccataaatttagcccaaatttccagactattttgtgtattaaatccctgtccaggaccagccagggtacacaaaacgacaagtaataaacagttccaaacgtaaataaagcgaaaattacttacagaagaggcacttagtcctcacaccgaaacaaaaacagcagcagcgaaaaaggcaatcctagcggggcttcagctttactccaaaggcaaaactcaactggggtctgagccttggtcttctaatttcatcttcagctcagaagcactacacttctgaaaagggggaataatagcaaggctgagtacaaccaccgtactcagcaagccacaccaacgatgcagatgtgcaaggggaacacaaggactgtttatggctatttgcataaaggcggttgtaaagcattttattgaacaaaacagtaaaacagttgagtaattaaagtaacattaaatctccactgatcaacgctacaccacgttgaacaggcccaaccaacccacctgaactacagtgcattgggtcgatttattaagtgtgagactaatcacggtgaatttggtcaaccgcccataaccacggtcacggctattcgaatagttttactctgatcagaggtgtacaactgtacccacaagacacagccccacgacacgtttccgtgcgccgacatgccaccacgacataccagaaagaggccgtgacaggacccttcgcataaccccctctagccaagcacaccacacctcaggtttcacccccgtccccagcaggcaacgggcagtcccctctcgtgcctaggtgaatccggaagcgacagaggccgtcgcagggcccgccctgctccatcacgcccacccttgcctggatgcgtcaactagaagaaagctacactacaggcctagccgttgcccacgctagcttatggtaagtacgagaaattcttccaggatttcccgcgaaccggtccttaattgccatgggtacgactagcaaaaccatgcacccatagcccaccattcagttacattttagttggataattacgaccactgaaacatggccaggtgtctcgagcatgcaactcgttctgttgctaaaaaggtctaatactgcaattatcccatcaactgagcaagtggtaattaagcatggctaagcatatagttctagctaggtcacataagtaacataagctagtcgatttattatccaatattgacaaaggacagatataaagtaaacatggcacaagcaaacagataggtaaaaccctgatcccatgtaattagcaaaacatgcatgtttatttgcaaacggtaaaaaatttataaattgggatcaacatgctcaaggggaatgtgtgacttgccttgcttcttcacaacaatcttctgaactctgatccttgcgactgcgaacttccgaaacaacagaatctactcgctggcacacaaaacgagaaaaaaaactaataaacaccaagaaaacagtatataaaaagtaaacaaacatgtagagctcaattttagatgaattttgcaagttgaatggctcaattcggagttcgaatgaattagatatgaattttagaagttttgagccattttaatgaatttctataattaataccaatttatcgagcaattattaaatatttttccaaaggaaatgataagcgctgacggcagcaaggggaagggtgccgacaagcgggccccacacgtcagcgagactaggggagggcgcacggtggacacggtccaccgcggcaggggcggcaccgtggaccgagaccacgggtgtggtccacgagcgcgaccctcatcgacaaaaggggaggctggctcgccggccaacccaacaaggcggcggcggcacacgctggacgaccggcgacggcggcacgacgcgggcaaggggacggcggaggagggggaaaaggaggggaaacagagggagagctcaccgagcgccatggcggcgaggggcaacgggcggcggcgatgccttctcgagaagacggcgggggcggcctcgggcaacgaccagtggtgcggaaaggatggccgaggcgcgggacgacctagggagggtggtagagaggttaggatggggacaagtggcccgagacggtgtgaatcgccggccggaggaggaggtgagaggtggagcttaccggcgcgcgaggaggacggagctccggtgggttcccgacgacgagaagcgaacgccggacctcccctcgtcgctgcgaagctgatggaggaaggtgcgacggccggggatgtctcggagtggcggcaagcggcagctggaggtggcaaatggcagtggcgtctcgggttcacggtgggagcagtgcttcgggggtgaaggagggagatggagtggatgccgagctgcgcacgatggctgcggtgctggggaaggcgacggcgcagcgcgaggtggaccagagaggcgatgcggcgcggctggaggcggcaatggtgacggagagagatggtgaacgtggcggcggcgtttcgtaggcggataggggaaaaagagtaggggccggggtagagctcggcacagcgatgccgatgacggtggtggcgcggcgcggcggcccctagggcggcagtagcgggcggctggaggcggtgagtggcggtagtggcttggcctcgcggtgggaaggtggttccggcggtggaggaggaaaatgaagtggatgccgaggtgcggcatagcgcggcgaagccggtgggaccaacggcggcgtgcggccgtggctttagcggcggtggagggcgactggagggtcgccggcgagcggcggcgcgcgggagcgacgcggggagagcgagggaggcgatgggaagctcgggggaggagggaaaacgaacgaggggagcacggggagggtttatataggctcgggagggtgagatggagccggggtgagttggatttgggcggcaatggccgatggatggaggtggcggcgacgtggggaagtggcggccggattttgcgggagaggtgggggaatgaggaggacgtggggcggcagagtcccacggccgggtgcgggcgtgcggagtggaggaggtgggcggattcggcggcaatcgtgggcggcaacggcagccatggcggttggccggaggtaggaggaagagctgacaggtggggtctcgggtcccacctgtcggccagagggagagagaggaggtcggttgggggacgcaaaaaaaacttcgagagggaggcgatctgggccggaggcccgaggggagaagggacggggcggccggccttagagagagggagggcgcccaggccgcggggaggcaaagcagacttgggccgaaaccggcccaagggaaagaaggggaatttaaattggttttctttttattttaattgattaaatgaactttgtattgataatgttacttgggctccgaaaattcgcgggaaatttcagagagtattttagggcacaagaatattacaaaatattcccggccaatgatttttaaggggaaattttaattctcccattattttacttgattaaattgatttaacttatatttaatttctaaaaaatacattatttaataatttttaatcccgatcgaaaatcagggcgttacatcaactcaccagcaggacgaatgactagattgagactagcaatggcaccttttgaaacaagtttattgagccgcttttcagagataatcgatggaccaagaccggaagatgttttcttcgctttctgttttgaggccggttttttggatttccccatggtcgctgagaagactcgaatcagaaactctcgaagcagaaaactcgaaaggcgtgtctatacggaagtgtttgagagaggagagtattcgagacaaacgagacaaagacgggcgcaacaatgggccaggaaagcgacccccgggcgcttatatagctgttttgcgtgtgcgtgttttcgtggggcccacctatcaataattaggcatgaaaaccgaagtggccccatcccctactcgcgtagtatgtccggataagcaccgccgacgacgcacgattttccttcgtgcttatcggtgcccttgtctgagtcgtctcgtccatgaacgtaagcatttgacacgtggtttactagtaaaaaaattaattaaaaattaattacaaaaaattaataaataaaaaataataataaataattaagaaagaagataatacaaaaactcacatgtgctttcgcccaaaacagggggacgacagtttatcccttacatatttctgaccacggtttcggccgaaaacatcccgcccttatccgtgaggggcttgttgtagcaagtggtaaactttgcccccccccaaaaaaaaaggcaaaaacacatttcgcccaaaaagtctacttaaagataaaatactcagagagtttcccctaaaatataaaaactcgaatgaagttctcctctttatagaaaagttcttttaggacatgttttacccaaaggaaacagcgttacgaggaaaagtacattcgagttaatgtcaagtagacagatgtattcgagccaacatcatccacctgacattatttttcctaatagttgtatccgagcaggtttctagggagtgacaaggcgccaagataatgggaaagtatattcgagttttctggtgcggccaagacagctgaaataacaagaaaagaaggaaaagtcttatcgagtagttgactcattcgaggaaaataaccgtggggaccacttcgactactctaaccagctggcaccagatgtcgcctagggaccaccagcaaagtactattatacccctagggcctatggatcactaagagtaatacggtaactttatgtaagcccatgatggcaaagatgtaaatatttgtggtgatggtcgaacactatgaaaggccgaccagagtcctacagcaagaatacaatgaaatagagaaaaagtaccttatatgcatcctgacatctactcttaggctcactctcaagggtaaacaggaatctacactttctcgtttacacccaactctgttggtgccatgaggtcgtgacaatctcggatgcgagtaagccttgtacatctctggaaaggactccgacatggacctgaagtgattccacagttgcttttcactcatctgcttcttgtcccgtgactcaaccctgatgcagttcagaacatggcataggtagaagacctcctcagggctaagttggaaccagtgcttctgtgccgcagcaatttcgacggcgtggccaaaggcagcacggtttaggatcacggcttgttttggctcaactccaagaatggcaccgccacctggacctgacaaaattgccacaggctttgagcttatgaatgaggcattgagctcagcaacaatgactgacatgggattagctgctgctagtgctaagaagtccttgccatctttgcccttcttccatcttggacctgacaaatccatatgctgaacacactcgcagaggatggactaaaattgatgcgtggtcaaatgctgtagtgaatagcaacgacaataaagcaataagtaaacaaagttgtccaaacaaatacctcaacaaatggagattcactacatacatcactaatttatcgaacatgttaatttgtaaagcatagatacataaataatctgccaaaatacccctgatacggccctacctctcatactctctccactctctcctactcttccccgtacataagactttgccttgagcatctgccgagtgtgtgatactagtacgttgtacggtggactttaagctcgccccctcgtgcttggttaacaacatcacaagattgctccatgtgctaattaaagacggttcccgctcaccgctgatttctttcttctcttcttgggttcttgatttctcgtgaacagaatcatagctttccgcaatcgtaatcagccatggcgatcatagtttttgccagcaatcctgacaagaacttctccctgaggaacttgatcaccgggttggtgctctgctggatgaagccgacgacgtaggccgccgtgatcagccggatgccgcgccaccgcctctcctcggcgtacttctccagcgccgccttgacggcctcgtaccccgggtcgtgctcggcgccgtcggcgaagaaggccctcgctgaggcaccgggcgaggacgacgccgtcctcgagcgccgcgcagccgccctggccgagctcgggggtcgtcgggtggaaggcgtcgccgcgacgcagacgttgcccctgctgatgctgccgcggacgagcgcgagcggcgaccggaacctcagcggcgacgacaccacgtcgctcatctcgctccgctcgatcacgtccagcgcctccgccgggatcctcgccgccctcagcttcgccaccacgtagctccgcatcttggccacgctctcctccgcgtcgccgtctgcacaccacacgtgacagattgatcagcgaattaatccgccattgttgctgctcgtcaaggggaagtaactagcaatggtccgcaccatccggggaggggtaccaggtgtagttccagtagacggaggtgtcggaacaggggagcacgccggagcggaagccctggccgatgaactgcaggatctccgggccgaatccgtggccggccgggtactcagcgaggcccctggtggccgagcgccctgagaggatcggctttggcaggccaagccacttcgccaccaccgagttcacgccgtcgcagcctatcagcaccttcagaaaaagcacagtaatgcatcaggccatggctgctcttagtgagaagaagagaggtacaagtgatgatgaacaatcaaggttgcatctagccattgttgatctcacacacctttgctcttatcgttgagccatcggacaaatgtaggagcttgacattgccgtcttcctcaatcgagacgatcttggaagagaacctgatggtgccttccggcagttcgttctccagagtctccagtaggaagttgcgcttcacgcaccgaatctcatgcggtccactgacgaagtaacgacacaacgacgatttcagttttcaggtgtttactcgtataagtatgattttgttacaaaattttaacattcaggtctcagctagcggtagttgcagacactgtaccttttcccttgcatctttagactcaacttcgcggcaggctctcccgtggatgcagagaaggccaacagcctgccaacaagcacgacaagtcacaacttcagtcgatcacaaactctttagtcttaagagttacagattactcctgcaacttcagtaggttaatcgaagggtaaactcaaaagatgggctggaaggagcaagagacagtgtaagcacacaagttcagagctcagacacggagtgggattgtggaaaaagcccaaaacttataaggtctagtacatcagaccaggcactggcagactgacccagcatatggacctaaaatcaggttcatcagtacggcccaggatggcctatcaaacgagctgggctgtaaatttgatttcgcttaaacgagaattattatactcgcgttaggatttgttgtgatttcgtgacggtcaacggactccactgttcgtctgttccactgtctctgtctggctattatctggatctacaactagaagggaagggattggtaaagcaagtggctgctcacctctcgtagagcagatgatgctccctgatcttgtcgccgacaccaagggcgtcgagcgcgcggaaggcgttcgtccatgtcgtgaacgcgaacccggacgcccgcagcgtcgccgacgactccagcaccaggctcctcacccctttcctgcacacgggacgcaccgccggcccagctcgatcatcagctccagatcgatccgcgcgcgcgcgcgcaaacgcggagcagatcaaggcgaaacggtcggcacagaggcttacctgtgtaacccgagcgccgtcgcgagccccgcgaggccggcgccggcgatgacgatgccctcgacgcccgagccctccattgttcgcgaacccccacccgcggttggtgtcgctcgcaagtggaaacagagtgaggatggtcgaaggctgtactgctgctgaaccagttcagggttttctatgatgcgccttcattttgtagcaaaacggtcgaggggtggttggattggacggagaagaccggattccaacgaggcggcgcgtccatccgtcatgccagcggtgaaacaaactggaacatggcggctttcacgaattcttgtatgactagtacacatcgaaatattggtcaattggtccatgttagtcctctcgatcgatttggtaacgttgcgcgcaagtctgattacagaggatccagcattcccgggttcaatgattggcacaaaggaactgtcagggctgtttcgtactagaatcgtagtacgagtacagccacgagggcggcttgtgaataaacccaaaaagaattgttgaggcagcaggtatgctcgcaagcagtgcccattcccctccgggttgacacgggaattttcgatatccgaccaaaaacccaaatgcactcgactttatttttctgcacacaaaaaggagcgtttcacaggtttgggatcattgacacgtgacggaacagtaaaacagacggagcacatacagacaaacatcacaaacagcacgacgatatgattacaggttgcagacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactcttctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtcctccttgcagccgatcgagtgttcgacacttggatcttggcagctcaggtgactgaccatctggggaaggagaccacgtgaagaaccagtagacgtcggtgtcgttgcagggcaccatgcctgcacggaatccctggccgaccaactgcagaaacctgggctcgaagccatggccgtccgggtacttggcgcgtccgcgcgtggccgtgtgccccgagtccgacggcttcgcgagccccagccatctcgccaccaccgagttgatcccgtcgcacccgatcagcacctgcatccatcgccaccatctcctcctcagcaaccgatcgatcgacagagacagcacgcacgccatgtgtttttacctttgctctgagagtcgatccgtcagacagatgggggatcttggcgttgccgtcttcctcgatcgagacgatcttgnaggagtagcggatggtgcctcttggaagctcttcctccaacgccagtagcagcgcggtgcggctcacgcagcgtgcctcatgggttcccctgcgtcacaggtgttttcaggtgtgcgcatcacacgacaggggggaaggggagtagacagatatatcttctcagttctcaccgtttgccttgcgccctcagatcaatttcttgcactatttctccagtagctgaagacatgacattcaacctaagaacaaacatggagagaaaaaatcaggcttatccgtactgtacaccgtatgatacagacatacagtaacagttacagttagtgtgtgtttagttcacgctaaaattagaaatttggttgaaattgaaacgatgtgacggaaaagttggaagtttgtgtgtatgaaaattttgatgtgatggaaaaattagaagttcgaagaaaacgtttgtaactaaacgaggccttaggagttaggacttctactttaggacctcggtcaccctgctgagtcaacccaaggcctcagggcaagtactatgagccccttatcactaatttcaagaagtcatgtagacttatatgatgatgtggagagaagagaagagagaggggagcagccacctctcatgcaaggggcaacctccacaccaatttcaagaaatgagagaaaaagagataagttgattggttgggtgtagtgtaagtagatgcaatctattgtatgtattacatctaaattaatgtgtagatgatttagacaaaattagatgtgaccactatctctatcataaaacttgccctcacacattcagataatgataaagtggcaggagaaaaaagttagtactactgtactctgacctggaggtcaagatctcagtgactcagagtctcctactgcctctgaatctgttacatacctctggatctgctggtgctggctcctcatcttgtcgcctaccccaagggcatcaagcgcgcggaaggcgttcgtccatgtgatgaacgccaacccggacgtccgcagcgtcggcgacgactccagcaccacgctcctcagtcctttcctgcacgcagtgccgcacttcgatcggctcccatggagttggaacacgtcgctaggcactcagaagcaaaaaaggttgtgtacctgtgcagtccgagggccactgcgagcccggcgaggccggcgccggcgatgacgatctcccggccgtctgcctgttcttgctgcatgcttgcaactggctttgtgcgaatgcaaactgacttggctgcaggaaagagatgagaataaatgctgtgagcaaatcgagtgagcgccaggagtttaaatatgattgctgcgacggcgagggtgagtgagcagcaggccagcagtgaaggcactttgacgtcatcgctgatgatgatgcgccactacggtccggtgagagtggacagacgtcgaacgggacgtgccttctcattgttttacaatatcttggacacattttttgcggcaagatagcagcctccagggaaaaagtaaatgggaatataaaacgttatggcattggttaaagtcaaactatttaagtttaattaagtttaaagataaatatggtaaaattttcaaccaaagataataaattatgaaaatatatttaattattgattcaatgaaactaatctaatattataaatattactatatttgcctataaatttagttaagcttaaaatagtttgactttgaccaaagtcaaaacgtcttataactataggaggagtagtaaccactgccgccacggatgcaccttcatcaaggttttacttgacaaaatgacaatggtctcatccagcacagacccagggtatggtgatcatttttatgtcctcaaacttgctgatagtgaaagttttagagcctcatgggtaagccatatgtttaggctgatcaaccaaagcctttttccaattcaagcaaatcaatttcattggttaacttatttagttgaatggcttaatgagtgatcctatgtggttggtggttgtagccagtggtggatccagaaaaaaatagcagtggggtctgagcaaactagataagttacagtcccccctcccatctacatatggtaaaaaaaatgtagtgggtctttgtggggtctttcatagtctttacgtcagtagtggaggctcgagaccccgccgctctcatgctggatccgcccctggttgtagctacagttgtagcattggcactagagagttcataggattagctaccaccaacgatcctactctcctgttggccccgctatatttggcaaataaacctcatcccaatcatcaagtcgtatgggcttcgggattgagatcacatgcagccatagctaggactgcaagttagtgactccatggtatctcatccattctttttcagatcaaaagtgcaaatcaagtgctacagcccgttactatagcggttgcattgcaccgttacgatgggatttggttcatgtgcaatccctgtgactacaacttaagcagtcatactattgttcctactatggtcaactgagactttttaattcttccatttttgcgctcaacaccttatccctactagtgtcctagaaatatagattcccatccttatccacaaaatttagacctaaacccatacatgttttgaggcagcttttatcacaaaatccaattccatcatttgttcagacacatgggtacaaaatccatttcgtaatcttattaacttgggtacaaaactgagttcccacgttttagagcttgccacagtcatagtccgccattttcagaagccttccggcgagcactccggccaaccacttgtcccgcagaaagctgatgaccgcattgttactctgctgcacgatgccgacgacgtaggctgtcccgacgagctcgacgctcctccaccgccggattctagcgtactcacgtagactcgcctcgatcctctcgctctcggcggcgccgccgccgccgagaagggcgtcgccgaggcatctcgccagcacgacgccgtcctcgagcgccgcgcagccgccctggccaaggtcaggcgtcatcgggtgcagcgcgtcaccggcgacgcacgcgttccccttgctgatgctcgcgagcaggagcgacagcgggggccggaaacgcagcggcgacgcgaccacgtcgtttatgttgctcctctcgacgacctcgagcacctcggttgggatcttggagctcctcagcttggtcagcacgaactgcttcatcttttccgcgctctcctcgacgccattactttctggaacggcaactaaacaccgatcaatcactgatcacctgtcagatcaccattgttgacatagttgacacttgatagtgacgagactgaccgtgttcggaaggagaccaggtgaagaaccagtaggcatcagtctcgttgcaggggatcacgccagcacggaagccatggccgacgaacatcttgaaccttgggtccaatccatggccatcagggtaatgcgcgaggcctctcgtcgccaagcgccccgaggacgacggctttgtgagccccagccattttgccacaacggaattcaccccgtcgcagccgatcagcacctgcacccccgtcattaatttcagtggcatttgctctatgaatgaaacacagtttctagggaattactctgttttttttcctacctttgctctgagaattgcggcgtcggcaaggtgtatgatcttggcgttgccatcctcttcgattgcaacgatcttggaggagtaacggatggtgccttttggtagctcttcctctagtgctcggagcagccagtcccgcctgacgcagcgcagttcattgggtcctctgcatccaagcgaaggatccaaaatttcggtacggttcaatacaagaacgtgtggcccgtggaagcaaaacgacatgcaagtatggcctagagtgtaaggtgaatagtcatcagtagagatcagtgggagagaacatgacatcttaccgtttcccctgcaccgtgagatccgctcttcgtgttatctctcccgtagacgaagagaagacatgcaacctgtgaacaattcagaccaagaatcagtcactattttacattttcaccacacctacaagtgttcctctctttttctacatactcctgaagatgcagatgaagcttcctgatcttgtcgcccaccccaaggttgtcaagcgcttgccacgcgttcgtccacgtcgcgaaggcgaaccccgacgcccggagctccggcgacgactccagcaccgagcacttcacccctttcctgcacgcggagcagatcatcatctcgagttaacctgcggcagccaacacacagagcaatacgcatcaccggctcaccggtggctcctctcacctgtgcagcccgagagccacggcgaggccggcgatcccggcgcccacgacgacgacggcttcctcgccggcttccttttgttgcatgcttgatcgatgctagattctcagtagtcagtactccccctgagtactcttaatcaattgggaggccagtgtttaattaagaccaaacactaactgagtaaagcttctttgctcactgaaatctagtgctgctcgtggccgcatatatagataggctagcaagtgtttgggacctgggagactgggagtgatcggcactggacttactgaagcagatgcgacgaaaaagaagtcaggttggtggattcgaccttgtacacgaacatgcggaaattggattagcgagggcagtcagagtcgtgacggaaatgggaattttgtacgggccaaactgttggctagtgtgtttggatgtggaccatattttcttcctttttttttaatggaataagatcactttgactacctcaactgacctggatttttcacattttgg

SEQ ID NO: 679 - DNA, 1031 bp, Oryza sativa
tggcgccgtcctcctgccaccgtggcgcacgcgaaccgacgtggcaggaggaggctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtttgaaaatatctagcataccacttagtctactttgcaccttcactaaaattagaccataactcctttagtaaaaccctttgatcagcatgttaaacataatgcactctaccactatatgaaattacttaatctaattcaaaatataaccatatgaaatgacatatataagttaaacagtacgtagagatgcaattttttatttttatttcatttttttgatatttttttcacacttaggagaacataggaaccaactgtataaaaaataaactcaaacagacaaaatatgtgacatgtagaattttccaaaactctaccgaaacggacaaaatatgccatctattaaaataggcataactttctcatacggactcggaatcaggcaaataatatatgcacggacatctatagaaaaagttacatccgattctcccccgctttgccgggttcgacgatattaaaacctccaaattccgcttgcaagattgtgttttcgaggaaagaagtttttcggtggagctttggaaaattccacatgccacatatttcgtccgtttgagtttattttttacatggttggttcctgtgagttcctaagtgtgaaaaaaatatcaacaaaataaaataaaaataaaaaagttgcacatctctctcctctgcactagttcggaaagagaggagaggagaggaaaaattatacatgtcacatattacgtccatttaagttcaatttttctatggttggttcttgtgtgtccctaagcgtgaaaaaaatatcaaacaaataaaaca

SEQ ID NO: 680 - DNA, 7428 bp, Oryza sativa
  unsure (1)..(7428): unsure at all n locations
nnnnnnnnnnnnnnnnnnnnnnnnnnnnnnnnnnaatttttttgtgtgaatgacaaatggccccgcatatatattttttattttagtgccacataagcgccacgtcaatgccacgtggaataaagatcaggtcaacactgccacgtgcgcgccacgtcagcaaaaccgccctcgaaaaccactcaaggagtcaaattgcaccggttttgcaagttcggggtgaagatttatggtattacgattgagagatacgatttagattcggtggtcaattgacggagtcaaagtgatcttattccttttttttattggagtaggccagcacaggcccattcgtagacagcctgggccgaagtttttggggccgataggaggagccgcgggtcccacaagtcagtgtcctgttctcggtagaatacaggagcaccgggagcgtcgcggctgtgaccgcgaaaaggaccgtgagtacgtgtctccatgaaccgtaaatcgctctcgctcggaagaaaacacggaggaaagcggcaccggcaacgcgtccgggacaaagggccggcttcggcacccggcactgcagattttgatctattataagtaggtaagcgggtttatcacttttgcctctatcactagttcgctctcatgaataggacgagaaagagatgatagggaaaaaaaacgagaggagaaaaattaacgtgactgtgagaaggagggggagagatggagaagtatacggcgttgaggagtcggaccaggtccgtccaactgtccaagcgagtgcgaccacgattgagactaccggtcgtgactgaccgtggagtcaggttttctcacctgtattgatgaccttctttcatttttcatgtttttccctcaacactcaaaattttctctaatgagttaagttctactagcttcgtactccctataacaaaaaaaataatggtcaaagtacagctttaaaaatcataaaagttaatacgattcatattttatatttttgacacggaataaatatttttatgtcctattgataaaattgaataaccgtgtcttttatatttaaagcccttaacctttaatttctttctattattttatttgttatacatatcatacaattaataataccccgtatctagaatagtgtaccatgtaccatattcgtgtctgtatccgtatgggagtgtccgtataacatagctaaccctcatttgtgttttgtgccaactgtatcacaaaaatcagttccatcatttgttcatgcaacccacatgtaagtacaaacaacgatgtatttggatcgtgggattggattctaaactcttgatgagatataaattaaattatagctagttaatgtatatctataatcaaatttacttttttcgttgtaacttgtagaagttaaatttgatcttgcatgtttatggatttgtttatcacattttaatctatcatgttgatttttttttattttattttataactatttagatgacatgcaaacaacaagatgatatccctcaagagtttagaatagtttctagtttggaccgtccatattttttatggataattgctcatttggctctgttttgaagcataactaccaatcagactctacttattctaatttgctcatttgacccctttttcaaaatcaaagttaccatctaaccctactttctctatgatgttagggcttcattcaagaaaagggaaaaaaaatccatttactagtcaacctgatcaaaatacccttgatgacattcaaccatatccattcattagctcccaaccctatctctctatgttaggtgaggcagtgacgacgcacacgtagagggatggcacagtggtgccagcgtcgccggtgtggagagggagggagcggtggttgcgcatgaagaaagggagcgacgacgaaagctgcacacgaacggagcagcgataacggcgtgccaagagagggagcggtagcgcacgcctcgacaatgatgatgaggagcgatggcagctgggcccgggcgtcagagctaggactagggcgggaggattcagtaggggatgggtggcgaagctcaggctgaggcgggtggatgcgacggggaaggagtgtggagctcgggctgaggcgggtggatccagcggagaaggggcaacgatggctcgatgatgatgaggaagagcaccaaaggcaaggctcaggcggcagagttcgggctgtagcgatgggtaggcgatcaatccggtggcggctgagtatctagctacagatccggcggcaccgagacgtgcggactgcggatatggtggcggcatcgtggcagtggtggaattcagtgggtgtgggttagttgtcggcaacaacgacgatgacgccatggcaaagaggatggtggttgcattgacacgaaccttcttcctctctcccatccacaagctgtatgtattttgggtggatgttatccaaaattttgttaaattttattcatatttttctcaatctaaattaaatatgtcaaacatctatcaaatttaaagtccattttatcaaactaaagtcaaatttaacaaaaacaatttttgacaaaaatatgccaaatttgatgaaaatctgacaaatctaagtcaaacttatcacaaatcagtgaaacctacgctaagtgcattcattcatttgtatcaggggtcaccgatatggccgaaattatttgaatttttgaacaaaattttatcaaatttgaataaatagtaccaaatgagaaccaaaatttctgaaattttgttatggaattttgaaccctgccctcaaccactgatagcaaaatatttttttattagaagcagaattcataaatcaatagttggtcacttgtactaatgataatacaataatagtgtattacgagtagagagtctagagagtagagaccactgtaaaaggatcccggtacagaaggccaataaccattcacattttagagcttgccacagtcatagtccgccattttcagaagctttctcaccagcgctccggccaaccaattgtcacgcagaaagctgatgaccgcattgctgctctcctgcatgaagccgaccgcgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgctgatgctcgccagcagcagcgagagcggcggccggaaacgcagcggcgcggtgagcacgtccttcgcctcgctcctctcgatgatctcgagcacctcggctgggatctccgcgctattcagcttggtcagaacgaacttcttattcttggcgagagcatcatcatctggagcagcaaccaaacatgcgtgcaccggttaattcctggtcaccaatcgattcaccattcgtgacagtgtgtcaatgacagagactaaccgtgctcagaaggagaccaggtgaagaaccagtagacatcagtatcgttgcaggggatcacgccgagacgaaagccatggccgaagaacatcttgaacttgggatcgaagccgtggccgccagggtaacacgcgaggcctctcgtagccaagcgccccgagtaggacggctttgcgagccccagccattttgccaccacggaattgaccccgtcgcaaccgatcactacctgcatccgcgccattaacaattcaagaattctcagttcgcaatctttgggattcactgtgttttttcttcttctacctttgctcggagaattgcgccgtcggctaggtgtaggatcttggcgtcgccgtcctcttcgatttcaacgatcttggaggagtagcggatggtgccttctggtagctcttcctccagtgctcgcagtagccagtcccgcctgacgcagagcatttcgttgggtcctctgcatctaagccaacaatcatgtaagcgttgtctagagtgaacggcgtatataatcagtagagatcagtccgagcatgccatctcacggtttcccctgctcattgagagacgttgcatgtgccatctctccggtgaacgaagagaagacatgcaacctgtgatgtgaaaaattagcgtctacgatatggagatggaaatttgcctccagagaatacaacctcctttcttgcatttcacgtaacaatttaatatgatatattaatatgtgatatgtcattgtataaacatgcaggttagaattcgatctctaaaaatatttataaataaataaaaatataacttgtacgtgtaaattcacggtcatatttgtctttttacaatatgtaggagctaaatttaaacatacatatttgtgaaatagaaaataagggaatactcaaagaagtttgagaccatctagcagaacacaacacgagattaatttaaaataaaatataataattttaaattagaaaaatataaatatgtgagttcaagtatcaatacaattttgaaataactgtaatccggaataataagaaatagtgaaaacagatcaatattgaacactatacaagactaactaaaatcggaaaaaaaatgaaaacaaaattagaaatttaaaaaaaagttcaactaggaacacgatttataaataacaaaaatttggagtaaaaaataaataatattgaaaaaacattctatctataacacaacagtgacaatgatgataaaagagaacaacatgcgagccgtaaagaggaagagtggtgacggttaatgggaaattaaaaaacaatatctaactaatgattaggttcagtaggggagaggcgacgggaaggtcgtataagagtagtgttgtgctggttgacgggactattagaaagtaaaaaaagaaacctaataataataatcatgtttaatttctaaaatctcaatgacaagaacatcgggcatgccgtgaaggagtctagtgacggcatttgaggggacttccaaaaaaatatgggcttgttcagattgtagccaaaataaaccttaccaagttttggcaatgtcaaaattttggtaaagtggtaatattgctaaaattttatagcaggatttcttatgtattgatcaaatttggcaacaaactaaatataaccattttttttggcaactttaccgaaaaatggtatggttgaaaatagcatcaatagatagacaaagaagtgaaagtcggtggtgggtgtgacttttaaaacatataaaaataaaaaaacaatgatgataagatttattttaaaaatcttaaaacaacgagattattatttagcaaattttaaataaattagataattttaaatgagtgctagccgtgtgtttacgcagactaccagctagttctaatgatatgtaataattttctcgtcaaagatatatcttcatgcagtgttttaaaccaggtgcgttgtacttactcctgaagatgcagatgacacttcctgatcttgtcgcctaccccaagggcgtcaagcgcttgcaacgcattcctccacgtcgcgatggcgaaccccgacgccctgagctccggcgacgactctagcaccgtgcacttcacccctttcctgcatgcggatcaatcaagcaagcaagcagatgatatcagctcagctcaagttaacatgcagctgccaacacggcgacacatacagaaagccaacacattctcagggggctcagggggtgtttgggagagaggggctaaactctcaaaaacataagtccctctggttttgtgagaggggctaaaatataacaccccctcagtttcccacctgtgcagcccgagagccacggcgagtccggcgattccggctcccacgatgacaacggcatcctctccggctctctttcgttgcaatatagttgatgccattctactagctagtagatggtgcaggctaactgggggtcactgttttataaacaaaccaagttcacataggccgtgtctagatgttttggcaaaaaaaaaaaagtttgacgtatacggacacacatttaaagcattaaacgtaaactaataataaaacaaattacagattccgcatataaactgcgagacgaatctattaagcctaactaatccatcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagtttattttagaatagacggactctctctccatcccataaaaaaccaatataatactgaatgtaacatatattagtattacgaatttggacatatctctgtttaaatttgttgtactgaatatgtcacatttaattttagactcggtttttatgggatagaggaagtaggtgcttaggccctcgagtctgtgattaatgggcaaatcatactcactccatccaaaaaaaaggcaaaccgtggattcccgtgctaacgtttgactgtctgtcttatatgaaatttttttataattagtattttcattgttgttagatgataaaatatgattaatactttatgcgtgacttatctttttaatttttttcataattttttcaaataagatgaacggtcaaatattggacacggaaacaagggtttgtctttttttaaggcggagggagtatgccatacctagcttgacaattgatacccctgacactgattgaagcattgtgtggctgctgtactctagaaaattgatattttgccattatcgaaacggttcgctggagtgccacttacaaaagtggtctcgttaaaatgccacctttgaacagggataacatgttgcaatgccatttcatccatttcttcttagtttaatgatttttgtaatattttttcttgctgagatgaccaaaataccttgatcctatctcatgtctcctccatctcttcctactctccgttgcagatggtgggcggcttggtggtgccgctggggatggggacggc

SEQ ID NO: 681 - DNA, 13850 bp, Oryza sativa
  unsure (1)..(13850): unsure at all n locations
nnnnnnnnnnnnnnnnnnnnnnnnnnnnnnnnnnnnnnnnnnnnnnnnnnnnnnnnnnnntgaggtaaccactgaggaaattggtcgccaagatgtggtccaagaggttgccgaaccgcctgctgctgtcaccgtccccatgcccagccgagccgccgccgccatccccgtccccagccgcgccggcgccacccaccattggcaatggagaggagtaagagatatatagggagagatgagataggatccaatgctattttggtcactcagcaataaaaaaacattaaaaaatcattaatttgagaagaaatggatgaaatgacattgtaatatgttgctcctgtttgagggtggttttttaacgaaaccacttttgaaagtggcattccagcgaaatccagtttttgaccatggtaaaatatcaattttctcgctgtactcgctgtcccctgctgtaaggtctcaaatgacgcttcctagaatttcccatgttctctccgtctcaacgtgtggaattgaagtactagtataacggaattgagatattacggctgcctcgaaccacaaagcatctaggagtatatgttaagacagagagaacacatgaatatattttagacggagataacgcatgataaagtagaggagagaacacgataaagatatgacaaagatgtcctttatcttcttatttatttgttctcgtaattaatgaactttctgagtctcttttagatgcaggcaatcaggttatattaaagggataacgacgacaggaggtacaattcttcattctctgatgtatgcaaataacctaatcactgtgggtcaggcaaatgatggagaagctactagaatttttcaaactgttcaaacttgttgtgctcaatctgttcaaactcctaactgggggaattttctattttctttagctcaagcactcctaatcaacaaaaacatcaaattctcaatatttttcatgtccctctgatagaaaattccactaaacatcttggtcaccctttgattattaacacaagaactagagcttctgcttataagtttattatttccaaattcaaagctcgtcttacctctcttaaagctaacatgctctctcatgctagccacttgtctttaattaaatatgttttcgcttcaatccctatttactgtatgtccacgattttacattctaagagcttattgaacaagttgacagctattattagcgcggttttggtggacaagagtgcataatgaaggctctaagaaaggtatttcctggcggtcttggaatgatttttgcaaatgcatctcctaatactatttctcagctttgggatgacaggacatgttgggaactgagcaaactcaatcaaatatttgatcagccaatggtacaacatataatgaaagttcagatcgttcctcgggacaatgaagacaaaatttgctggattcataattcttcaggtgaatgtacttcaaagagtgcatacaagcaggtatataatctatcacattcagttttcacaattgttacttctttgcagcttaatattcttttgaaaatctgttccactaagtgcattcctcctaaatttaaaacttttatttggagacttaatagaaaggctcttccaactgttgccaatcttcacttaaaattctgtgacattcctgatatttgctcttgtttcaattcttcagaaaatgaggttcatcttttttttcactgttcttttgctagagtcacttggcatatttcagaaatcacttttgttaatcgcatcactgatttaatgtataatgtctctgatattttagcttacttgcttgtcacaaacaaatctgagaacatcctacaaaaaacttgtgtcatgcttaggtttatttggatagctaggaatgactttttttttttgccgggacggcaagaacaccggccgtagtatattaagaaagaatgaccagtattttaagaataaaaaaaagaccgcaaaaaaaagagttttatttgtatcctcaagattcagaacagtagttacttgacataacacttaggccttagctacattacagacctgcaaaggctcccattccttttggaactcttccaattaaagatgatattgctgctgcctctatcaaattgttgccaggaactagatgttatgtagatgcttcttggaaagataatctgtttgggtttggtatctttattcatgactctctaaatcatcaagctatttttgtccaagcaaaatcagatctttatgtgtcccttattcgggcagaactagcagctttttaagttagctattttcatttgtgttaaacttcacattgcaaatccagtttttctttcagataatcaacagttggtgtttcttctccagcaatcaaattacataaatcaaaatcatcattggagccttttaccgctgcttgcaataaagctgcgttaattttcaggtggtgcttcaatcaatactacatggattccaagagaaatgaacaaaatgattgattacttatctaggaaaaggccagagaatcaagggttgttttgcctatagcaagctgtcaaaaatattaatcatgtttgtaatagcaaatactagttccaccaaacaaatcctgctttttgcctcttgagcagctgaaaatgttgttagagtgcgcagcccggcccaccaaccgtgggccacccaggtcacattgggtctgctccaccacagacccaaccgaagccataactttaggtcctaggattacacaacccaaaagactagtctgatggggtgaggaccgccccaccttttaagtgggactaaacccagcaatctccctcgtcacacatcgggcccaacaatctccccgtcacattaacccatgtgacctcgaagacttgttacctggcctcaggcccaacaatctccctcgtcacattaaccccatgtgaccccgaaaacttgttacccgggctctccaccatgtgacccatggaaattgttccgggttccaaaccggagctagtcttttgggttgtgtaggctcaggacctaaagttgtggctccggttgggcctgtattggagcaggcccaatgtgatctgggtggcacatggtcggtggcccaggctgcgtactctaacaaatgtatcccttgtgcacgtgttgtgcttttaatgtttgatgtaacaagttctaaaagaaagaacatgataaagtacagggagaaggaatgagagataataaattattccttacacttcctccgtcccaaaatataatagattttatatggatgagacatatcttagtactataatttaaacaagtccagattcatagtactagaatgtgtttcctcatttcaaaatcccttatacgttgggacaaagggagtataagaggcactaggttcggcaatagcaaaaaaaagagaaaagttttctgttttttcgtgcgcacttttccaaactactaaataatgcattttttaaaaaatctagatgcgtgacccacacaattgtgtggctagcatctatacaaaattatctatttttaaaataattttacataaagtttattaattagatatctcgttgtcttaagattttgagaaaccaaaccttatctccccgaattaaatttgaaaatgtactattcatttgttttttctctcagaaatattcgggatgcaatttttttacacaaatatactatcgatctcgcagaaccattaagtgaaaaatgacgtgggtgtgacgacacagatagtgtcgtgcggtgacattgcgagaccgagctgtctcgcatatggaaatagcgagaccgacgtccatgtcgaacggctccaatttaatttgtgattaattacccaattaatgactaactaataataattagtgattaattattttaattagcaattaattaataaattgctaatcaggataattaattaatttgaagcggccaacctgttcggtctcgctcgctggtaatgcgagatcgagcggtcttgcaccgtcactgcgtgacacagcgcgatctcgcgccgtccgtgccgtcatgcccatattattttcaaccaacggttatacgagataacggtatatttctatcaaataaattgcataaggaatatttttgagggaaaaaaaaggttaatgaatagtatattttcaaagttagttcttaaccttcctgtgtttctaattttatagtttttaaaaatcgtacctattgctacccttactcctatcgctcccttcgttatttgctcgatctaccattgtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccgccggatcctcgcgtactcacgcagacccgcctcgatcctctcgctctccgcaccgccgccgccgccgcggaggatggcgtcgccgaggcatctcgccagcacgacgccgtcctccagcgccgcgcagccgccctgccccaggtcgggcgtcatcgggtgcagcgcgtcgccggcgacgcacacgttccccttgcggatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtcccagccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacgatgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcgggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgaatacgatgtctggtaatcgctatttttttcttatagttgatgattattcccggtggatatgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagctgcaggacaggagccaacggatttcgcgatggaggaggagcctggtgagcagctgccgagcccggcaacagcggccggcgtggtaccgccgtaccaggcaccgtctcctggcaggcgcgccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctgcgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcaccgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagattgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgagcggatgcactgacgaaaggattgccggcggcgaagctggtgacggcgagacaccttcttggtgttcgttcactagggtcacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaagggttacattcagttgaatgagaaaaacccagaaaaaattgccccataaattctcgcaagaattctttctctgaaacttctcctctgctctgtttgctgctctgttcgttgttgccgctgcagttcttgccgtgccgggcgtgaacagtctgccagcaaggtgtttgatcggaatttttttgctattgccaacagccgagacgaaagccatggccgaagaacatcttgaacttgggatcgaagccgtggccgccagggtaacacgcgaggcctctcgtagccaagcgccccgagtaggacggctttgggagccccagccatttcgccaccacggaattcaccccgtcgcagccgatcagcacctgcatgcgtccccgccattaacaattcaagcatcccgggtaatacttttaatctccaagatagatatatataagctgtaacaaaaataacaaatcaaactctcattagtatacatatattcacagttaaatttgttgtttttgttacttccttcgtttcacaatgtaagtcattctagcattttccacattcatattaatgttaatgaatctagacagatatatatgtctagattcattgacatcaatatgaatgtgagaaatgctagaatgacttacattatgaaacggagggagtagaacttataaaagttgaattttaacttgcatttttgtggatatatcatctatcttgtaaattttttttaatttttttcatgatcattcagttgacatgcactaaacgagtggacatccgctcgagtgattagaatccatcttatcccccgttcatataatcttttggattcactgtgaaacacttttagcaacttaggtagatatccatccatttattgcatgtcaactaaatagttataaataataattaaaacaacttgataatattaaaatatatcactctactaacagacaagttcaaaatcaacttttacaagttataacaaaaataacaaatgaaactctacatagtgtacgtatatttcacagtaaaattgctacatcttataaaagttgaatttaaaattaaatatgtttatgaactgatatattacatatcaatctatttatcagtttttctaaaaaaaattataattattttgttgatatgcaataaacgagtagacattcaccgagtgattagaatccatctaccgatgtacggattcactctgttctttttctacctttgctctgagaattgcgccgtcggctaggtgtaggatcttggcgtcgccgtcctcttcgatttcaacgattttggaggagtagcgtattgtgccattgggtagctcttcctcaagtgctcgcagtagccagtcccgcctgacgcagagcatttcgttgggtcctctgcatccaagccaaatcggcgtgtaagcacggcctggagtgtgtagtagagatcagtctgagcatgccatctcaccgtttcccctgcacattgagagacgttgtatgtgacatctctcccgtggacgaagagaagacctgcaacctgtgtgatgtgaacgattcagatcaaaacatagagatggaattttgctctaggaaatgtccacttgtttcttgcatttatatttttttcaaaaaataattaatatacagtatatcactcaaaaagtacaaaattaaattaactactacaatttctcaattaagaattaactactaacaaattaaaatgtacataatattcatatattcacgtacggccgtatattcttttttttttgcaacttgtagagctcgaattagacatacatggtaataaagtatacacatgaatttattttgtttcatctaaaaataaattatgcatgtttgagtgacatgcaaaaacgaaataacaaaggtgtatctcctgcagtgtttaggtctttgttaagtcttgtgcgacttcgtccactcattaaggcgcgcacgttttttaatatttaactctttaaatgcgcacgttttttaatatttaactctttaaatatttgaccaataaactataaattaaattttattcgatgaaaataatattattggattgttatttaaatttactttcatataattataattttattgcgacaaacattataatatatgagaaatttaaagttacaaattagttttaaaaattgcgccaagtttaaccgcactttagtgagtggacgaagaaagtacactagtacttactcctgaagatgaagatgacacttcctgatcttgtcacccaccccaagggcgtcaagcgcttgcaacgcattcctccacgtcgcgatggcgaaccccgacgcccggagctccggcgacgactccagcacccggcacttcacccctttcctgcatgcggattaatcaagcaagcaagcagatgataccatctcagctcaagttaacctgcagctgtgccaacacagagagcagtctatatccagttatccggcaaacgcatcgctcgccgcgccgcgcgctaatagctaagctcccacctgtgcagcccgagagccacggcgagcccggcgattccggctcccacgacgacgacgacgacgtcctcctcgccagcttccttttgttgcaacacggttggtgccatccttgtgtttggatttaagccaatatcatgcagtagtcagcttctttagccacaggccctcttattacttattaggagacacctcacgttttttttcagctttcttagccacaaaattctctattgatcctcgtggctgcaggctgcatcatgaatagcctatctcgcacgtgtttggatcctggagtcctgctgtctgcgagagtgatggcctctagccgtagcttgtgtggctgctgtactccggtgagtgttgacatgtttcccttaccacctataactgcacggttaccgcggggtatggtaaggttatcaatagtagggtttttgagcaaattcaaaaattctaaaaaaatagaaaaaaatcatggatgtagttcttgatttttaatggtagatggtgaagaattttttttttgaaaaagagtaagataaaatcaaatttgagggcaaaaccaataattgtttaggaaatggaaaaaagaaaaaacatgtattggccttaatttttgcattttacatccaagctaggttttcaggtatcctatatattattataattatccttaatttctacacacatttaagtgtttttaaatttttttagcatttttttcataattttatgttttctacaaatatcgcggttaccgctcaaaccacgcagtaaccgcgaaactgctaattttttaatttaaattttttgaagacgaaattcagacagttttcaacggttacagcgcggttatcatgataaccgtcttaccggggtgggggcggtaacctctccccttaattttatgttttcataatttttttcataataaatgataagtgcaaataatcacacgatgaagtagagaagataaatgggagagagaatatgctgtatctcatgtaagaggtaatctataggagcaaccttttccaagagccatgaccc

SEQ ID NO: 682 - DNA, 4490 bp, Oryza sativa
  unsure (1)..(4490): unsure at all n locations
nnnnnnnnnnnnnnnnnnnnnnnnnnnnnnnnnnnnnnnnnnnnnnnnnnnnnnnnnnnnnnnnnnnnnttttatgttttctacaaatatcgcggttaccgctcaaaccacgcagtaaccgcgaaactgctaattttttaatttaaattttttgaagacgaaattcagacagttttcaacggttacagcgcggttatcatgataaccgtcttaccggggtgggggcggtaacctctccccttaattttatgttttcataatttttttcataataaatgataagtgcaaataatcacacgatgaagtagagaagataaatgggagagagaatatgctgtatctcatgtaagaggtaatctataggagcaaccttttccaagagccatgacccactaataggcatatatagcgtgccttgacgactgaaattattgctaatgaaaaaaaattgaaaatattgttcaccatttttttctcgaaaatataacactgttgaatttttcacaagattagatcgtcgtagcaagaacggcatgcaaacacgtaacgagtttgtctacccaccatcagatttggagcacaatgcgcgtggatccagctcctctgaccttggatggaaaaggcagagaataagggcccgtttagttcataattttttttttccaaaaacatcacatcaaatctttggacacatacatgaagcattaaatatagataaaaagaaaaactaattgcatagttatggggaaaatcgcgatatgaatgttttaagcctaattagtccgtgattagccataagtgatacagtaatctacatgtgctaatgacgacttaattagtctcaaaagattcgtctcgcggtttccaggcgagttctgaaattagttttttcattcgtgtctgaaaaccctttccgatatccggtcaaacgtccgatgtgacacccaaaaatttccttttccctaactaaacacaccctaacagtaaaatgtgtctgtgctacatcagaaacagtaatacgtagtgtttcactgtagcaacagcactctagctctctaactttacccatgtaaagtcagaggatccaaatccaatgcgcgtgtgggcgggaagctaagtaagtttattgggccacgatatctcatgtaccttcagcgcgaactcggccgtgtgagaccacaagcatgcatcatgcctgcacgaactcagggcctcattggatggatgtttgggctgaggcttttcagccaaaacccattgaattgcttattgggctgatgagtaccagccacagaaaatcttcatcaagttaaataagccaatcaaaccaatcaatggtttttctttagcttaaaggaaaaaagccaactttggcagtcaaagctatttgcttaccgatgagggcttcgtacagtgagtacaaccccatgaaggtgaggacgacgtcaacttcacgagttcacatttgctttgatcactttgttattaaggccgtgtttagttctatttttttttaaacttccaacttttccatcacatcaaaacttttctacacaaaaactttcaacttttctgtcacatcgtttcaattttaactaaacttttaattttagtgtgaactaaacacagtctaagagagaatggtggtattttaacttgtaagaaagtttcacttatgttcataaaattacaaagtgtgtattgaggttcgtaaacttgttttatcgtattattctagtccaaaacaacttggtttatcgtatcattcttgtccaaaaccttgtttgacctacttagcatgctacgtggataatgacatggcacttttttttttccctttttttctcccctctccctcagggaattttttttatttatacttttttttattaaaatatttacaaaaataatttgttgtttcgaaaatttacaaatctaatcgcctgccgccctttgagagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcataagggcggcatgcaattagatttgtaaattttcgaaacaaaaaattatttttgtaaatattttaataaaaaaatgtataaataaaaaaaattcctccctcaggagtccggaccggtttgctgcccgccgccggcatgtgggccatatttccttttccatggtagtaggccagtacaggcccattcctaggcagtcccggcccgcaaatttatcggcccaatatgaggggtgtcgggtcctacaagtcagtctccttgctcgttctagcgtgttcggtgttcctcgatagaaaagaggactgggggtttagctgcgcgctctctccctcccccaattttctctttcctcatctagggtttccgcgtcgccgcggccgcgagtcgccatggatttcgacgagtacgactacttggagaagacggtggagggctccggggcgccgtccaacggcgccgccgcgcccagatccgaggagaaggagcgaagctctcgccgccggagcggcggcggcggcggcggcgacgaagagcgcgacgatggcgagcgcagatccaagcgctctcgctcggaggagaaccgcgaccgcgacaaggacaaggaccgggaccggcaccgcgaccgcgacaaggaccgggaccggcaccgcagcagccgggagcgtcgcgaccgcgaccgcgaccgagaccgggacgagaaggatagggagaaggagagggacaaggacaaggagaggagaagccgggaccgcgagaaggagaaggagaaggagaaggagagggagagggagagggagaaggatagagagcggaggagccggagccggtccgagcgccgccgcgacgacgaagaacgtgaccgcgaacgctaccgcgagcgagactaccgtgaccgcgatgtcaggtgccgattcatgaccttacccacctgtattggtgccgctgtgttatgaactgagtggtcttaacggacttgccgattgcttgattccaaaaagctgccatccataatctcgttttcaccacgtttgatgcgcttaggcatcgttgtctccaacaaaatcaattttatttttctacacttggtcatgatatattgtaatattcgcggaggattgcatgggatggggatagcaacatagtttgagtgtaatgagtatattattatggggtgcattgggacttttcttcttatttgtacaaatgcagcatcaatttgtaaattgcgtgtaatagttctgctttcatcgtttagcataatttatagcagatgatttgataactcttctatcagagtattcctattgcttcctataattctactgctattaacagttttttgtattatatacctcgacttcttgtaaattcctacaatttgaacattagtatgggtacctgcagattcaatttgctagagccatcttctgtggtcttgatgttgagcctgacctaggatatcaggtgatttttttttaatactactattattagataggagttagtgttctatgttagggttactatgatagggaaattcaagatggatgatacaatttatgcttttgagtggtggtctgagagcaatgatggtgccatccacgcataaagttttgttgcatccagaacatggagctgaactgtacttcttgtgttgcagaaatgctggtgagcggtgttttgggcttcttcactgaagcattgtgtcttattgttaaggggactcagtattcggcccgctgcacaaacaacccttattgctttttacccttttcaggagatgtcaactttgagttgtcagagttaagagttgtgcgaaacctggttagatgatggttcagagcccactcaccgttctaaaccgcatgcatccatgcagaaggggggggggggggagcagctgcatgcatgcatgtgcaacactgggtcaaatggtttagtaaaaccgtttttgttcacccccaatcatggtgatgcatgtctatgccttacaacaaagggctttttacactacattttttgcttatctcc

SEQ ID NO: 683 - DNA, 15513 bp, Oryza sativa
catattctaatgaaatgtctaactcgattagtcagttatgatctataatgatggctgaactatgctcagtgaacgttgaaagttattcttcctggacccctagatctgacacattcatttcttcaattattattattggataacttgttgggtagttaagcgttgtgatcttaacaaatcttgttatttaggtgagaccgttagaggtagggagagaggattgagtggtgatataaatttatattagtatggatggacactaacatgtagggaatgattgatattgagaaactgaggtagtattctttttatgaggaactccattactgttggagctgatgattaatgtgggcttgtattatatatatatttttctatattttcgtatcaatgcttatgacagttttgcttattgtctgtgcagacgtaggaaagaagaggctggagagcctgaagcagatccagaacgagatcaaaggacagtatttgcctaccaggtgcattttagtgtaacatttgaatttcactttgtgaccaggaaaatgctgaagccttttctatttgaaactaatgtttgtgagcataatcacagttatctctgaaggcggatgaaagagacgtgtacgaattcttttcaagggctgggaaggtgatcctcactttgaatttgcttgtatcctctttagtagtaaaatattttatgattagcagatgaacatttacggcctataattgtggtttggtgggaaaaaaagttcttctgatggttgctgcgcatttgctcagtctcttgtcattgcatcaaatcaataactgtgctgacattgattactttttgtaggtccgggatgttcgcctcatcatggaccgaaactcgcgccgttctaaaggagttgggtgagtttttatagtgaattctgtgcaacatatcagatcgttgttttatttgttacctgttttttttccttgagttgctaaaagaggggttttattttcttagtggcttggaatatctagcagtttgcttataatagccaaatatatctattgtttacacatttgatgggagggaggcagggtgttacttgtgtttcctgttttagaatctccaaaagatctgattagactttggtgttctactgattgttaccttggtcgtttggtgcctcccatggattcataacctgagatctagagagggagggtggggcttgattttaggttttacagtatcggaatgaactcgttagtttgtgctcataatgcttctggttttgtgtccaagtggcaatattgacttactgagaatgagggagatggacccactgttttggggttttagtctgtgttgctaagccatttgtttgtagcaagcaaatagcaaatgcctcctagctttctgtaaagctgctccagttttgtgctcatgtggcaaatattgtgatttaggttgttggattcaatgttaggcatgtttgcacgtgagtgtaggtgtgctgtaaggtccattgttggtgggcaacaagggaaggagatgaactgaatcagaaggtatgaaccagagtggagtagatgtctcacaagaggctgcaaagagatcaaatgtgtgagaattgttttttgggtggggggtgattggtagggtatttcaaatgttaatgaataccgaccatatttgtcaatatttttctggttgctgttatgattacacaagcatttttaaactgtagctacatctacgatttattatgggggaatatattcaccgatttttcatactcggcaggaatgtttataatttggtgtatctactgggataatcagctacttatgactaagatggaatacaagatctttttgggggaagtaagcagcgtggaacatcaaacatagcaattccacattattggatgccatttctgcgcattttcatatgattttggttggaggaatgtgcaattagtttgtgctgggaaaaattaattctaaacctgtttgaaaatgtttgatatgcaagattttatgtgaataactgaatatcttttcaaaagattgaacgaatgcggcctaattctatcggcgacatgatatcctgatatttattatgcttttgcgtttccaggtacatcgaattctatgatgttatgtctgtaccaatggcaatagctctttctggccagctgcttcttggtcaacaggtgatggttaagccatcagaggctgaaaagaatttagttcagtcaaatgcttcttcaagtggagcagcttcaggtggggcaagaaagttgtatgttggaaatcttcactcaaatattactgaagatcaattgagacaggtgatgccgacaaattgttttttagatgagttggctgtgcttttggaagaaaatttcccttggagttcataatggaaaacatattacttttatggggtagaagaattactatggcatccttgttatgcatatatagagtttaatgaattctctttaccaggtcttcgaaccgtttggtcaggtggagcttgtccaattgccactagatccacttactgggttatgtaaaggttttggttttgttcaggcaagtgtttgcttattaagcaattcttttgtttttgtggagagttctgtgtggctgacttctgtttcatcatgtagtttgcacgccttgaagatgcaaaggctgctcagagtttaaatgggcaacttgatatagctggacgtgtgattaaggcaagtgttttcttcagatttactagaatacatgttgttttcaagctatacatctcaaatataagggttctgcctgacactatgctaaactgctgtaaccaggtttctgctgtgacagaccaagcaggagttcaagtcagtggagtaactactggagatttggatgatgatgaaggtggaggtttggtgggtgccatttctggagacacatcgagaactggaaattcacttatcatatttgatatatatatcctcattttcttttaagtacaattacttgggacatagcatgcttttgcttgcacctcgcctcaatctttttagagaagattttactccctccatcccaaattgatcaccatatatgcatatgcaccaaaaccaatgataatttaattcacatcaatcaagacatcatgcacacattctcccacagcgcatgcattgattaaaacaccatgccaattacacccttagcatgcacacattctcccttgctgcattaattgtattccgatgaaatccatgttcatgtggttatatgatgatcaatttgggaaattttgaatttcattatatgatgatcaatttgggaaggagggagtaatgtgcaagaactttaccatatgatggtttagtatacactgagcactctgcatacctagcatatctactatagcaagcctttattgcatggtcatttgttcattcttagttggttaatgtttgaggctgtttttaaatgccacatacttatgcatattgcaacagtatctcaattgtgtctgtgatgactttgctgaatgctgatgtatgcaggcactgaatgctagttcaagagctcttttgatgcagaaattagaccgtagcggcgttaccaccaggtatatatatgtgagcttaatgggttaaactatctttttggtgccctcgtggccatgtcaatctaactacatcagtcatattcaatcttacatataacctttgtcccataaatactccctctgttttttaatagatgacaccgttgacttttggcatgatgtttggccatgttgaaaaaaattatataaaaatgtcatttattttgttgtgacatgttttatcattaaagaaatctttaagtatgacttataggcatatttacactaattataccaaaagtcaacagggtcatctattaaaacagaggtagtataaataggaagaaaaaaaagaccatgatacccctctttaaatgtggtatggacgggaggttggttaggggttagctcgtttgatggcacaagtagtactatagaatcccttatattttgggatggaggtagtagcttgtttaatagtgtgttgctcagtcaaccaggtaatttctgtaatttgttgatggtactgcagagccttaagttcatatttagaatactgggatgtcaaatgtccagaacgtcaattatcttgcttgttagagttgctgtcatttgtatcaaaatcattcgttattgacctttactatattatcgtcaggattcatccaccactacatcaacactgtttccatatgtatatagcttgtcaaggtcattctccaaggacctcttccaattctttggtgtacatcgctattgttaatattttgtttactccatttctaacatcaaatgtcaatcgcattgactactacaaatttcaagagagtgaaccatgattgagaaatgccgagaacatgccacagtaccttattattcttatggtatcatcaagttatcgtgacaagacatgttagccataaccttttaatttttcactgcatttccaattcaaaaaatgtgcgtggcatatattaactacaaatagttggtactggtttgaacacttggccttcctctgaattttttaccttccttttgtctgtctgcagtttgactgctgggatagccggtactggtttgaacacttctgttggattaccacctgcatcagttcttggtgctcctccagtcgctgcatctgtactgcctacagtgcctggtcttggttcagttcctggggtgtctctttcaattactacccaagccattgagacagccccacccagtgaatgcctattgcttaaaaatatgtttgatccatccgtggaggtttgttcttactactgcattctttttttttttgggttcaccaacagtccataccttttttaaaaaaaatctttactggtctgtatcctttctgtttggttgattaaaaactaattgaaacttactttattgcagacggaccctgattttgatttggatatcaaagatgatgtccaagaagaatgctccaagtttggccaagtaaaacacatttttgtggacaagtaagtttgttcaacactaattaccagtcaacaaatctgtaacagcttgcatacggcattattgtaaccatctacagcttcccagtacataagtcccaacacaatctagtaatctagtaaaatatagtattcaatagttaccagcatgtacttgtagagtgttaggggaataattctctattctctgctaacatatccaaaggctctgtttactgtgcttttatctttcaattttcttgtgtactgcaacttcagaaaggtgcagtgtacttttgctcctcgtactgcagtgcaattattgccgtgtgcaaacctgatttaccttgaaaagcctgccaattttacaaggatagcctaaggccatgtacaacgtgtgaccctggcctgtggtctcaaacctccacatcggacgggcgcatccatgtcagtggggaccgtggctctgcaggccgattccgcgcttgcagaggaaccggtcgaagcgccgtgcctgggctcgggagccgcgaagccacagcccaaggccacgcgttggcggagccggagccccgtgcttcgcctcgtccggtcggtcgccgtggtagtcgtcgctgctcaccgccgccaccgttgttccccgccgccgccagatgcgaagaggagcgccgccgatgacaccactgttccccgccgccgccagatgcaaagaggagcgctgctccccgtcgccgcaggatccggcgagcccgcgcccggatccggtgagcccgtgcccggatctggcgaccttgtgcgcagggtggcggcgaaagaagtaggatgcaccggagaagggcgtgtgcgtggcaaagaagaagaagaggatggcctgggggaagaacgccgcggttaagaggaggaggcggcgctgcggcggcgcaagagaagaggagcggcgctgtggcggcgcacgagaggagaagtggaggcaacaagaggaggcgttggagaggaagagggtaaggcagagccggttggtaggaggagaaaataaagggaagaggattggagaggctgacagtgggtccatatatagattaggggtatctatttctttttgttgttagaaggactaaaatagttaattttataataacaaatatcatagggactaacacaaataggtaggggctgaaacacaaaatatactctgcagtggtctccattgtagatatcgtggtttttgtgtggccttatcctatgtggcaacctgagaccatagttgcttgtggcttgcattgtacatgccctaattatttggtattgttgcaactattttgcaggaatacttctggctttgtgtaccttcgatttgacagtataacagctgccatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgttttagaaagcacagttccctcgagatttcctaataagaaggggctatacatggttccattacatgtaaagtaaatcattggatctccttgaaaaaagctggatttgaatttaatgcctttttggccaagttacgcgtatcatccctggatgattcccttgatatgcgaaggagctccttgatccctccggttagaataatgtcacgggcgttatcttctgcgaatatgcgcatgtgataggaacatcagtgatgagggtcaaatactcaaaatgcgtgagcttgattgtacacagggagggatcgaaggtgacggcagctagtcagtttacgtaccattttgagctaaatggcaaaatgcaagctcaatatgtcttcgagttgaagcagaaaacgcggatgaattggccaccatccaattaagaacaccttcttcgatgaggagggatctccctttcctgtgacctattttgggtagaatggcaaaaaagttggattttccctctcaagtttgcatagttatcttcaggagaaaagagctgaggacagtagtgttccatagtgttcaaggtaaaaaaatatgtaacatgtgacaatgcaatccatgttaaggcatatttagcatatatgattgtgtaagcctaccaggatattattaattgattagtggtgtaatatcggttcgtgttcttgtgaacatgtgcgttatatgcatagatctactatagtaattttcaagaagtatgtacgcaatttcagcaggctctagccctgttggcatgttgtatcatatcagtgtatcacacttcagattgtcctctgccgcattttacctcttttcaactacacccagatcgtcataactatccaaataaattcaggactgttctgcagttgatattcatgcaaccatgtggagtttgatattcaaaccataagctcatagaaaacaacaaacaattacagaataatatgaacgaatatatccatcacaaatgagtaatagagaatgtactaaccttgacttattactcgggattcacattttgcaaaattagccattccccgtgctatctgagctatgacttcgttgtgtccagttcggaacattccgagaagtgcttttattccgccatcttgtttcaacataacatgcagcttttctgcaaaaaaaaaaagaaaaggagtacatggtattggtcactcattatcaatcaatgttctacatacacgagctctcttgtttccattccaaaggaatgctagctcgatagttgcatgtcattgctgttcaagaagccacaagtggtgcaccctcacaagtcacaagaggacaattgcccaactaaaattacattattctaaaacaaaataaattaaagaaatgtacttatcagctcttgacaaatatccggtgcaccaattaacaagtttgatccgtaaaatcatgactttatcttgtttacattctgcatcgctatccacctttttatcttcatttcagaactactagcaatcagcgttaaaaaaggccctgataagctgtcctgatgcgccggaggattagtggctactggctagaaggatatgaattcaaactaaacactcaaattgtaaatttagattttttttttcagcaggtaactgcacagttaccctccggtactggtaaaaaaaattcaaattttggatttgaattttatctagtaaaatctggtaatcggtggaaccaggcctggtaagttagggaatactggtatttgaacgctggtagcaacattgtcaaacaaaaatagttaactcattaaaattgaaattgaaatttgaataaaaatatgacacccactgccgttcaagaaaattgaaattccatattaaaaggaatattttgctataatggatacaataaagacaggttgtaccgtttccacataggttggcaagggcaccagcaaccatccgcagagtttggggatcattagttttcgacgcaatatttgctaataatcgagctcctcctttgttcattattagtccctggtttgatcctgcacttacaaggatctaacttaatactcaagttattgcctgttcattttataaatatcgcaatataaatttgactaataatatagatatagttcaaatatgtaaaaagaatatctcatgctggaaacctattggggaattttccttcagtcaatgactgggccatttggcatgtgcggaagacatttagtgaaagactatagaacacaccggttaacaactacttccatgctgcaatattatcagcagtgagccaactatacaatgaaataatagccccttttgaccaaatgtggaaaataaatctcatgagaggttggaataggcattaccattcattgccaaattagcaatagcaccagctgtgactcgatgaattgtggtattttctgatgtttctagaagtgacagaagagcatccagtcctccttcttcaacgattttttcctgattaacgtctgcaatcccagatggattggtgataacaattaactatggttataacagttgccttctaaaggagaaaacatagcatagacagcagataactgaaacaaatcactggcttcaatattatgaccaagtgcaaattacaattcgtatggaacagttgaatatgttcgtcaacagaatttgaacaatatgccactttcacatttttcacatattataaccaaaagagatccacatatttttagggaaaaaaaatcctcttttcaggaatattttccatgcaaatgtacaaggaaaggcagtgaatgaaaaatattcagagttttacataaagtcccgtaccttcagcagcaagattagctactactttgacagcatggatctgcacctctagttcatcagacttcaacagagccaggacatttggaagaccgactgaatgccagttggaccaaaaataatgtcaagatggctacccacaaaaaacagctacactgatattgtaccacaaataaaagtaccttcttcaaatatctttgatatgttacttctctggctagatagcaactctctggattttcctgacttagacataaaaggcacactacctaatccagatcctgatctaaccataccacataatgctttagactgtcaaaaagagagattgacataagatatgattggaaaatgagcatcagaatgtcaagattataatgcaagtgtggtacctcttcagagcaattatcagccaaagattgtttcaaccttagaatttcatctttaaggccctgtctatgtctcatcttctgttgcatcttttcttgagtagatttcagctcttcatacaccaactcctagaagaataattaaataaaaaggtacattaaaattgtttcagatttgagaaaacctaaacatctccatatgtttagatgtgctgtcccgtgtttgccataccttctctgatatgagatcagcaattctttcttcgagtgagcttatttgactggcaaattcttcagtggttctggagagctgcttctccaattcacaggctatatttttctgcaaccgggatatcctcatattaaccttttcaaaattcctgaaggatgcaaacaagtcctccaacaaaccttaaattattgcagggacatgcgcaatgacattctgccaaaaggccaatagtgaagaaaaaaaaggaaaaactatagagaacccaaggcatgtctagtctaaaatgtttttccatttcaagtatggagagtagtcctggttgaggaatgaggatattatatccaaacaagatgcaaccacaaacaaaaaatgtatacctgaattatctgactgttatattgtattagactattagttactatgaattatctgactgcattatagctacagttgtaaattctgaaagtatacctgaaaataattctgagcatcactcagttgctgttgtagtacatttaaatggtcgttcatgctagcagaacgtgatctttcatcttcaagttgcttcagcaattctcttattttcttctcatgagatttagttgtatcggcaagaatatttgtgtttgagatgttctcaagctgtttttgctactaacaacaaaacttgtgttagaactgtgaaattattgaaataggacatctcagtgtcagcagaactacatcaaatactaagtacaaaatcaagataaacattacatatgagagaaatatataatatggcaaagaaaatctaccttattctcatccaatgatgtttctaagtgaataatttgctcagataaaatattatttttgcctttctctttctcaaggtccagcatcaatctcttgattgtagattccaattgacgcttttccatcgccatattctgcgaaaataaatcacttgttacattatatctataatgccctgaagcaagttttatgtactgaaagtgatttttcctgaatgctcacaattaataattatatggaaagcacaaacaaaaatacaaccaatttacttgtcagaaattacaatagatatttacttcaattcatgtacccaataggaaggacaaaggtaagtaagaaggttctgtaataaacaaaaggcacccaaactggtagatttttgtggagtgacaaaaatgaatcaaaattaatatacaatgcaaacttcatagtctatgctttttggacaattagtctatgaaagttatacctcaatttgcatgttagaggtcacttttaaatcattcaaggatgcttctgattctttcagttttttctccaactgcattttctcactgtttttaagcttttgctgcctctccatctctgacgtaagatgatcaacttcatgttctaccttcttatataggctttcataatcaacttcctcctttatccttatcgtgttcactattttcattgcctgaaatcacataatgaacgacttaatgtggtgttataacttataacaaaaaaggaacaagaagaaggaaacgatataaaacaactagacaacatgagtttctttctttgagtaaatgcagagttgcaattttaaacaacgagagccattgaattcatttcaagaggaaccagtaacaagtagtttagttcatgcatgaattaagtctctgatgtaatgcaacatgcacagtttgcactgtgtgcaaattaatgctgctcagttcactctagtaatttatccagttagaagcagttgaaatgatgtttccaactccatgaaactaggtgcattatgttggtataagacaggtgcatggcataatttaatggcctgggatggagtagagttcagatattaactaaccatcatatatctagtgggattaactaaaaatatatctagtgggaaaagctctgaataccatttacaagaataggttccatacagtagaggccaattttgcacaaattggaatagggaaagtgagcaaaaattcatcaacgtagacagatcttagtatcttacagatggacctattgtgcagagagagagagagagagagagagagagagagagagagagcaatgaaatattgaccaatctacacttactcgctgcccaaacataattgtgcttgaagtttctgagaaatgccttgaagatggacctattgtcacaatgagtgaagtccttgcagtccctgcatttggagatttgagcaaatcaattacagtgttacacatgtagtgatgtggagaaaaagtaaccatgatgtttgaacaaatgtgataaattcaaacaatctaataggcacctatactttggacaaacacaagaaattcaatcataccaaaaggaaatcatacctccaaatgaatcacgcagtattcttgtaagttttgaatctcttgttggtatatgaggactattttctgctaacgcgttaatgcatttgcctagagatgttaatgacagattgatgaacttggcttcttcaatcatgtgaccttcacttcctgggagacaaaagattaatattacaaacaaacaatacaacatacgaaatgaaaaggtttgtttcaattatatggtaagacctaccagatttatcgatacgttctgatccagcaaggtcgacaatcaagagcttgctcttgagaacaagcggtaaattatcaggaaaaaggttgtcagtaccattaggaagagaggtattacttccatcttctattcttgaactcctctgtatatgaatctgaaaagaatatcaaattcgcatgggcatgtaatttactttggaacttaaaacagaatacccacagcaaggaagaaggagcatacaatgagaatagcatgactacgagatgattctgtgttcatcttagtattagcagcatgacgattcatctcaccaatttggagaagttgaaaaacatgttcaagatctctgatttcaacttttgcagcaccaggcaaagaaacttcaccagtttttggatcctcaacaatcggaatattagtcttctctggagcaagtaaatcttgcacagattctaagtaaagctataaaccaaataaacatgtatacattagtatggaaaaacatactacaacaataagggaccactaatgaatattcaaataattttatataattgagaaaaaaaatatggacatagaagcttaagcattaaatgaaccatggtgcactttggttcaatttgcagtacaccatgaactataacacttcatcccatttgtgcagttttttatgcaatttatctagcacgatagaaaaatgcctttatctttgtcgtccacgtttaacatggcaaactacctggaactatggatggataatattaaagtgagtgaaagtgttcaaacacatattgttatacatgacctatttgatgtcatgtattaaatacaaaaactggtgctatgtcttacataatctgttcaaaaatgattgtgacaatgtggcacgataatcatataagccttagcatataaatatgactgttcctggcttcctgcattaatcgagacagtttgaagaatcctagctaataagaaagttaaaacaattccaccattccatgccaaaaaagaataatgtcgatcaataagaaataatgatacatgtacaaaacaaataacttcagttgttgagaatagaacctggagaaatgatattgccacactatctgtctccaaagacatgacagaaaggatatgttccaatgctctgaccattattccaccttcagaagggtcgtcatttccaagccgaccaactgtgtatgtcttgccagtacctgtttgaccgtaagccatcacggtcccattatatccttctaacacgctctgcgagatttatcagaatagtttctacattctctcaggccaatataacaaaatatcatatgcaaatgggtcataagctagtaacaggctaaagggaaattccaattgtatacacataaaagtttgttcctactagcaatacagaaaagcgttcttaaggcatagttgcaggcctgttgtacactatttggcacctaagagaatcacttcctgataataatcaagttctaccaactgaagttaatgtaactacatagaaaacagacaaacataagcatttgcaatgaaaatatgttgctcatagttagtagtacgttacatgtgtaaataaaagggtgatgacatgtacgacttgcctcgactacaggttttgcaacgacctcatatacacgtttttgtgaagcattttcactgaaaacctcatcaaacctatatgattcacagctccagttgtttttctttagcttcagcttcttacactgcacacaataaaaaacaagcagaataagtaattaagttgttaattacttataatgaggtacaaagcgcagagagtaaaataggatgctcacctcaggctgcaactcaacacaactatcgaagtccgcgccatgagctaagtcctcagaattcttcggccggagccttacagcaactcttactctgcacgaatctgtgaaaaacaccctttatcaattctgaaaacataccatattgacatcaactccataaacgactgtaaagcatattaagctacattcaccgcatcagaatgtgagaaaacagcatcgattacagatatctagcagaatgtactgtgctagaaggctagcagcaccagggaaatggcgtaaattcagagcgaatatataactgatagcgaacatatatgacttgtatacatgtgtgtgcgaacatatatgacttgtattcatgtgtgtgcgatttaatgagtacaatatataactgatagcgaatttccaatgctgaaatgcataaatggtcatctctccagcgacaatgatattcccgtcgccgttgcaagtatccgtaacgtttggagtttcccgataaaccgacgaagagcgaaaaacccgagacgcgcttccacggctcctcgaacagaggaaatgcatcattcaccggacggtcttcgacgaaaagcaccaacagcgaaaaacccccaatacaccga

SEQ ID NO: 684 - DNA, 21619 bp, Oryza sativa
gtttgaattatttaatgcaggggggtgtgtgctttgcgtttggggttgagagggtgggatggttgatgttgattgaggtgatggatccaacggcggagaatggatgttggagtttgctggatgtctctcacgactgacactactccccgtgacgaccaccagccaagcgatcttttgttgcatttgcttctttttcatactgctgtgcatgtttggctgtttgcccgtgagagagtcataactaatgaacagtaattattactacttcatttctgtaaatgttttctagctgttttatgttaaactaaatgaatgcaggagctttactacgaataaaacaaaatatacgcgagttacacatcttttttatgaggaatgttcacctttagttcgattttatacgtggcagcatattttaaatgagctcttaatattaagaggttcaaggttaatttgtaactttacggatttattgccaccaccattatcctattttaaagaagtgtaaaaattttgttatgtactgttcttttctttaaaataatgttgtttatgtactatctttgttttcttttttttccgagctgtctgttttctaatagaggtatcattgattttgtcacaacactttaatatttgtcttattcggaaataaaattagtgcacatatggaaaaatataagtaatacttaaaggtcctttaatgttaaactaagtcgcatcaaaataaaaaatatttagttaatttttttaataaaataaaatggtcaaacaaaatgttaaaaaaatatcggcatcatccattaaaataacaaaacggaagcaatacttcaataagatatgctctctccatcccataaaaagccaatctagtaacggatgtgacacatccttatattacgaaaataaacatacatctataaacatatatctatttagatttgttgtattacgaatctaaatatacatctataaacatatatctatttagatttattgtaccactataatgtattacattcaattgtttttctttctggatggagggagtatatacttagtaagtggcactgaattatctatggaggatctcagttaaggtaacgaaaacaatgctcacaaaatctgcaatgcgctagtatagcaattcagtatgaaccacgagcaaagatgatacatctgcgaatttctccttcctcgctacaccatatgcatgatacatctgcctgtcgattgtcgaacaaaagatgggcactgtccaggtttacacggaacaaaaatgaacaccacaaaaatggaatctgaactatgcaacacaaacattacagattttcgatgagcctgtatagacaacactagcagctcagcaacccccgtgtatgaatggatttggaaacccaatttatagtctatagacagatcattgtgcccatttctccactgtaggcagcaaaatccttcccacgtacaaatagcgttatttggcttcgagatcgtgctgtaggagcttctacgtcaaaaatcggatacaaatgagcaacaatacacttgatccagtgacctcacactctgcgcagaggttgagaccccagaccccaattcaccaagacagtaattgcaccatttgacactctgatattgactctatgaacttcccgttgaattggcagctgacgcatatatctccaaggagtgctctggtatgtatgtaagacctgtagtagaaagatatcaaacaaaacaagcaggaaacatggaataaattccactatagtctacatacttctttctttttttacaatcaattccaacaggaaataattatatgtcaacatcctaaggaatctaggatattcacattgtgacagattgttaaaaaaaaaagtgttcctccaatgccactaatttgtttttctttctctgtgtttttactatgcttgcaagaaaaagtatacctttctcccttatcgttatttgaagtgtatccagtgtaatgatcccatccgttaatggaagtagctcaagcttgacggtggtgcttgaacgtgcaggaatacacctaccacaatggtgacaacaaatgttattctttagtgtatagaaatactccctacgtcccaaaataaactaaccccatacgggatgtgacatcctagtacaatgaatctggacatatcgtactaggatgtggcacatccagtacgagattggtttattttgggacggagggaatacaaggtacatgggatgtgtcactcaaagaaagaaaagcaggtgaggatcaataccctaaaggaaccgcactctgcaaccacagatgagtacagcctccagaagtgctaattctatttcctccattgtcactttcttttggtgagccagcaaggactgaattcattcttcgaaaaccagctcgatgtttacccaagccagatcttctcacagactcattaagattgtcatacgaactatttggtgtggttggagctgagttcaaggatacaactgaagaagaaccagacgcttctggagcaagaaccgttacggtaaggttttctgatgtcatattagtagcctcaagggttaagacctggaaggtaacagtggattgcactatcaaaatgaaacatggataatctgcataatatacctaaaaaagcataggaattacctgcactgggagttgaggaactcgagcactcgaaataggatttcgcaaagacagttctgatgatacagagatcataaggtcactagcaacacagggtcgccagctggtggcctgcttgaagaaaagttttgattctacacaggaaagaaggctggaagtcagaaataacaattcaacgcttcttccaagtcacttacccccatctgttaagtagtttacctgtgtaattgcagcgatatgatacaagtacagcatactgatccataagagagccaatggtctcgccaaccttagccaaagaaacatttgtggcagttccattcatcttagggagtgacaaagtcagaggtgcatcattgttggtcctccggtccctaaacgacatagttgctggcttgagaataaaagagtgctcctcgcctctcctggaaaggaaaaggtaacatttaagaaagatggaatattctagaatctgacataaacttcaatgtttagagtaagaaatactcaacatacaaccatgtttactactactagcatatacttgaatctggtgaaagtaaaagggaaatgtgaacttaatccagtcctgctttgactaacccagtactctagggctctaggccatacaagaccaacttgtttgagcccaaactcaaactcttggatttgatggaccccgagggggaattgacccaatcaaattctctgcataaagctgaaatggtggatagagagtgaaatcaatgagaaattgcatatacctgagtgcaagatttggtaagctatgcccgtgcccaacctcaatactggcaattgggagtgacaaaggagcacctcctttggatgcctcctcaaagacaattgtaattgcatctaccaatacaactatatctttcacatgctgtggagaaatattctgaaatttgaagatagaagcattaggtttgaaagcttctctaagtaggagatattaatggttagggatgttcgcgtaaccttgattagaacacacagaagattttccgaagtacattttgcggcaaaagagtgaacctcaattggttgaatgatctcaacttttctccgccatcttttccctggtagatatacaccttctagaccacaacgtacggaataccgttcaggctccaatggaactcctctaaaggaaagttgtccatcatttataatatcaggtgttttcgcaggcttttcaggcacaaattcttgactttcagaaattggtggtggcctaatgttgggtggttgagtggaggaggctgaaggcatggaatagcttctgaagtgacttaatgaaaaaatttgagaaccagaagcagaataagattgcttgtgtgatgcactaggattgagagtaggaggtgataaggatcgcggaggaagtgtgcgatccaaagggagcagccagcttagcagctcctgacatggatcctcatcaccactagaaagtccattgaccagattcttggttatataattgcttgatgaagatttctcaaattgaagaacttctagcactggagcttccattttgttaacaccaacattcacttgcaaaacaacctgcatccttccaacaaagaacatgagtgattaatcagcatatgtataacatctaaaattaatcaacagatacacgtgtgcttcctttctttctgaaaaaggggatttcaccgaaggtaattctatatgacttctaaagatctcagaacattgctcaatgccgtgatttataaagttgcagaaaatgaagagagtactaaaaggcatgggcatgaggtattagccagttatgtcaatctgctaagattgacgcaaataggtagcacatgagaacagtctaccatgtttatgcctggtgaagttattatgattaaagcatccaacttgcaattatttatgcagtgctcataagtaaacttccaatgtgcatacattatacaaaagttctagttatagtatcacccagtaactaaacagaaggatcattcataccacgatgtctccattttgcagagcatagcaccttgctgtaccacgagcgattcctccagatgtgctaccatcaaaaactcctttatcagaaatggtattataagcattactccttgaacccttattgttttcctggttgtctgaatatgattgctcttttggcacctttgatacagctagttttttattggaccagagaggttcatctgactctgcaattcggacaaaaaaattggacattttgaatctttgaagcatactttcaatttggtgcttgtgatcttccaatcgaaggagagattcggtctccaaaatatcttgttttgaaggagagatttcgttgttgagttcaacattttgcatgtcatcttgttttgaaggagacatttcggtgtcgagctcaacattttgcatgtcatcttgtgtcataggagacatttcgctgttgagttcaacactttgcatgtcatcctcaacaacctgggaaccattctctccattctttacattactatcaccattttctgtggcatgactagatttatttgtggagtattgcaaagaatttccattcttagacatcacggcagcaattctaaagggagatatgacctgtgtttcttgcttcgaagcggacatgcacgccaatatatgaccctgctcacctgataactgaactagttcagattctagaaaacaggcagaatcatgatgcacttgtgccagaccccctagactaagtcataggaaaaatgcatttaccaggaaaaaggaaggggcggtccaaaggctgtaactgcaacatgtctgaaaggtcattccagttatcaggaagctcctctgtggaagtaaattgaagatgttactgaccgtagatgtaagaggattaattgttacaagcttatggcacttctaaaagcatgacctatgttccatggcacttcaaaaggaaaattttcagaaaaatatggatttccttagaacatttagcagatcttgtagagatattcctaacaaatggattcttattaaccagtaatgactttaaatgaaaataaagacgggcaagtcaaagggcacatactgttcggaattgtgatccatccttcgtcatccaaaacatcggtatgctttccagtaggaactgaattttttgaatctgcatctgcagagtccccaccgatatctacatctccattatcagtatcttcatcttcaggggaggggtgatatggatcatcggcaataaggccctccagagttgtaactggcttttgtaggctatccctttgctgatcttgctctggaatccgcggaagctcgggtgcaacaggctgcgaagtccggtagaggaaattcatctctacccgtcctgccaagcaaagcaagagggtgaaaaaggagataatgatacgcagatgattaaacaaacaaaatcacaccaccgggagctccagttcgacagagagaaacaggatcaacgagaggaaacagagattcatcgatccggcagctcattgaagacaaaaacaacgggacatcagatcaggcaaccacccgcggcaaagcgagccattcgaggcagcaattagccatggcggcgcctgatctagcggctacacggcacagggggcgccgcatttccgccgatgcgggagcctgcctagcaatcttagcaaccactgacgactctcactgaagaagtaggagaagaggaaggcttagatcacacttacagcgggggcttcctatgggcatcaaacgatacacgcacagctgggctcggagaaccgcgccccgccggcgcggggagggagagagaagaagcgagcgagcgagcccgtcgtcgtcggcggcggcgccggctacggggagcgatcgcgtgagggggagcggctgcgtcgtgcgcaagagaggagagaggggagcggggcggcggcctggcgctccgggggacggacggatctgagccggagaagatggtccatggcgatgcgtgggtcggattaaactaatcttcctcgttgccaacaactaacccaaggcccagctgaggcccatgcgagcccaactatctcacgtttcttttgtaagtttttggaatatcaatttttttttactaaatttcagcaaaccccatgtttttggttgaagttgtataaaaccccagttattgcacataacctcgtaattcttaagtttcacaaaacaccacacatatacatatttggcaaatatttacttaaaattttaaaacatagaatatatacaaaacttttagtcgttgatttcttgattaaggttatcagtttaactcttcgctactttaagaaatattgtttctgatatcctgaaatcaattgaaatttgtatcagagtgaggttttatgaaacatttaggccataaaacatgtgattatatgtcgcaagtcatcacacgtgtgattgtctacaactttgatcataaaaacgtgaggtgttatgaaatttactccattttttagcaactttcaaatacccacttatacaatgtctttttttgggtagcattgctaccattggcaaaatgttcaagaataaaaaggaacatgcttttgtcaatcacaataatattccagctgtagcagaaccataacatggttaattcctgctcaaaatacagattacgagagaatttggttcgtatacctcctggattgctacttgttgataagtgttgaatcgtgtagcaaaatggttcgtatacctcctgtacctcacgtaagagcatctatattgataaagtgtagcctctatcactaaccctcaacctgacaatatcccatctccaccaccatatatattgataaagtgtagcctctatcactaaccctcaacctgacaatatcccatctccaccaccaaacactgctgccttgttgggcactggaaaatgttcttccaagcagcttgtgtgttcttcaagccaaaagtatgtctttgtctatcttcaccatccgcaccaacttaacgtacaggcattggtgtggagtagctttcaccttgacgtgagaaggagcaattgctattcttcgatggagttgtgcggatccacattaccgtcgaaattagcacccgtggacccaggttttcactctacttcttgccttccagtgacttgagatcagtttgtttaagttcaacaaacttcccaattctgaacatgtaacatccaacaagggttaatattcagtgttatttttcctcccagtctgtaagaataaatggaaaacaaaaaggtccaggataccaaattaatttatcattttgtgcatggaatcatgcctctaaaatgatggcataccagttatctttgaatcagccaactatactggacaggtcttagcatgcctgctggcagatgctatcaagtatacagcaccatgttacctcacaatatttgacaggtcttatgatatagttattgttcatatcatttacagcaagaaagtgccatgctctttcttgcgatgtttcatagacatgatctttttcttacagtatatagtgttcagtgttcatatcttttacatgaaaagaacatgtcatgtcgagtaggtgctaagatgctaaaaagacagtgtaaatgtataatggtccatttcaaacatatacagatgtggtaaactgcattacctgagatctggtggaagcctgaacctgcctatccgaacacgtttcaaggcataaacctatcaagaacaaggataaaatatcagctacttcccagaggggggaaaacattccaaggtatacaattccagcaaaaaacgcacttactggtacacaaggatatatgcctacctcacccataagaatataagataagtgcacttcttagacttcactgttgtttttagaaacacctaagactaggaagaaatcccaagctgatgtgaacaaaatctttcagacaagtgatgttccgttgtacaggtattacagttagtacaatttatcttatgcactgtagtgcttgtagaagcacaagaattgagatctgcaaagtgctttgagataatatcaactaataaacatgctaggcatctcaaaagctactgttctaagaactatatagtagaatgtagtatatcatcataagcaggtttgagaagaaaaactctgaagcgcaatgtgctaggtgtatgacatttttttagtaagtacactatgtctttagcacactgctaatctctgtcgttgtaatattcgatcatcataataatatttctgttgaaaagaagactctgaagcacataagatgcatttcaatcctcttctaaaacatactgttaatttgtcaatagtgctactgatcattaatcgtcctcatttctaacaattcaatcagataagggattaacaaacaacatttgctcttgattctagaaccaaattacttgagttaccaaatttgatattgcacaatgggaaatgttaagatatgatcaataaaacataaagggaaaacttgagaaaaaaaatattgagcatacaaacaaacctctaggcctgcattctgcacgagttcacgaacttcatgatttcttccttcatgaacctgccagacattaaaaaaaatagcataccaatgagtagatgaccaaatgctatgcctttgcaagtttacatctctatagaattgctttagttaagaatacatgcaagaattttgagcaataagtccataacatattgatgtcattgaaaatactgtatgttgcccagagtagtgacttttccttctacactggtttttactcacagggctgaaatattatcaagaaatggttccaaattagctggtaacatgttaaaattatttagctagttttgaacaatgcgaaacatattattgcttaagctttgcagaattaccagtttcttatggtttccacggtttcaatcatttgaaaaagtaagcaggtgaggcaaattatcgatccaaccaactgcctgttagacatttaaagtgaactttacataatcactaaccactttagcttgtcatgacatttaaaaataaatcttgaccgcaagatactatctaaagagacctttcgtgtgtcatgtatcatgttgtatatcccataaaggaatgataggatagattcattgctagggtatatttttcactgaacagaaagagccaagttgcctatcttctacattatcctatgaagaatttggaattcatgaaacagacagtaaagtcaatccggaatctaataaaatgaggtataatagaaaatataagtaccgctattctaatccgggtcctttttgtattggattgtacatccaatggttccactagatcaggtatacatttgacgccatcaatttttgtgccttcactgatagctataaggtgatttctgtgcactggtccatctatagttaccacatatctgcaagatcaaacaactcaaagtcaatgttggtttcatttgaaatttgataaaaatgatatttcagatatttcttttcgcaattaccagtgcatattgataatgaataaatgagagtaaaaaaatgtgaatattagggaatggcctaatatcaaataaatagaaaaggtgaggcttcgaacccaggccggctagcccaccaccttgtggagctagccggaagacccctaggcgtttctccaaataaatgagagtgataccaacagactgttaaattttcttctacaaaagatctggatagtgtctacagtgttcctagtacgtgattttgtattactgtacttcgaaggacacaagaagttgagcttactccttcattatatttgacgaagggtgtgagagtttctgggcaaactcacctgaaagagaaacaaactaactttaggtattggatggtcaaaatattgattcccaagtatttattatgaaatacaatgaaattaccgtcatttgtaattattatcaaaccacttgtagcaacatcaagacgacccacagtaaacaagcgcggttttggtactcctggttgaatcttgttctgcaaatgttaattgaaaatggaaaattgtaagtcctagctataaagcataagaggtgaaagatttcacaaatattaggaagtaccatcactataaaaaaaaaagaacatacccaacccttcaaatagtcatcaaataaggagataatggactttggttcaccacaggaacaaatatacctgcagtacattggaaataacatttagatatgttgctcatatggactgctgcctccatatatatttcaaaaatgctttgatggaacaagatagcggaatggaatataagagctgacccttttggcttgttaacagcaaaatataacttcggaggaagcttcttggaaatgcggtttccattaacatagatagaatcctttgagatgtcaactttggtctacataaaaaagaatgtataagaatcatatgtaacaaataataaacttgtctatgaatacatttgaagcacatggatcaaaattcatagtaaaatgacctagctaaattaaaacaatttatattttaccgcaatagtacgatagctggtctcagaccagcaccaaataaatgaggataagagctaaaacattacttagacatgcaacaaacttagagaagtagcatttcatcattcataaagctaaaaaaaaaaacatacctggggtgcagtgcagacagaaccattgacggtcaccttcccttggaagatgagctcctcgcatgtccttcgtgaggccactggaaggagcaatcaggccagcattcagacaactgatgtgttgctgtaactaagtaatataactttgattgaattgattctgtccaattcaagcacttcagtaaaatcatgcgtgataggaagactacctcctgccgcggcaaggaccttggcgagccgctgcggttcgtgctccttgatattctcattgtagaatctcctcgcggccttggagaacttgggcggcgccgtcgcgggggcggacttcctctccctcaccttggcattggcgacgggggtggcaagggcggcggcgcccttgtggctcctgcgggggtccttcttggccttcttggcctccgcctccgccagcgcaatggcctggaggacgtccggcggcggcgcggtgcgcatggacggcttgccgtcctccccacgcacgatccacggcaccacctgctccgcggacggggcgggggatgagggtttgggtttcgagggggcgggggcggtgggctccgcgaaggtgatgttgaagtccggggcgctggaggtggaggaggaggcggcgcggaggaggaggggagggaggcggcggtggcggccgcagcggaggagcacgcaggcggcgggacgggagagcaagggcgggaaggagacggccgctgccgcggcggcggcggcggcggcgagggccatggctcgagagtggagagtgtgggagggggtttatcggttatcggatatgcccgcgacggcgcctgtttggttgcttggtacgcctggcttgagacgtgccggaggggagaccagcccgaacaacgttgccacactgacgtcagttccttttttttttaagaaagaaaacgtcaaatggggtcgggattaaaactccgaccccccctccttcgtttcgagaaaattaaaagtcggcgatttagattttttttttaaaaaaaaatacacgacagagattatagatgcataagtgcacatatgcaatatcacgctcacctccacaaatacattctctataatgtacttataactctaaaaaaaataaccttgtttagaaatatgaaaaatgtatgttaatatagtcatataaaatagcactatgctgaaataggctaaactgttccgatataatacatcaaatcacaaactcgactacttgggcaaataatgccccccccccccccaaaccttgtttggacaattggataattggattatcccttaaaagatgtagactaaacttgcaatattccataaatatgtgcactttaggatcagagactaaaattttgatcccttcctcatttcgtttagattaacaaaataccaccttatagtatattcatcactatttaatggcattgtgatatcttttattggatacaaactagagagtaacaccagtcatatagtacaactatttctaactagtccacatttcactttatgttttgtatgaaatactccctagaatttagtttgatggtttcactgtagcttagttacatgttttatgtttgatggattcaccgtacaagcagttgtccatgttcatctctataattttttttttctgcacaaaaagtgataaagaggagattcattaataacgccatactttatatgttttgccattaaaggaagccaaatcctctctcgtagggaacaagggagaactaaatactaaacctgattgaaaaacggttaggaaagctatattgttttatagtgtgacaatgattggtttaactttgggttaacaactgttatttttttcttaaaaaaaaagggaagcaagaccgctgaaaccgtccttgttgtcaccgcagaccaccttacacaccggataaaacaccccaaccgggtacgggctaatctgaccccttcattctttcttaaagctaccaaccaacggcccagatccaacatcctcctcctgtggccaagaacaaaaaccgaccaagagaccaagcgccggccaccacaagaaaaaaagagcgcgcacgcatcgcctccccaaaaaatccacccatttttccgcgatcccgtgcgcatctcatcgcccccacctcgtccgccatggccgattccgccgcagccgcatcctcctccctcccccgctcgctggcgtccaggaggccgctgccctcctcccctctccgcggcgggaggccccggtctccccgccgctgccgcttcgggtcccgctcgctccaccggctgcgagctcgagctgggaaggacgatcccgaggatctgtatgggccctacccatgggatcagtccttggatctcaccactggcctcggtaagttcatgcccccacactctccctgatcgttctggttggtatccgaattcgaatggttcttcgattcgacggcgagcaatgagctgggggctacttgcgctagtcttgcggtgggggtgatggttgatttcccagctgttactagtctgtgatatgatgatgaactcattcattgttctgcagattttgcttatttcactttgtgagaggctttatacttgcgtttatggcgtggctttatttggggttcaatctctgtttcttaacagatattcagtgggtgccagaagatagagtcacactgttcacttctgatgggcttgttcaaatagggggttccctggttcctcgtcgaattactccatcagaggtgccgaatcattcaacttgggctcgtttcattaatcgttcatttttcagtaataaactatgtggtatattagaatatcttgacattcaagtaggaaaacaaagtctcttgcatcatagacagtagtaaatttattcttgtcagtaaaactagggtgcatcttcagttcaggagtgagatatgttatagatattgcagacactattgttcaatgatcaggaatgttctgttccagggagacatagtttcacattaaatcagtttcaatctcttttgcatagtgcatcacagcctaacttcatataattcaatcatagacttggatagatgattagactattaaaaatgtttgacttgtcactatgctaaaagtgcttatattttgggacagagggagtatcaaacaacaaaaactttttcagcatcctgaccagcatcaaatgttccactatgaaatataagctctttcacacctctgttcatgaaacatttggatatatgcagcagtacttatggaaacgtgtcatgtcagcaagaaattgaaggggaatgaatccttgaaaagcagtatcacatacattatagcaccaattttgtatctcccatggtggcaccaagctaacaccatagagtagtgtacgtctgtcatgtaatgttggagtatcttattgcataaacaaagcatgccatatttatggatagccgtatctttttagtatttgtgctcgcattcagttcagttgacctgaaattatatccaactgaaacaaattccaagtcgattacaagtaatccagtatgaaatctagcacagtgtgaatcatctcaagaacacgatgtatctcaagctgacaggttataattatgatctgtgcccaatgtgctagtttagaccgaatcatagtaatgtactgaattacttaaattgtgctagttatgaaatgataattacttaaaagatgttgattttagatagaactgcaagttttattatgtattcaccattatttcccatattatctgtactcacttcttttgttatattttgaccagaagaggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttttgagaaaaaaaaagatttaaaaatggcgcacatggacaatgatgtggcgttttatactgaagtagattgcgaagcaaacataacggtgcccaaggaaacatgccaggtgtagctaagttttttctaaaaaaaaacttaataaaaggttgagtagaaatgctaaattgtcaatgtttttaaaggaggaaacatctatctagtcagctcttgttacatttggattttttttagaactttacatttggatactaaactgtgaattgagtaaagggcgccaatctgcaggttgtcacggcagagaaggcaagcaaagatggcctccaggagaagttgaccatgtctgttgcagtgccattgttgtggggtgttcctccagcatcagagaccctccatgtcgcggtgcggagcggtggaggcattgtggagaagatctactggcaatgggacttattttaaaagtcccaagccgtccagtcattaacaaatgatccatgccacggtgtaaatactcattcagtctaattcgctgctcgcattgtgtcagcaattgtaaattgtgcatatatgtaaacagaaaactttggaatctctatacatgtacagacatggtcacacccctgcatataagaaactgtgagttaacagctcaacttctacttttatccttggtttaatatttaccagtgaactgtcgtcaccgtttgagtattggaatattggagatttggagtaactaaacaatgcgaaccagtcattagttgactccgggaatcgggagtaactaatccctggcctatgtcattgtagacacgtttatgagttttggagtagtaactaatgggttgtttggttgatgcctaagcttgccataactaagcttaggtaagttgtagcatgtggcaaaagtatggccaagaaatagttagccacaagtgtggcaatgttagctctagttatctgagtatgacatgtgggaccatctaaatatgacatgtgggacctaagggtagaaaagtgtggcatgacacaactgtggcattgaaacaaacacacgcctaaaaactgtggcatgactgaaatgtggcgtggcaaaatgaagcaatcaaccaaacaccccctaaaacaatgtgttgacttcgggatttgggacaagattactctgtgttttatattgtcgctgggccttgatcatgatgagttgatgatactccaggtgtgatgcttcctgcactaacccgtgctagttgtcgcgccggtggtgtcatgcatttagacgaatcgaaaagacattttcaggggcgttagggttgcgagttgtgggtcgtttggactgtggagatcaggccaggaaccaggacgacgatttttaagacctttgcaggcagtgcaaggctgcaaattatggcattttcgcttgcgtttatacttataagctaaactttaaatttgattttttcgtcctagtttatttttagtatttacttttgaatcgctaagaatatatataaaagttttactcgcagataatttttatttgctaataagtgatttcgaatcaacgtatgaataagcgaaacaatggaatggcctagtaagagatttgttcaaacatccctttcatcctccaacatgaggtcgccacaatgccacttgccatttttctggaccgtaagatagttgtccaaataccaaattagccaaacagtagttgcgtatcgggatttataatgacgaactgttcaaagctttattggacttcacctagatcaatccggttgaggttgacactcactctctccctcgtgcattcagatttgtgacaagcaagaggggatctccatcgcgtgctgcattctccgtatggaccgtatattcagatttgtgacgagcaagaggggatctccatcgcgtgctgcattctccgtatggaccgtatatagccatggtcgtcgcctctcgccgaactgaaattactccctctgtcctaaaatatcttatctccgttatatttaaatatagtaacctagtagtacaatgtttattcttatactatttgctatattttgatattgagagagtaacaaagagtgtgtttagttcacgtaaaaactggaaatttggttgaaattggaatgatgtgacggaaaagttgaaagcttgtgtgtagaaaagttttgatgtgatggaaaagttgaaagtttaaagagaaattttggaactaaactcggcctcagcatcaaacatgatatatattactacaaatcagaacagtaccacattgatagaaatcagaacagtaccacattgatagtagtaggatatgttgtatccaatcgtaattgctacttctttgtttcacaatataagtcattctaacatttttcatatttatattgatattaatgaatctagatgttaatcacatcaatatgaacgtgagaaatgctaaaatgacttatattgtgaaacggatggagtatattttaaaattaaaaagtaggagtataaatctatgtgcgaaagttgaatctcgtgcatacatattgaatatgacctttgatctagacggtcgttcctatccactgtaccctaggtatctccatgatgcagacttcgacttcgttttcattccacttccatttgttcgatcatgaatgtgttggtttaactattatgggagtgttcggatgtcccttttcctaactcacatctctcgttttctgcacgcacgctttttaaactactgaacagtgtgattttttaaaaagtttatatacaaaagattaatcacgcgctaatgaatcgctccgttttccgtacgtgggtgatgggttcccaacacccaccatcgaagacaacctatatgctctattgctcattcatgctccacatctactaccccagtttttcaaaaggttctcgaattggattgacataaatccaattgatatgacggcgttatggttgattgttatatgttcggaaggaggtgaacttcttcccactacacaaaatatgatgatttattggggaagtattaaagatgtggtagtgaagttgtgggtatgtgactccatttatcagggttcaaaacttcaaatcatgttgtcacgtatgcaggtggactttcaacaagattttcagggatatgccgttggttttcgtctcttatgatgcaattgtggttgattgttatgggttcagaaggaagtgaatttctccccactaagcaaaacatgatgattcattgggaaagcactagtagtgtggtggtggagtcgtgggtgtatgattccatccactaggatttaaaatcatgttgcacataaatattagaaatacgcacatgcaggtgagattttaacatgattttagtgagattaggtatatgccgttagttttcgtctcttagagtatgtgttaggggacgttcgtagggggtgtgagtgtagtgttgcatgtgtagtggtgtaatatataatgactcattagtgtacaattaattacttcatccgtcctaaaataagtacaattctctaaatttgaattagaggcgtgcacttatttcgaaacgaatgaagtaaatattagttcaaaatattttaaaatatatattaatatgttttttacactaatttatatgtaaaaagtttatataaaaatatattattattcgataatttgaaaaatatgcccatgaaaagtttggaaaagtgaagttagtaaaagagaagttgggaaaggagcagtactacaattctacaaatgtacaattcaacagaatttttttgagaattaatattatttttatggaaaatcgcaaaagtagtggtcaaccggagaaaatcgcgaaagtaggtccctgtcgaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggagggctgtcgaactgcccctgttcgacaggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattattttttgtatatttgaatgataatttgtcatgattcattcgaagggtatgctactgagtaattatccgaagaagtttatgaaatagtactgatagtactaagttaatcgtaaagtgtttctcaaatagtacagacagaacataaatgactaaaagtttaatacaaatagataagtcaaggacgatcagtgcccttcgcacgcttgctaggtcctcccttctttctacgcctaatctgctcagtgggatatgtcaaattatcaggggggtgcctatctctagctgcctactgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttacacaagaggaagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcaaggaagttgtgaaggatgctcgccacgtcgtcaggcctgacgactggaggtctcgcctctagtctttgcagcagggtgtcggactccacgtgaacgtgctcaacaaattccgcatgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtatcgtcggctgaaccgtggtcacaataactagctcgtaggaaagcccgagcccctttctggagtacctgcacaacaacaaattcacacattagaaaaaatgttgtgcagtgatttattttaaaaaatgtaggattaaacaactgtgatgtg

SEQ ID NO: 685 - DNA, 3015 bp, Oryza sativa
tctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgatgtagatacagatattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattatagacgcaataaacgtaaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcactccagcttcatccataaggttcttgatcctgcgcgactggcgatgacccttagtatcaactaataaatttgagtcaggaacccaattggtttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctgtattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtgacccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcatcatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaataggaacgacatggctatccgcgtcgactccgatcgcggttagaattgttcctctgtacttgcttgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccggatttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttggtttcgttgtcccacagtgttgtatcttctccttccactacaagcgcaaggtattcctcgttttccacttccatctgatccactaccgcctcattctccttcgctgcatcaacacgcataggcgaatcaggttcttcatcgtccaagtcgttggcctcacgattagtaccacgaacaatgacctctccttgtgtattaccctctactacttcttcccctcgaccttgcttagtctgccaaacattttcagcttgtccaccttccaacggagtttcttccaccacggcatgacttgactcccccgatcgatcaacacatgttgtcttctgcaccactattgccaggctatagcctttctccttactttactaacaaactttcttcaactcccagttgacgcaacctcactactcttcactgccattcatgttgacccctcactggccacacggcacttatgaca

SEQ ID NO: 686 - DNA, 1870 bp, Oryza sativa
taacacttttctaatttattgacaccgtattctttctgttgttgaatgttacttgtataagacagcggtggtatttgcggtcttgcggaggcatacgagagaagggcggttagttttgcgggcaaaaactaaccgcagtccctatccacgacaagcgcagaaagcaaaactcaccccccggcccccaccctgagccttgagacgcgagcccacgggccgacgaccgcgcgcaaccacagccaccgcccacaaactccagtacacaccgcccgcatccccccccattcccctcatacccacacccgcgacgcgattcccccgcacaccgtcttcgcaatctcctttggtcggctgcccaatcctcccttcccttcctctcctcaaacccccccaacccaaatgctcccctccgctccccgtccccgcctcccaaaaccctagccctctcgccgcgcgctccccccctgatgccgccccagcctccgccggcggcgtcggcgtcggccagtgccccggatcccgccgtcccggcttggctcagggggctcccccgcgcgcccgagtaccgcccgacggagtccgagttcgccgaccccatcgccttcctctcccgcgtggagcgcgaggccgccgcctacggcatctgcaaggtcatcccgccccacccgcgcccttcccgccgattagtcttcgcccacctcaaccgctccctcgtctcctcctgcgacgcccccgcgccctctcccgccgccgcctccgactcgtccattcctccatcctcctcctcgccgccgccggtctccgccgcggtgttcacgacacggcaccaggagctcggcaacccgcggcgtggacgcccgacgccgcaggtgcttaagcaggtgtggcagagtggggagcggtacacgctcgaccagtttgagtccaagtcccgcgccttctcaaagacgcacctcgctggactccacgaaccgactgcgctcgcggtggaatcactcttctggaaggcgtcgcggaccgtccttctatattgagtacgccaatgatgtccctggctctgggtttgctgcacccgtgcagttgcaacgcaagaagaagcagaaaagagagactgccccgatggacgaatgggagaagagttcaggctggaggctgtcaaatagcccatggaacctgcaagcaattgcgcgggctcctggttcgctcacacggtttatgcctgacgatgttcctggggtgacttctccaatggtttacattggcatgctgttcagctggtttgcgtggcatgtggaggatcatgatctgcatagtctcaacttcctccacactggcgcacctaagacgtggtatgcggttcctggtgatagggctgttgagcttgaggaagttatccgtgtacatggctatggaggcaacactgatcggatcggtatttgtcttatattgtgtttctttatccagatcttgtgctcacgcgatggtgcgaatgatatgagttctggttggtttctgcagcgtcactagcagtgcttggtgagaaaacaacactaatgtccccagaggtccttatagacaatggtgtgccctgctgtaggtacaagttctgaaaccgtcagcaatcaatacaccaatcttaattaatttatgtgttgacatgcattgtatttcagattggtgcaatatcctggtgagtttgtggtgacattcccaagggcttaccatgtcgggtttagccatggtgggttaaatcatacatattttgaactcacaatacttgttatttgattcatcagtatgtgctagttgttaaatcatctgaaccttgtatgctttaatttaatttctttatggtattgtcaatgaacac

SEQ ID NO: 687 - DNA, 28176 bp, Oryza sativa
  unsure (1)..(28176): unsure at all n locations
nnnnnnnnnnnnnnnnnnnnnnnnnnnnnnnnnnnnnnnnnnnnnnnnnnnnnnnnnnnnnnnnaaactgaatatccaatgcagtcagcagcatgtcatgttcagtagattccttattttattttgttgctatgcatgctatcggcaactctaatgttcgtgtaatataatacaggattcaattgtggagaagctgccaattttgcgactccccaatggttgaagtttgctaaagaggctgcagttcgaagggctgtgatgaattatcttccaatgctctcccatcaacaactattgtacttgctagcagtttcatttatatccaggtttttttttctttttctttttggagtttggttttgtgctgtccaaagtgtctttttagtttttgcacctcattaataggttgatgaaacaaaatatattacctttgtcctccaacaaaccaaatgctacagctagtgggtaggggttagatgcttgttaggtctgccatacagaaggattacgcataaccgcaaaggtgaagttgtcatggtgctcctgggagacgccgcattacaggatcaccacaatgctaggtgtaagctagacttcaactaaatcacattatattccaagtatatcagatggaaatataaacggcaaatggaaaatgtagcgcataaaacccactcaagccgctacacccacccgctacccagtccatgagcccatttctccaccctctccctcatcccctcccctaagctgtactctctctcctctcctctcttaagtcaccttggattctagattgcccaactctatatgggaagctaaggcttctagagtccctagggaataggaaatttgcattcatagtttccatatgtattttttgtgcacaacagttttgatgataagttgtatatgtttttttaccttcatacatatattttgcataagttgtttatgttttacataaattggtatttgctagcttgccgctttacattttgaatctggcaatggtttacgttatttgtagcatagtgctctctggattatagtagatgggacaccatgattgaaggttactctctgggatagttatccaatgtagtaagaactcataaagggttttagatgtatcatatatgtgaacaagtgtttgcgaaggttcaggctctagctgggaaacagatcagtgcttagcacctaatttaccctaaggtggacctaggagggtctagggtggctgcctaggagggaagatggctttgatatatatattaaaactgaccattctagatgttaccagaataagttacaactgactatggctgtgttcggcaccccttcttcccaacccatctcccttgttttccgtgcgcacgcttttcaaactgctaaacggtgcgttttttgcaaaaagtttctatatgaaagttgctttaaaaaaaatcaaattaatccatttttgaaaaaaaagctaatacttaattaatcacgcgctaatggatcgctccgttttccgtgagcactgttcttttgggaacagtgccgaacacagcctatatcttcggacatggaaatctgaaatgataaacaattgaaacaacagaagaagccaaaaggtccaaaatatatgctttatcgaaacaaaagaaatggaagtaagtgctgatgattacatccctatggattctgccactgtaacaattccatgtttgttggaagccatcaatattcactccccaaagagaagctaacaagcagaatgttggctgtctgcatccacacaaattacttgccttttttatccattgttcattttgttttgaaagcttctattgttcatttgttgctcacatgattgccttgtgttttggaatttcattgattattcgaagtgtttaatattgaagcactcatttgattgtatattttaatcattacctctaatgctttctgtgcccatttatattaacaagtatgctaaatcattatcatagcacacacttatgagtctgctggattcattttattttcaggaaccctagagaactactgtctggaatccgaacttctcgtctaagagatcgtaaaaaagaagaccgagaactgttggtcaaacaggaattcttgcaggatatgattagtgaaaatgaacttatatgttcatttcttggaaaaaaatcggttgataatgttgttctatgggagcctgacttgctgccatcgcttaccgctctacacccctgctcgtcttgctcaaaagctcctgaaaagaagggtgaagatggtcccagaattggatctacccaatccagctcaaaagatgacagctcatctgatggtactgcatgtatgactgggacacaatctaaaggcttgtctatggatagcaaacaagctcctgagggagaaaagcttgataccgatgacggagatgacctgccttttgatttgagcattgattctggttcattgacatgtgttgcatgtgggattcttggctatccatttatggcgattttgcaaccttccagaaaagcactggaagaaatttcccttgttgataaggaaagatataaactgagttgtgaaaaagagatttgttcaaatgtgcttccgtgctctcctaatgatggtagctccggtatgcctttattatctttgaagattttgtgttttagttccttatttataaatgtaggaaataaagtgaatttgtatgatggttgtagatctttttttttcataagacctagatattcttcaagtgtcttgtttttctatgtccaataaattaattgcgttcccagtgtgtgtacttcacgttgctgttgttctagtggccttcagtgagctacagtgaggcagattcttttgttatgataaacctcggcaagagggaactgttgtcatacacttgaacatatattttattggaggataatgaatgtcgactccttagcaacgtataataatgcacacaagggtattatgatcatttggactcaaatctgtaatcctctcaaatgtttatgttatgcctgcaactaggtttagtaccataatttttattgtacagtgtgcgttgttgcttgattactacacaagattaatataactgtctttttcgtcaataagttagagatagccagacttttgtctagctgagctcttggtatttgtattactgaagtgcatgggtttccatccatcatcctgagcatcttctatgtttcaactttaatgatttgttctattttcttttcatgtacaaaaacttgacaaatgtttctcccccatgtatcaggatgcccactcatcgccaatagatcgtccagccctgtggaaaatgctaacctcagtcatcaggatgtgaagccaattagaagtgacatttctttgatgggaaaggagtttaatggaaccctagggaaacatattggcacttcctgttcttgtagcagtgaaaataccattcatccttacggtgacacagaaacccctgagaagaaaataccaagtgattgccctggctcagagttgagtaaacaatcaggcagaggtgatgttaatgtaccagatgtcgaaggtagtgaggaaactatcagctggaatacaggctgtgcatttgcacggcctcggatcttttgcttacaacatgcccttgagattgaggagttgcttgcgagcaaaggtggagttcatgccctcatcatatgccatgcaggtacgattgatgcagacttctgttgtcacattcaatgtaactcccgtagattgtattaatcctgcacactggatgtggaattttatttattgtttatttgacatgtttttgtcagctgaagttaactgaaaataagagatattagccgaggggatttaagtattatgggcccttttgattccttccaaatatcttgaactttttaaatcatgattgaaaatcaatgtagttgttttaactgtgattatttgattaatttgtcccctgaattcagtgataacctttttccctccattatctgcagattatgtcaaactaaaagcacttgcaatatcaatagctgaggaaattgagtttcagtttgactataaagatgttgcactagcaaatgcgtccaagtctaatttgcatctaattaatatttcaattgatgatgagggatatgaggaagagggaacagattggacatcacggatgggtctaaacctcaaacatagttccaagattaggaaagaaacaccagagagtcaagaacagcctcctttatcattttggggattattttccaagccatcacctatttcagttgtttcaaacttgaaatggctttgcaggaaagcacggactccatataaggtcattggttatgcttccagccctgatgttgtggcaactccagacaaagttaagcccgcagttacaaaaactcagatagacacttctggaaatgctcatgaaaacattggaagtgaacaaactctgcaacaagattgtgtcctgcaagaatccaatgatgtagctgatatgtgcaagcgtcccaaggtgaatgatcaggatggacattctcttattaatattccaattgctgttgctgaatatcctatgatgcatcaagtttgtgagcgtccagtaagtgtgagtgcatgtgatgaccctatctgttcatttgattcccaggattcacccacaactgttgcagtgtcagctggcaaacctaccagagaacaatgtggtgctgaatcaactgagttgagtactgtaaaacagttcctggacaatgggcttatcgctgagggaggcagcatgaacttcataagtaatcatgagcacttagaatctgacaatgcaacttcagtgtgcaaagatgaacaattgcaagttcaacaagatcagttggccatggtactttgtaataatcccaacacagaattggttgcaggagaattacatgggggggcagcatcatcaacccttgaaaatgaggatagctgtggtaatacgtcttactgttctgacactgtattaaagaacagcgaacctgatacagatgatcaacctgaaacatgtgatcgtagtgttgttcttgtaacaccaaagtcgagctgtgaccagatgatttctagcagtgacagaagttgcagtctgaccttggactgccctgtctccactgatgctgccttttcaagcgaaaagctgtctatggctcatgatttgatgggcagtgagttgcaggcagtccataattcaaaggctgaggttgtggccagtttgactgatgtcaagggtgctaagctcaatagcattcataccacacaattacctcatgaatctccaagcagtgatttcatcatttcagaaggtgcgcaatctgcttcaacaactgcaattcccagaaaaaatggaacatccatgcacacagagtcaaattcaattgatattttacttggagttctagccgatgaatctaaggtctcttctggaaaggatgaggttggcaaagcttccttgacattgatgacactggctggcaatgaccaatctgcagatgatgtaactcaggatgaagttgcagagatcactgatccgtcgcatggcttctgctcatcagacatagtgtctagaagcattggaagttcaaacagaacaaatatcatatgttatgccagacgcaaacacaaaagaaagagcggatctgagttcaatattaatagtccccaaagcttggggagctttgtccgctctccatgtgaaagcttgagaccaaggactagacctgcgattgttgaagacatgacaaacgaaacaaaaactgcagaagcttcaactgcaaataagaggaagaaggcaaaggtggaagcatttcagtgtgacatagaattttgtgacatgacatttgagactaaagctgaacttcgtgctcaccaacgcaatatctgcaccgacgagtcttgtggcaagcgcttcagctctcacaaatacctgaagcgtcatcagtgtgtacacagagatgagaggccattcaaatgcccctgggatggttgtccaatgactttcaagtggttgtgggcgcaaactgagcatatcagagtccatacaggcgagcgaccgtacaagtgctcggctcctgactgtggccagagtttcagatatgtctcagattatagtcgccatagaaagaagtttaatcattattgataggttgccacttttcatgttactgatgagtgatcacagctgggggcaaaagctctagctgttgaggccatgcttgttgtaccagatcacgtatttaaccacctgacgtctgataggcctagtgtttgttccttcgttagcaatgtgtttagtgtagaaagtagagaaatagttgggggttaaggattgtaccccctgatgcatcaacgtagattttcataagcagctgatctttcccatttacatgggatcattcattctttcttcagtccgtaaagtttatgaatacagatcacttggataacttccaagtaccatttgaaaaatgtgttaatgtctcatggtctcagtgagcacattgctgtctaataataatatggcttacgatatgacaactattgttgttgggcgatggtatatgaactgtgctttcatccagatgtttttataggtgtaaccgtgtaagccgggaggcgaaattcagcgtgtccttgatgaattgaagggaaaataaccaaaacaaaaagaaacacacttctattgttgcagtattctattacacctcgaaagcctggactaatcaacacgaacggagtaaaactcgaactaatcaatcatttaaccatagagagaacacttattaacaaacttagatggttcgccctcaagaatgctactgcttctccactcaatcttggtctataatttacgcggaaggcgtcttcttggagtcgtcatccttggttcttcccaagaggtcgccgacatttggctcgccgaacatggtgatgccctggcgagtacggagggtggcgtactcgccggcggcgcggaccttgttcttgaggcagacccagtgatcccccgccggcgcgtccttgaactgccggaacaggtccttggatctctccttgaacgtcgcctcctcccccaccgtcctccggtagcacgccatcgccgccgcctccttctccggcgccttctgcgtcatcgcctccgcacccttctcctccatcaaactctctccccccgaagaattttgatgatgttttttggctgtcgctgttgctacgatgatttgggagaggtggcgtcgtttacattttatagggtagtgtttttcttgagaaggaagctgagcagcaaggcgtggagaggaaaaagaggcggtaataagccttggagtagggaagaagaaagaaggcgagcaaaggcaaagccaccgtccgatcacaattactagtagaatcattaatcatactatcatcttcggattacggaagaaaaactttcttttcatgaaagaaagaaaataccaatgggctgaccggcgggtgacctcttctcatgatttttgcctactcgcaaagttttcaggatgatagaattgaatatttcaattttatgatagaaaacttgccatacaggttggggtcaaaatgtgtagtagattatacaagaacgttttggcttaaatgtctttgctgatcaattttacatgcaccttatactgtcatcaattggatttcgatgtttgcaaccaatctgactaactggacgtccgaacaagaatacagcttgcattaaggcctagtttagttcccaaatttttttctcaaaaacattacaccaaatctttggacacatgtatggagcattaaatatagattaaaaaactaattgcatagttaggggggaaatcgcgagacgaatcttttgagtctaattagtccatgattagccacaagtgctacagtaacccacatgtgctaatgacggattaattaggctcaaaagatttgtctcgcggtttccaggcgagttatgaaattagttttttttatttatgtccgaaaatcccttccgacattcggttaaacatccgatgtgacgtccaaaaattttgttttagcaaactaaacaggccctaaagcctcatgcaatatgcatccgattcaatcatcatttagataatacagtttcgtcaaacagtggttgatggctgtggtcccgacaagaacaaagatgaatgtataagccaatccagctagaatgatactgttactagacagtttgcagaaagatcttgcttcagaaactcaatctgggaagaaattacatgttcctagaaacaatgtagattccagtaattgtaaaaaactgttcaacacatcccaggagcgttgtttcagctcctacttctgttgtacatagttgcaggtcttaatcaaaatatctgtgttgtggtcagatgatgtgtaacattttagtagcatatgtgccgcagtcacatacattttcgttcatctttaaacaacatgaatacatgacccagctaagacattcatataccattggagcttttactccacttcttccatttttcttttatatgtttccttgccaggatggaagcatcagggattcaggacacaaatgaaaatagcttagatgataatgaataagacatgggaggcaaattgcactgaagccatgtgttactgaactctgatgaatcaacttggacaccctatgagaaatttgataccgaaatcagtgtggttcaatcaagaatttgataccgaaatgtttcagatcaagttcatgacataatcaagctaaaacatcactgtaattcatagcaatgaagaaccgatccaatgcactgaatcactatcaagaaatacatcaccacaaggagcagataagtggaaccaaaatccactacctttattatcactaatcactcactcgagattggacagccaagaatcgacgtttccatccatggccgatctactccgccgccttgctgcctcccccctcctcctggttccccttgtacttgtcgagtgcagcgccggtgaggcggcagatgcgccactgcgggagcacctcggcgcccatcccctcgtagaagtcgatggcgttcttgttccagtccagcacgcaccactccacgcgccccatcccgagctcggcggccttgccggccaccgcggacagcatcatccggccgagcccgcggcggcgccacggcgcgcgcacgaagatgtcctccacgtacagcccgggcttggagaggaaggtggagtagttggggaagcagatcacgaagcccgcggtgacgcgcccgccgccgcgaggggaggcgaaggcggcggcctccgggtcggcgagcggggacgcggagaggtcgaggcagtgggaggcgatggtggaggggccggaggcggggagcggggacggggagaggtcgaggatgagggcggtgaaagaggtgaagggagggcgcggcggcgagggaaaaagcgtggaggtgaggagctcgtgggtggcggcgaagaggtcggtgaggagctcgaactccgccatctggtggatgagggcgtggatgtggggcacgtcgctggagtccgccaggcggagctccgcccacacctcgccggagaatgtggtggcgttcgccggcgtcgccatcttcgcttgcgggcttgcggcggagacgatagggagatgtggcgactggcaaatggagagatttccccccccccccccttgtgtgactttttatctggagtaaattttggaaaacactatagattttaaagcacatttcctcagtttcatattatacctcgattgaattttttaatcatttttctataatttaagtttgtatcaaaatacaatactaagaattataatacaaaacaaatattgtattaaaatatagtcaacgttaaatttaatgaatgaaactaacttactgtcgtagatattactatttttctctataaatttagtcaaacatatataactttgactaaggaaaaaaatctaacgataatataaaacgaaggagtactatgtaatataaaatcccatatattatgatttattttagaaaataccagatactaagagaaaatgtttttgaagaatccccatatttatatcacatgctcataatttcattaatagttataatattttaagtatatatttacattattaagctcaaaatacacatccctccggcataattcattttttcctttactattatacaattgaaaaaacacaatacaaatatataaccggttgcttatatatataaaaactaatgatactaccaataatcgaaaaaaatgatatgtactctgcaatatctcgtattattattatcttataattattatacataaatatattaaaaacaataatataagcttaagatattttaccttaaaatctgagattcactgaaaaaaattataataatttaggttttatgttagatatgcctcgaaatttttatgaattttactcttttatatctatttttctattttccttttttttttgtctagtgtgttggcttttaaaccccccttgaccgaagtcgcacgcgccgccataaaccctaaccgcagcgacgcactccacctcctcctccaccacgccgccggcggccgggcgccatggtgaaggcctacctccggtacgagccggcgatctccttcggcgtggtcgcctccccggagtccaacgtcgcgtacgacccctccggccgcctcctcctcgccgccgccctcgaccgcttcgccgcctgggacctcaagcgcggcctcccctccctcttcttcgccaccggcgccccgtccccctccctcgccgtctcctggcttgccacctttcccttcggcggcttcggcttcggcttcttggtatcacacgctgaaccttcctccctttccccttttgcggtttaatctctccgcattttgagctggtttcatcatctcgtgcgctgtgttggtttgcttcagattgcgagtgggcacgccgatgggagcatcaggctatgggacacggagaccggctcctgtgaggcgaccctccatggccaccgctctgcggcttccgccctcgtattcggcccctctggcgccatcatcgcctctggcagtaaggactgtgacattatcctttgggatgtagttggacaggccggcctttatcgactccgtggccaccgtgatcaggtatactacattgtgcttctcttctctgtctctattgggtagcaaagttcagtcatactaatctggcgattactcgctgtaggtcacgggtttggtgtttctggattcagggaagaaactagtgagctgctccaaggataagttaatccgggtttgggaccttgacacgcagcactgccttcagattgttggtggccaccgcagtgaaatatggtcaattgatgtggatcccagcgagaggtttttggtgtctgggtcggccgatcaagagctgcgggtgtttacggtccggaaatctgctgaggagggtgaggattggagcaagtgggatatgctgaagctatttggtgagattccaaggcaaagcaaggaaagggtagcgactgttaagttcaataagaacggtaatcttgtggcatgccaggtggctgggaagacggtggatatttatagggttcttgatgaaacagaggcagcacggaaggccaagaggaggatgcacagaaagaaggagaaggctttggccaaatccatggctgctgaagggaatggtactgttatagatcctttgtcggctcaagacttgcagaatcccactcctgttgtcaccgatatatttaagcttctccatgttttgcgggttaacaagaaaatttgctctgtcgcattttctccaaacaatccaccaaaaggttgccttgccaccttgtctctatctctgaataataacatgcttgagacatactcagtggataatgagaatgtgtcgaatatgtattccattgagatgcatggacaccgttctgatattaggagtcttgcacttaactcagaggacaacctcctgatgtcaacaagtcacaatgctgttaagatatggaatcctagtactggcgactgtctccggacaattgattctgattatggattgtgcagtgcatttgttcctggaaatcggtatgcccttgtaggcacaaagagtggtactttggagattatagatattaatagtggaagctctattgaggttatagaagctcatgctggttccatacgatcaattgtactcattccaaacgaggatggaactgctggtgcatggggttttgtcactggaagtgctgatcatgatgtcaagttctgggaataccaattgatgcagaaatctgataatgtgagtcttctgtctaatcccttggcatcgtctgttctcctatgactctacagaagtgtctgtttttcttaaccaagtctccattatttatatgccaagaagaacaacaatttattgtgatgcatctcttaatgacattcttttggtttattttgcgcctgcaagtttactaaccagttctccacatgaagaggcatgttttgccaaatttctaaatgatgttacacagaaatataaaaattcaatgtcaaagaatttcttgtgttgcactgtttttgatgtaatgaatgcgcaagatcatcgatctatctgttctagttgaactttcaatgttaatctgataagcatcataaatatcgtctgcataggcttttagaataactttagtgttttctcatcttgttccaggactctaagcagctgagcgtaacaaatgtcaaaactttgaaaatgaatgacgatgtccttgcagtaaccatcagtccaactgggaatcatattgctgttgctctcttggatggcgcagtcaaggtttgtatggttttgaacttctctagaaaatgaactacattctttttagtggggacctttatgtgaacacaaatttggggcttatttttatgattatgtattgggtatatagatagagagcatgattctttacttccttgtccataaaatttttagttttctaatttagaacaggacaagcataagcaaatatctattttccgccagtcagtttatatgggcaaagctattattgttaatattttcttggcatcctgcaaacttggtaacgcagtaagcacttgtactgaactttttttatatcttgaggtgccagttggcatcctgcaaacatggaaataaaaatgcaatctagaattaagtttttgatttcatcaatttcctcaacatcttgtgctgtgtgtttgcaggtcttcactatggactcactgaagtttgcccttaccctttatggccacaaacttccagttctctgcatggatatatcatccgatggagttctaatagttactggttctgcagacaaaaatttgaaaatttggggtatggattttggtgactgccataagtctatatttgcccacacggacaggttatttcttgcccttttgttttctttgtgatttgactgttggcacaatccttacacctttttctcacgtgttcaatttgcagtgtgatggatgttaagtttgtttctaaaacacattatatgttcagtgttgggaaagaccgcactgtaaagtactgggatgctgataaattcgagttgttgttaacactggaaggacaccatgctgaagtttggtgtcttgccatcagcagtcgtggtgattttattgtaacaggttctcatgaccgctctattcggcgttgggatcgtactgaagaacaactcttcattgaggtatgcagtgattgtattgttttaatggaatcctgttattgaatgtttgctatctttgcttagatttttcttagctctgaaacccacaaaaataaatgcaggaagagcaagagaaaaggttggaggaaactttcgaggctgatttagatagtgctatggaccacaagtatgggcaaaaagatggtgctcctgatgagggttctgtaggtgttcctggtaggaaaaccaaagagacagtaactgctgctgatgcaattattgatgcacttgacactgccgaggaagaagtaaaacgccttgatcagcaccaggtattaaaaagtgaaactaaaaacataatgtgcaacccttgttgctattctgttactgctgttaaatgatgactcaccaagtggaatatttacttcagctatacatttattataatttcaggaaggacaaaataatgggaatggaactacatttcaacccaatgttataatgcaagggcagtcaccatcggattatgttttgaatgtagtttcaaatgttcgtccaaatgacttggaacaggctctccttgtaagtttttcccttatcttccctaatggatgacatcattcctttagttttgtcctgtatttctcacagaacggctttcagggaaaagccaccatcaattatttgttgttatagtaaattactagccaatatttgtagtgtggtgatccattttatgcattgagtatcatctaatgtccacgtattccaccgatgccccactgacatgtgggcccagggccatctggcaaccttgctgtgagtggtatattgtagattttttttagggaagatatggatgaaactcactgatatagggcttgtttggtttagtgccataccaaaacattggtagtgccaaaatctaggcatatggcactaccaataatttggtagggtggagttctaagtaatgtgtttggattgataccaattagaagccaaattttatgttatggtgaagaaagtcctagaattataccaaattaagcatgtgcattaccatccatttggcttcaaaccaaaccatcatatttactattcaaactaccaaaaaaattggcatggcacattttggcatcaatccaaagtggcccatgattgcccctattgcaaaggaaacaaaattcaactgataggatgaattccaacttcaacaagactgcacacgtaagaaaggctttctggaaccataaagtgtcatgccctactggggtagtatagaacacaattctttgattttgttcaatctggccttgttgttttagtacataaccatattgtcaagcatattgattgtgttcgttagcatatttaaaaaaccactaaacagattcatccttgtatattaatcattcatcatttgattatatatttatgttttccctgcaacagtcattgccattctcagatgcacttaagatcatgtcttacttaaaggagtggtctatggttcctttgaaggtaaaatgctagtacttcattgctctctatactagttatgtcataaatgtaatttacctgtcaactttctcagtttccaatcctatgactgcaatagacattccattctagttcattttactgcgagttttcgagtgttgtttgtcagaaaccactttctttgttctcagctagaatcgcaccattcctatcacaagccatttcataactagcagtctagctgtctctcttcaagttcaaaattgtgagtttttttatgtgcatgaatacccaggacgtaaaaaaatgtgtagtccataatggctaggtttacgctgattcatggaagttgtttaagctactgtttacattaaaaaattacagagatattgggtcatcactggtggcttcatggattttgttgattaattcagttccacacgtttgtgttactctattttatattgacctaattgttccataccctcatctgcacaaatcctgatgtctgttgtacgctgcaggttgagcttgtttgtagggtttgcctagtgctgcttcaaacacaccacagccaattaactacgacaccatctgcaagatcgatacttacagaactgaaaggcattctttacagtagagtaaaggtaacttttggttacttttgttatctcccgttatacctttcgcagcaacctggtaatgtatttatgtgatgttcatcctttaggaatgcaaggatgctataggtttcaaccttgctgcaatggatcatataaaagtaagattccgccttttccatcaaaaactccttttccatcaaaaactcttgctactagttcttaactttgatgtgaaatccctcttctgctaggaattgttggccatgagatcagatgctcccttccgagatgcaagagcgaagctgatggagatcaggcaggaacaatcaagacgatcggataggtcagatggggctgaaaaaaggaaaaagaaaaagcgaagaacatccggtgagagctgagctttgtgggcgaggcaaagtagttttttttttgtcgtagcatacaaacgatatatcggcgtgctcatattgtgtctacatgagcacgacagaattttggcatatcgagtgtaaaatcaaaacgcgcgttgcgccaaatcttttagatgtaatagcagaatgtgcatttgctcaatcctacgtactccctccgggttaataatatttatcgttttagacaagaacacggtctccaaaaaataactttgaccattattttctattataatatatataaaagtgttaacaaatatatgattttattaaaatactttttaagactaatctatacatgtaatcaccatatttgaaagataatgattttaaaaatgattcataatcaaagattttaaagttggacctcacccttatctaaaatgacaagtattatcggtccggagagagtattaattagatggcatcaccgtgttatgcatgcttttctggttccgacagtattgatggatgaagtgggagtaaatgatgtttctttacgtaggaggtaaagaggagagaatgcgagagaagatttgagaatttttagaattccaatgaatctgtgatattatttaagtacttttagggacaaatctacgcattacaaatagttttgatcggactatttgtatccgtttcatatatttgttgaatattttcaaacagtacaaaatggtaatgttatagatgtgtggtacgttcaaaatattttcaatttggtctcaacaattcaaaagcaattagttgtcaacgccgaaattatcaattatcaagaaacggagtaatctcttatgtcaacttatgtctgccctctgacctttgtttttttttgtcggttggtgtctcgccgaccaaatgaagcctcggattaacactataaaaacaaacttcaacaagttccagccttgcaggagcatctataaacctcacaaacatacaacgcaaatctatccatgctccaatcgatgaatacaacccgcaaccatgctcatccacgacacatccatacagaaacatgcaattcggttcagtacctctcaaaatattaacttaaaaatagtacactgtttccccgtatgttacatatgataaagtttaccaaagcgaaatagacatactgaacaaaagcacggaggttaaatataaatagcacagcgatctaactatataaatcatcatcgtcagctgcggcggcagcggatgcgaaggggtcagcggcggcgccggcgccagacgctggctggtcagcgaacctaaactcggtgccgaacccacgagactgctgcagagtctgggcgaaggcctggtacttgcggatgtcggcgtcactcacactccggcgtgcgtacttcatcgactcctcgaagtgagccgccttgatctcagcaatatcatcaacctcgtcctcctccatggcttcagggttgtccttcctccgcttctccatctcgatgtcctgaaatcaaaatcaagtctccgttagcacgcaagcataagccagaagtatgtttggaattaataactaaataatattgaagatatttatgttaccttttcaatgttctctctgatggcgtatttgcatgcacgctggcagatttctgtaatatcagcaccactgaaaccttgggtgtatttggcaagagcattcaggtctacatccttggccacaggtgacttccggaggcaagctttgaagatctgcagcctagattgatcatcaggcagaggaatgtagataagctgatcaagacgccctggccttagcaaggcagggtcaatgatatctggcctgttagtagcaccaataatgaacacggttttcttcgcgttcatgccgtccatctcagtcaacaactggttcagcactctatcagcagcacctccggcatcaccaacactgcttcctctctgaaatatggttgaaagtaatcagccataaagattatcatgaaaaaaccatggaaatcgtttgttcagaagagataactaacctgggtagcaattgagtcaagctcatcaaagaagaggacacaaggagctgactgcctagccttgtcaaaaatctcacgcacattggcctcactctcaccaaaccacatggtaagcagctcaggtcccttgacactaatgaagttagcctggcactcgttagcaattgccttggccaacaaagtcttaccacagccaggagggccatagaacagaacacctttggacggagacatgccaaacttctcaaatttctcaggatgctccactggatattggacagtctgcaaggttttaaagtatgttaaccacaaataagaactcataagtgaggaaagaaaagagcaataagtacctcctgcagctcccgtttgacattctccagtccaccaatatcctcccaagagacatttggaacttcaacaacctgaatttaaaaggaaagctagatgtaagcctcggaaacaaatgggaatagatcctggtaatgtgcaaatagatcatactaaaaatactcacagtttcacggagagcagacgggttgcttgtccctagtgcagtcttgaagtgatcatttgtaacagccatcgagttaagtatctcagcatctatggtctcatcctcaagatctataatatccatcttctcacggatgcattggagagcagcctcagtgcaaagagcagcaagatcagcacccacatacccatgagtgtctttggcaatgtgttccaggtcaacctgcgacaacaatgtaataactattaaaaaaaaatgcaaccaataaagaatattttgcatctagactgtagtggtgataactcacatcttcagccagcttcatgtttttggtgtgaatccgaagaacttcaagccgcccaacttcatcaggaacaccaatgtcaatctcccgatcgaacctaccaaaccttctgagagcaggatcaatactgtttggccggtttgtagcacccatgacaatgacatgggaacgagctttgagcccatccataagagtcaacagctgtgaaacgatgcgcctctcaacttctccatgggtcttctctctctttggtgctatggagtctatctcatcgatgaaaatgattgatggtgcattcttctcagcttcttcaaatgccttcctgagattactctcactttctcctgctagctttgacataatctccgggccattaatcagaaagaagaaagcacctgtttcattagcaacagctctagcaatgagggtctttccagagccagggggtccataaagcagtatgccctttggaggcttcacaccaatagacttgaaaagttggggatggcgcaatgggagctcaacaagttctctgatttgggccatctgcttcctaactccaccaacatcatcgtaaccaacttcatcaagtctttcctcatcctccctcttaataggctcaccatcacagaatatctccgtatcaggtgcaacaatgcagtactctgcagggtcagtctctataactttgaattcaacacttctcatcccacccctaacaaggaaaaggtctcctttcctcaaaggacggtatgcttcaaggaagtacgctgaaaagttacaaataaaaacagtatcagcaggatgtaagaaggcgacactagaggttgcaagagcacgtttaaacatatcaaggttgaatatttgccataatattagcaacaatgtagttaatgttataatgtacatcgtaatataggtactacagttcatggaaattaggagccacaaaaactttcctcgacataattaagtatcaaacaagcaagttcaaatgaaatggctaatactgttttagaacatgggagcaaagctctaaaattctctatctagaaccttctataagagaaaaatcaaaatacttcagtgataaagaaatcttacgtttcaggaaggcatcaaacaagtttccggtgatgccctcaacagtatcatcaattggaagtatgtgcacacgcttgccgtatttgacatctgggcattgatgaacagacacgacatcaccaagtcgtactctcaggttcttcctgacaaccttgttcattctgatcttcggctcctcgcaggtgtcatcagcaagaacaatgcagatggtgtcttttctcttcttaccctgtgatgcagtgagccaaaatgtcagcagcaaataataaaatatgccttgatgacacaagaattatcatacaatgcaaaacagaatcccaagttcccgacctcatggcattataaaactaaataagtactgttgtgaagctacctagtgaatagccatcacagtttagaagttaactgcaataatcttgacataattacagattgtaagctgtacccaatcaaattagaggatcacttatcacagcataattactgtaacaacctagtactaaggaagctaaagagtcatgagtcatgaatacatataatctaaccatatgtaatctgaataaataatctacaccaaggctaacatcaggggcaaaaactagaaagtagcaaacattcaacctcactaataatttatcctctacaaaacagtagacacacaaacctaagcttagagacaagaaagctaagttcttttttcatacatattcacaattcagaccatcagttcctactatccaggacaagcaccacagattaggccttcaaaccctcgcaattgaagcttaacagaagaattacagaggcaaggatccccaaaccttgagcagcacagtgtcgccgcggaaaagctggagcttctccatggtgtcggggtgcatcccgatgacggagttatcatcgttggtggcctcgtcgaccaccagccggttcggcgacttcttcctctcgaggatcgccgtcgagaaatccttcttcccctttctgctcacaacaccaccaccaccccacgaacattaaaatcacccaaaaaaatcgcaaaaaaatcgcaaaaattcgataatctaccagatcgaaaaggctagatcaggaaggggggaaacttacggatcggaggaggaggagggctctccctggctcgccatgggagtcggcggattcccggattcgggggggcctcgagcgcagaggcgctaggttttgggttgttgggtgtctcttctcttctcttggcggagatattccggggggagaagtgattgtgggggaagacgaggggattagtctaccttaaatagctcctttcttgccgaaggggtttgggattcgacctcctaccgtcctacgggttgggctcggttcgggagtccccggaggtccatgacatgtgggtcccacgaggcccgtggcccacgcgacatagagttcggatgaggtgggtcccggaagatggagggggccccgtgccgagttgagagagtgtgggcccgacatgtcagtgtatcaggtagttgttgttcacttgtgcctgctcgtgcaggaataggagcatgtgttcggctcggaagagaagtttcgcatcttttgctgccttcgattgtaaggaaagtgtcccgtgttcgtatgcgatcgtggcattaattcattatactgcacaaattgtagagcgtaaaaggcaaaagtttctgtctgtttgaggttagccatctgcaattgtacacggagtacttgtttagatgaaacttcggtgtggtgggtgtacacaggcacagcaactaagcaactttttttagtaccgatattagattgttttagtaaactaagatgttacacgacggcactattaacatatacaatacgatacgattgaacacaatgggataaactgtacagtatcctttgttttccaaacaatcgaccatacagcagtttttgccctgacagacatgttacatgcacattaccagcttgtatgtgttccacttcaacaaacaccgaagctaattatcaagacgccgttggcctgggcaacctcttcgcaatttcctgtacaaggaacatgatcaagttatgaggacgacgttcacaaagtttcttttcccagctatgtagtgtagcaaaagatttaaacataagaggataaaaacatcaataggaaaagaacatgaaggtgacagtgcatgtggacaatgtccaggaacctgactgatgaaaatgcaacgaagtgtttatccgtagggcgtaggctgtgtagagttgaactttgttgttaaaatgcccacattaggctgtccctatctgtggtgatccttaggcgagatcagagaaaatcactgattcttgtgctgagattgtttatccacacatatatgtgctagtgacttagtgagagtttaatatgaggttagagctgttcttccataccccaaacctcttctaactaactcaggaatctttctgtttttaattaataatgcaaaaacggtgacctgttaatggaaaaatatcataccataacgagttagtatgatgatgaccattgatggcctaacgcagtagctgtccattcaatgcttacacgtaagggggtgggtgaaacagttaggatttccatgaatttgaagctttggtgtttttgttcagcttgattaatttgaaataaaatagcatgttctcttgttagctatcctgcttcttggacatcgtgaaagcaaatagcttcatatgctagggggcatacctcaaatacttggtttatattatcagctgtctttgctgatgtctcgatgaaaaccatattattcttctctgcatactcttgtgcttccttcagaatgtgcaccatatcgtcaaaacaattttgcagcatattgtgatactatgtttactacaacttcacacaagatctgacctgagaagatacatgtcgattttcatgtagatcagctttattaccaaccaaaaccatgataatatcaggactaccatgtttttgaagttcctgcaatataagaaaaaacaatctgaaagtgcttcatacctgaaaaaagaagtggaaacataacatacttcacaatagtcgacatggtacaatctcactgaatcaattgatattgatgaaataaatctagaaggtgcattttaagattaaatgcaagtgttcatattatatacacttctcacgctagtcagggtaatctttgagcataagcttcaacacatttataatattttagcagcaatcttacagtatgatataaaattttactagaacagtttcgggcaaaaaatacaaactcatagtaaaagatagaaagagtaatcaatcaaccagacatcagaaaagcagataatttggcgatagcataccttcacccagtattgtgctttgctaaatgattctggactagttatgtcgtagacaacaactgcagcagcagctcctctgtagtaaagaggtgccaaggcagcatacctaaaattggctggtaccaatgagttcttgattgagaaaaaccatatgcatgtgtggcacgtaagatggatcaattgtaaaaatcagtaacacatactactagaactttctcacaaaaccaatgcttctaatgcaccaacagcatgccattatcccaagattggaagaagctaaaaccatagtgctgtatgtgtacctctcttgtccagcggtatcccatatttcaaatttcactattgttgagtcctccaaagccaatgtttgtgataaaaatgatgcaccgacagttacctgaaattatttgaggaaataagtttaaaacaatcgaacttctgaaagtaagaatcatgcatctaaggtgaagaataacattatcaactgaaactaagagactcaaaacagtaatcaccttggaagtgggatcaaactgaccacgaacaaagcgaagaacaatgcaacttttccctacaccagagtcaccaagcaataccaactacaacatcaaaaggatggacacgttaaagaaagctgctagtaacatgatatagaggcattattgtagtaataaagggcaaaatgtgcagtaaaccttagcacgcaagtcctttgaatcagtagcggagttatcgttgctaatattgttcaaccctccagtgcttcgagctggatgacaaaacagtgctatgtgttaacaaatggcggaaaatggctaattcttctactccagctacaaacttttcccagcccccactcacatacatccacacacgatcctcccattcatagagatcgtgcagacaccctgctctaacctccaattaacccacaaattgacttaaattcactaaatcacagttcaaaaccgtccagattgcgcgaattttcgccccgatcaacgctgtgaccgaaaacatttatccccaatcagctttcagcataaaaaagctggtccctccctcccattttccaaagcagcaagccacgaatcgaacccaatttgaaaacccccacggcaacacctgcttacctaacactcggtaccaacaatatccgcagccgaaacatagccaacgaggaaatctaatctaaaaaagggggatggaaacgtgtgagagagagaacctggcacggaggaggagcaacccatcgccggcgatgctagccggcgtcgaggtgaggcagagggacgcggaggcggcggtggtcggtggccggaggtgaggcgggcagatcgattgccgcgtcgccttctctctctctctctctctctctctctctctctctcccctactcgagtctgttgatccgcgcgattgtgttggtttggtcggtgaagccgaagaggggggaggaggtcgttgccgctggctagtgggccccactggtgggtcagggtgtcagtgtcacacggcggagatgcgattttatccacagaattttagtgggcttaggctgaatttatttgtggggcctttttgcatttgggctcatgtaggcctatcactcctgtcaaatccccctttggaatttccggccggttttggattttaggacgagtttcacgaactgtcaagtcatagagctttgcttagaagtttgcaggggacaatggtgtgttattgtccgaatttctgggaattcatccgttgagatttcagccacaaaaaaatgtgaactgaaaattattttgttcgagtatatgacaatatctatgacacttgcaagacacaagttctctgctcctactttggaacttcagtgacggagctgcagacaaagcacaattgttgtatattaagagagaaatgacgtgatactatttcggaaatggaatgggccggtttgataacataggccaaaaaataaggtctgttcagatcgtagcaaataaaccttaccaaattttggcaataccgaagatgtcgatattatcaaaattttgactggaattcatatgtatttattaaatttggcaacaaattagatgtagatatttttttacaacttttaaaaaaatggtatgtttgaaaatggcatcaatctgaacagcctctatatattctgtttcatttttcctaactgaattgtgaagccgctgcgagttttacattttttgcagcactgagaaaatgtgaactgaaaattattttgtttgaatatatgacaatatctatgacacttgcaagacacaagttatctgcacctagcctcctactttggaacttcagtgacagggaggtgacggagctgcagaaaaagcacaattgttgtatattaagagagaaatgacgtgatactacttcggaaatggaatgggccggtttgataacatgggccaaaaaataagatctgtttagattgtagccaaataaatcttactaatttttggcaataccgaatatgtcaatattgtcaaaattttggctggaattcatatgtatttatcaaatttgaaaacaaactagatgtagacatttttttgcaactttaacaaaaaaaaatagaatgtttgaaaatagtatcaatctgaacagcccctatatatccggtttcatttttcctaactgaattgtgaagccgctgcgagttttacaactttttcagcactgtaaagtgcaaggtctagctagttaatttgcgaaacttcaagtaaactatggtgaaacttcgatgcttccctcgacacttttgccagaaatttggatggacgcatttcgtctcctcatgtctggatcaaagcatgcgacatcgcgtgcaacaacacatgtgcgtaaagcgtctgtggtgacctacaattctacaaagttggatcgcaaagaacactcatcaggcagtagtgtgctctgctcgtgcaagaatgtttttcttccactttcactttctccaccaaatcctctcctgcatgtatgcagcaaacctgatacaagtgatgatatgtctgaagaaatagaggaacgaaagtgatgtgtcaaggggggccatgcaatgcgatccactttgttctttaactttagcttaaaggacttcttttttgtttggctttcaaccctttcatcatggtagaagaagggacaataaaaaagtaaggtcaagctagggatatattttatttgtggtattttattcaatcctggattttggtggttctgaatccaaaactaaggtcaatcttagaagatagtagtatttttaattggaatacaagcatagtggaaatctagaaaagaaaaattatatattgcatggttgaggtatcgcagtaaacagttaacactattgtgaggtttcttcagatcataggaaggtaaacagtacgtcatgatcagctgacattttgtgttagtacgggtgcctctgtttttttcccttcttatctctatcgcccaaattgttgcttgcaaagtctagatcacgccaaataaaactgtctgtaactctgtacgctggtttggagcttattgttagtcaagatcattgtgtggtactaattgaaactttgatctcttcgttgtgatgcatgatgctgaactcaatggtgttagttaatgcgtcgaatcatcttctgtgatttatctagcgaattcaaggaagtacagttgagacttcaggaccaaggcctctaaccaccggtttctgactgtgtgcaatttgattacagatttcaataatttcatacaagtagcccccataaaacaaagaaagaactgcatgaattgactcttttgtaatcagcaaagttaacaataataacaattaacaaacgaagccatacagctggcataagtctgtgtttagttccacgctaaaattggaaatttaaagaaattggaatgatgtgacggaaaaattgaaagttgtgtgtgtaacaaagttcgatacgacggaaaagttgaaagtttgaagaaaaatgttggaatctaaacaggcctaagaatgatgacgatcttgcagttggtagcaggaaaataatgtgctgcaatactagatcagatcagtaaccagttgattgttggccttgcaagttagtactgacacttacctgcaggccacccacattcagattcagttggtcacttgagccaaaagtttgtgatctggccactctcacggtctcaccagacctgaagctgccaggatgagtgaaagaatggaagaaatggtccaggatcatggttggcagccactcatccagcatatgcaggtatgtggcacacacagaagctacctgccatcagggaaatggctgtcagaaagtggacaagtttggagtgccaaatctgggattaaagaaggcccaaacatgtgattaaagggtgaaatgagcaaggcccactgcccttaccaaagtctgaaactgtctttgtttctttccttcttg

SEQ ID NO: 688 - DNA, 3362 bp, Oryza sativa
gttttaaaggcagtgcaaagatgccctttcaatttaggcggagtttacatgggatcatgtctagttgcaatccaattcagacagaacctgaattcagttgcagtgacatttccatgaaagtttctcaaaaaaaaaaaaaaaaaaaaaacatgggagcattgaactatacttaacttcactgcattgcgcaaacgtagcagacagttaaatttacaagacattgcccgtcttttagattccaacttttttttttcaaacttcaaatgttttgacacatatacagagcatcaaatatggacgaaaaaagaacaattgcacagtccgactgtaaattgcgagacaaatcttttgagactaattacaccatgatttgacaatgtgatgctacagtaaacatttactaataacagattaattagacttaataaattcgtctcgcagtttacaggcaaaagttgtaatttgttttgttattagtctacatttaatactttaaatgtatatccgtatactaaaaaaatttggcacacgaactaaacacaaccaaagtgttgtgatttatgacggtctgcaagtactattcaaataagaatataagatcaccggtgaccggtcggttggttgtttctttcaaaattttgatttccttgaaaattagcacggttgccagctcgattcaggtcaatttgtccaaagatccgactaggacaagctgaccaaaccaacagtattcatgatattgtttgaatattaatgtgtttctcatccaatgaggctggaacagagaacagaacgacccaatgacatggcgatgttatcctcacagccagtgatacatactccctccatcccaaaatgtttgacgccgttgacttttttaaaaatatctgaccgttcgtcttatttaaaaaatttaagtaattattaattcttttcctatcatttaatttattgttaaatatacttttatgtatacatatagttttacacattttacaaaagttttttgataaaacgaacggtcaaacatgtttaaaaaagtcaacggcgtcaaatatttaggaaatgagggagtatattatttttaacatttccctaaaatataaaagcaccatattgctgccatattatgatattatcgaataatgtaacatgaatgtagataaaattaaaaaaaaataagtctagtgcacaacgaccggcattgcaatccggtcagaccaaggctgtgtttagttggatccaaagtttatattttggttgaaattagagatgatgtcactgaaaagttgtgtgtgtgtgacaggttgatgtgatggaaaaggactgaagtttggattcaaactttggatctaaacacaacccaattcttccgattcgtaaacccacgagacaaaaaatataaaaacaatttgcgtaatcagggcggcaatgcggcatgccccaaaccataattaaagaaaacaccgactcaattattcaattaactaatggaaaatcagcacaccgacaagagattcatatccagcagttgttcgtacaggattaggttatccactacttccagaaattgaattgcagtccaacattttccaagtttcagctttcagaagtccgtgtttttctgacatgttgcctgagttaatcaacgccatatttaattgccatttgggagaatattcttagtcaggcacacgtatgaagacaaaaacagagcatgaaaaaaaatagttttgctgtgtgttttgtttcctccatttggcaacggatcaacgatgcaacagcatcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaacatgggcgtgttagtgatttggattgcttcaatggtaggtgaccgtgtggcacgccaaacctgcaaaatgtgggcgaaaaggacgtgggcatttcattccggataacgaagaccttgatgaacattgttgactccctgtctggaacgctgaaatttttgttattttttttcttattcccatgtgaaaattgcacagaacatgtgtagatcacagagctagaattgctgtatacaaatattgccgaggtgatagttctggatttcacaagttgcaggtagatcagaaaatgcagttgttctgaaatggtctacgaatcagagttaacgtagtaaagacgaaaaggtttttggatttaccgaccctttattactgtctcaaatgtcaaaagggatatgaatgatggtaacgacggcctgcacacgcatggccaaagcttcacatcgaaaaagatgtgtgtcttcaattataaaactattaatcgccgcaataatctgaaatttgaagattaatcgcaacggcaatgcaaccaggtagcacacagagaacatcaaataatatcgcggagaagacttcttacacacagagctgggagaatatccgaatccgaatcaccgacgtagctatccgtcctcgtcggcgccacgtcggacggggaagaacgagatcaattttgccgccacgaatcgtttgaaagaaaattaaactactccgcgtttgaggaaacttttctttgcccctcacgaacagcacaagaccaacgaagatttaatcatatattttaatttacaatcgcctggttaaacaccacgtctttgatgaaaagcaacgcgaccaagacagaactagtccacgattcaaccaacatctctgactaggcacgcattttgcgaccaaaagatcatcactccatcagtccatttcatccgctaatactctagttaaaatcaaatttcgcttaaccagtcaagaattgatctaaaaaaaatgacgctacaacagaaggggtaagtttggacaaaaattgatcgaaagcataacaacacgtttggtggatgcctctgatcttctaagtctaaagtcctcggtatgtacatgtcgtcagattggcctctgagcttctgtcgccggagacatggcggatcacatcaccgagcagggcgtttgggggttctcgtcggctgacagctgcggcgccggcgacatgtcgagctggtaggggtacggcgggtacgacggcggcggctg

SEQ ID NO: 689 - DNA, 9407 bp, Oryza sativa
  unsure (1)..(9407): unsure at all n locations
nnnnnnnnnnnnnnnnnnnnnnnnnnnnnnnnnnnnnnnnnnnnnnnnnnnnnnnnnnnnnnnnnncggcgcagccatcgcagtggaggcgaatcctgagcagcaccgtttcctgtaacaacaaagcagagagacattttgagttctcaggtcaaacgagtagttgggaggagcagagaagcgtatgcgtatggcgttggtagggttgcctcttgtgtacccgacctctttgggtttcttctcctctggcggttgcttcttccccttctcctctttcgcctgggcgtccttcttctcgccgccatcgtccttgacggccttgggctcggcggcgggtttcttggcggcggagccaccgccgccggcggagacaacctcgacgggcttcttggtcttcgcctcgatcctcgacttgagcgcggccgcttcgggcgtccccgccacgacgaccgtgttcgtcgtcacgtccgcccgcaccgacttcacccctgcgatcccagagacaacccaaaaattcagacacccagacaccaaatcgaaccccccaaaaaaggctcaaaaagaaaaaagagaaagaaacgagaggcggcagcggcgaataatcgagaccgagatgcgtaccggccaagtgcttgatggacttcttgaccttctgcgcgcagccggcgcaatgcaactccatcctcagcaccaccgggtcggcggtggcgcccgccttcggagcagccttctcatcccccatggatggatttttccaacctcctcctgtgctcgcctctggaagtctggaatttgagattttgagttctgacgaagcgaataaaatggcggcgctgggtgggcggggataaatagggggagggagacgagacgaggaagcggaggcgaagccgactaggcgacggagacgaagaagaaaaaaaaagagagagaaagagaaagaaaccgtagacgccgcggtggggtgggtggggccaccctgtcagtccgctcgcccgcccgccgtgcggatccgtgtacgcgtcgggcgcaagtttcctttcagtggccggtaatttcccaccagcaaagccagcctgcctgccgcggctggtgctttggctttggctacggtcacctgcgatgtcatgtcacgtggcgtcatcgcgtagattttgctggtgcctttgctgctgtgtactcctacgtagccagtgtactggactttagtactagtacagtactacttgccttagataggatcaacagctgtttggttggatgtcaccgaccagatactgtttggtactccacaactcaagtttgtacagtactaccttgtcacaatgttcgagtttctatgcggccacggctcatacgtgacagagatacagtactgtcctttcttgccacgtagcttcagagcaaaaactatggtaaaacacggtgatcaatcaagtaaatgttggcattagttgttttttttttttagaaaggggtcgttgatatttccagtcagaggaggatggtaattgcaacggctttggttccccttttcttcagtcctcgcgtacgacgttttccctttttaagggaaccacacgtacgaggcgacgatttgtgcgacgaaaattatcgtgtgccgtgtgacgatcgctgtgacgataaggtggaaggcgacgtgtgccgagatggtcgtgggccctggcccttcccttcttttttcttcacttttctcgaacaaaaatgggccctacgtgcgggaggcggtgtacgtgtccttcgctggaatccagtggcggaagccgcgctcgctttggaccaagtagggcccatcaagggcccaagtgggtgtgggcccacgtctcggaaaccggcgagccgctgcagcgacgcgcgatggttcagtttctcgaacgttctagaactactagtactggcttgcgatgagctggtgggttggataagaacgacctaagttggtgggctgccgcgtgcggcggtgaggtcagttttgggctgacgtgcctaacgctgtgccacttgggccgaaaaaacgctttttttattcggcaattcggtgtattttaaaagacctaaacgcacgtggtgttatccatgtgtactgggcctgtattgggttcaactggaactttgggcctgaattcaacgtgtagtatgacttattaataacgttgtttattattattattattattattattattattattattattattattatttttaagataatggaagtatataggctttacaacttctctaggaatacatgcaaatcagcagtaggatttgagctttaatggataaaatcatgcgctaatagctttatcaccattgtggcctactttttactactaaacaaatattgattttgaatttattggccatttatctatacatctccctgccctcttacacatcttcatcctcaactctagcttcctccatcgcctacccactctacgcaagtgtagcggcttgcttaatgttgccgtcgtcctcgccctcccaccactactaccgagggtggaggattgaggatggaggaatagattagtggttggcacttgggaggatattgcattgaggatggaggtacggagtagtggttgggacgtgggaggaaggagaaggagagaaataaagtgatggatttccgaaaaaaaaaagtgatggattgatacataggtctcactgttatagacccaaatgaaaagtgtagatgaaaaaactgcgagtctggcttaccaaatagccaaatcaggagaggaattagctatgtgaatggttggagaggctgatttcgtcggaaatgctcgcgcttcccaagttctcattcctactaggctttgggttcagacgatgaggccacctggcaccgcactaggctttgggctcatttcaggcgccggcagccggcgcgtcacggagccgaaaccgccaaatttcataagaaaaaaaaataaaaataaaaagaaagaaacaaaaacgcaaagaggagaaaagaagctcgtctccgcgtctctgcccgccctctcgtcgatttctcatttctttctctccctccaatttgccccctctttgtcgttttagggtttccgcgctccaactcctccccaattctggtccccgattcgcgcgatctcggccacccatggtctccggcgtcgcccaccgcccggacgacgacggcgggcgcgccgcctcgacgttccagcgcccgccgcagccggccggcgcgcggccgtccctggccacgccgccgccctcgggcggagcgcaatccgcttcgacgagcggcgggagcgcgggctccccgtccagccgcagcgagcagcatgtccccgcacccccaggcatgcgtcgggggcgacgacggcctctactccgattagtgagaataccttcctccgcctcaacgaccttgacatccacggcgacgatgcgccttcctcacaggctccaacgaggtcagcgtttggtttgccagttttcgccgcggggttgcgtttttttcccaatgttattacaagattttaagattttgagaatttggttggtttttgtttttctctgtagctgtacgctacttaaaatgctccggagatgcaccgggtggttaaaattgtccgtagtgttgtaattagctgtgtttgggctgcaaaatgcttagggaagtgtatcctgccatcactttgatgtgtggttgcaagtaagattttctggggatgcttatacgattatgctctgtaggtttaccttgctgaaagtgttaattctatatatatacggagtagttctcatctgtagtctattacacgtgtatactgtactcacgatgatcagtaaaacatcagtcatgtgacctcttttgctacatagattccagactgtagaacactgctgtttggatgccagtgcatgtttttctgcattatgaatttggaagtacgacttggcagaagttctctacctcttaaggctccttttcaaaaaataaatcccttcattgttatctagttttgtgcatttgcaataagggtttttgctatgaataaaattattcagcaagaagaagaagagaggagcacgagcagttggtcctgacaaaggtggcagggggctgcgccagtttagtatgaaaggtgtgttaaatcccatttgttccctattagtacaccatttgagtttatttataagcaccacaagtatgtgctataaaaactcatgatgacactgtttgttcttttgcagtttgtgagaaagttgaaagtaaagggagaacaacatacaacgaggttagtgctttcctctttctaccgagttcatgtatcttgttctgagcatctgatggcatcatgtacgtggtcacatcacatggattgaagcagcaaattgagatcacaaatgttgcatgtgtcagctccctgtttctttgcatagttgtcttcttgttagctctatccttgaagattcaatcagttatttcaagaggacttaggctatgtatgcaatgtaaaacctaatagcaatatatgcacagggcaggactagctattgctccaataagccaacatgttcatattgtccgtccacctggtggtattgtcaaacaattcattatctataaaactgccatgttccgcatcatgatttggggctataaaattggtaactcactcacatgtcttatgtaacactgctgtttgatcagcttgctcagatcttactatggtgatgtgttgtaatatgtgacatccaccatattgatcattgtaaatccgctatacatatcaccctcttctactgttatatttaaactaacaatctgtctttgcatctattcatgttcatgtttggagttcctcaaaattgctaaaaactatcatattttgtctctctggcaaaaagttgtaataattttggctatgcatttgttgatagttttcaatgtttacccttattggtgaagtccaagtctcatagtccttctgacttatctttatcaggtggcagatgaacttgttgccgaatttgcagatcccaataacagcattttgccaccagatccggataatcccaatgcagttgagaaatgacttgcctgcatcaccaattatttcttaagtcagttgtatgctcactttgtgttaaatgcagcaacaatatgacgagaaaaatatacggagaagggtttatgatgctctgaatgttctgatggctatggagattatatctaaagataaaaaggaaattcagtggaaggggttgcctcgaaccagtataaatgatattgaagatttgcaggtttttcgtcttcttttcccactggttatcgacatttgatgtacttttggtagtcatatttattaatttatttatgctcttttacagacggaacttgtaggactgaaaagtaggattgagaagaaaaatacatatttgcaggagctgcaagaccaagtaatgatatagctcaacctgcttttctttagtcatgtccaatgcaatatataaaatgaactgttctactgagctagcagtgtaccatagtcttcaaattgtgtggctttagtggtagatactgtgatacacataatgcccttactcggtaacattgtttttggcatgttaagtttgtaggtatgcaaaagttgatacaaagaaatgaacagctatatggttcaggaaacattccctcgggtggagttgcattaccatttatccttgttcaggtgaatagttcataaattctttgtcttctattctcttgtttcatggcactgtttcctgcacatgacttcaggctaaatgacaagaatgaatcatgcagacacggcctcatgcaactgtggaagttgaaatatcagaagatatgcaacttgtacattttgactttaataggtaaaacaagaatcctgttattctctcccatctggtcacacctttacaatttatctagcaagccacacctttctctttctgtttccatttttctattctttcatgatatgattgcagaaggtcctcactggaagggcatcctcttatctcatttaaattctggcagtggtcttttaacccttaaaatataatataattcactctgtaaaaaagaactaaaatctcagctgctatatcaaatttggatggtagagatttttgtctccaaacctctagtgatgggacggtacaagcggaagtgtaaataatgtgacttttgaaaagtgttgttagcttttattggttgagctaagtcatctagttttagtccaattacaggtcgcaggtcctcattatcctagtgacatttgccatatcactaattcttgaataatagggagacattggcatcctaaattgggaagatgagagcccaagtgtgaaattcattttacttttctaaaagagtaaattgcattcacggtacaagaatttgttaggtgggtgcattctattgtaagaacttgaaaactgaacaaactggctcaccaacttgactagacggtgcgcttttggtcaaggtgaataccacacggaattttcggccacgttagcaagacatgtcattcatgtaacatgtttttgcttcttccttcaaacgacagatagactgaaggttcattttagcaaatatccccagttcaatggtaacaatatcaaatcaaaagctctataggtctagatttagctttgatagagggcactgtaatctcttgattgatgcatgaatcaattcatagttatactgtcaattgaacaatgaaactagacagtagaaatttagcttgatctaaaaggccaacgcttgcttcgagaagactagcatcaccatcacccgccaccaccactgacgaagcacacagtaacatctttgagttagctagcctgttcgatttttgcctatatatttccaaagtttgatcatgtgaacaggaatgatatgcattgccacatcttgccgtagatgatctagcttcacaagattcatagttcaccaaaagtaatggatcaacctgggagtcgtgaattcataataaatggaaagaagcagacattatatatcatctggaacaattagaacatgaaaaatagtcgggagtttgtttcaaaattgttgggatgggagataagcgatttgtgtgcctgatgtgcaatcgacagcgtcccttgctgatgtggcaaaaatatgtaatgtggccttcactttgaacaaatatgcaccatatagccaagttaatggactaatatgctcaaatttcaagttctagtactaaaacacgcccacctgacaagttcttgcaccatgagtgcaatttactctttctaaaaggaactatcaaatgaatgaaacatatcaaaatatgccttttatttttgttgaaagaaataatttgatatcggtgcagcctcttagatttcccttagatcagcgtaagttcttgatatttacatttctgaaactgcagcacaccatttgagttgcatgatgactcatttgtactgaaagcaatgagttcttgtggagaagaacaaatcgacggtattcatgatctaatttcaaatggaggtgagagctcaagcatgccaaatatttataggcagcaagtgcagcaacctgcaagatcacctaatggtacagctagattgccaagctcaccccctattccaggaatactgaaagggcgagtgaagcacgagcattagtgtagtgtgtttgttgattgttgtctggcgtgttgggtttataatttttaatttttttgtgtaaatggcctgtaaattagtgggcattggaaaagtagtttattccgatttaacgctgcagtctgattggtagagtggcgggtgccctgaccagacctgtatcactccccgagtaacttctaaccggcttttaatctgttccgccatggttgagaaaagacgtcttttaacgtcatgtaattgtttaaagcattttgaagtagttagcatttgatctgagtgaaatttcagccttttgcatgcttattgtaggcatatacatttgtattggatatttgccttagttatatgatatactactacttgtcttagcaaaattttccatacttctatatcgatctgattcccttattgccttttggttttggctatgaaggaaacaagggaatatgggatacacgaacaacttctttgtgaacatctttacacgctggtgtgattatcctcaacttcaggtgaccagaaaaaaactgcaaatgcatctcggttgaacaatcacacgttcacacttcattaaagcttttggagtggtggttctctaggcctttcgtccgccaatcagccaatgtattttgaagagtccaccaattttccattgccattagagcaagtttaatagtatagccaactactagttccaattcatttataatcaatctaatagctcattcatacaatacttacatactacactattaatatctggtcccatctgtcaaacacacactgcgtcttggagtccgtgctacagctggctacaaatctgtagcccgctacctttctctctcctcatttatctacttaaaatatatttgcagctgatttatagcctgctattgtacctgctcttatggaaaaaggggaaatttctaagattgtttatcgacaaaccatcgattctaagaaataccattgatactagcaaaatatccatatgttacaacgggctctaattatattaaatgggttatcagctaactaaaattaatcatcattctccagctctgattaacggtgatataataataaattatcactttaaaactctggttaaagatgatacgataaacaatgtattatactgttcaggaagcaaatagtagcacataagataggtggaagtgacaaaaccattaccactaataaattttatgataatatagatagagatgtaagctctacaaaataccatggtataagctattttctccttttgttatttttaccatcgccgttcaatcaacgtgagttgccttccgttaaccttttccttttgttttttttttttgtcaacgtgaaccttcggcaagaccttcacccaggctgccgtcgttgatccaggcagttgatctactgaactcccgatgccccagcgtcgccgccgcggggctgtgcccctatccgcctgtgtgtcttccttcggcgggcgggttgggttcgagggacgggggctctgggtggcgtcgctcgcggaaaacgcgcggccgctgggcacaagccgcctcgatagtgcctgtgtggtgctctggattgtctctgggagcggcgatactggcagccaactatggcttcttccccactgaagactgcagcttatcgacgacgatttggccttctattatgggtgccttagt

SEQ ID NO: 690 - DNA, 10938 bp, Oryza sativa
caaaaggcccgcccggcacggcccagctcaggcacggctaggcacgacccaccagctattggaccggcacggcccgatcggcacttcgtgccgggccgtgccagcccatgggctgcacctcccgcccaggcatggcccaccaactgttgagccgtaccgtggcggcccgaaggcacgggtggcccatcgggtttttttaaaataagtctattttccgtccctcctctttgggcttctacatatgtatagttaaaataagtctattttttttgtccctcctctttggtctgacatatatatagctaaaataagtatattttccatccctcctctttgggctgacatatgtatagataaaataagtctattttacatccttttctttcgtccaaggcatataatatgtctatttttactcccctatttttttttgtgtatcgggcttggctgccggcccatcgtgccgtgccgggccggttgtgtcgggctggcccaacgtgccggtggagtggcccaggcacagcccggtgctgtgcttgggccgggccaaaatgccatgccatgggccgggccatcgggcctcgggccttttggccatctatacattcacctctacctcctcgaaattcctagttttgttcgtcttctcttgtgtatctatttcctcttgtgatttttgagaggtgatggtattttttaagagacattgctgatggatgttattttccgaggtgctcccacatttcactatagaagagaaaaaagagagtctataaaaaaaacagatctaaaaatctcacaacggcacggttaatttatataaaaccggcaaaaatcctgccgttgacttactgaactaaagaacaaccatccaataaggaaaaaactcctaaacaaagctttaaggacacgctaacagaacgacgacatcgcccaatccaaacgaatataaggttttcacccgaagaaatcttttgatgtggagttgaatgaggactccatagcaacgccttcaagaaagtgaacagcgtcagaggatgtcgccgccgctagcaccgtcaagccaagcaagactttcaccttggagtcctatccaaccatatgccacctgcacatcgaaactacttgcactatgtacaccacctacacaccacaacaacccgcaccacgactggacagcgctgttgatgacccgctcctccacctagccgggccgctgagcttcaccgagtcgtggagctgaaccatcgctaccaccaaacgccaccatatagggaccaccatagcacctagatccggatctggatctgcaccgttgatgaaattgccgttagaatttcgatcatcccgccacgataaatgtattatttatcctatagcacttaatggagagatgctaagtactaacggaacattaacgacgatgatatttttgagacaaattaaatcgctgatgcaatgacatttcatgaaacttggacttatttgaaattgtgtgcttgtcaattatatttatttggattttctcttagattaattatgcatcctccgttcctccagccgatcgatcgtcccgtcgatacaccagaaaacgaccagaaaacatttttttttgaacaaggtaacgtggctatgcatgccgagaagagctgagggaagcaggaagaagcatcccctgctattattacacccccagaagtcgaaaggcgcgatagccatgaaccgtccagcgcacgcgcgcgcctagaccgctcactcctctcccgcgctgaccacctctgcatgcgctctgtataagcacggcccgcaacgagccccaccattgcacgatactggacccctcgtgatggacacccgcctccccctcctcctcctcctcgccggcgtcgtcgccgccgcggcgccactgctcgccaccgcccagctctccgccgacttctactcctccacctgccccaacgtcgagaaggtcgtctccaccgtcatcgagcgcaagttcaaggaggaccctaccacctccgcccttctcctccgcctcctcttccacgactgcttcgccaatgtacgttcacgttctacgaccttgcccgccgccggcaatggcggatgctgacttgcatgtgatgttggatgcgtgcgtgcgtgtgcgtgtgtgggtggtgtagggatgcgacgcgtcgatcttgatcgacccgctgtcgaaccagagcgcggagaaggaggcggggccgaacatctcggtgaagggctacgacatcatcgacgagatcaagacggagctggagaaggagtgcccgcaggtggtgtcgtgcgcggacatcgtggcgctcagcacgcgcgacagcgtgcgcctcgccgggggccccaactacgacgtgcccaccggccgccgggactcgctcgtctccaaccgcgaggaaagcgactcgctccccggcccggacatcgccgtcccgaagctcatggcgcagttctccgagaaggggttcagcgccgacgagatggtcgtcctcctcgccggcggccactccatcggcaaggccaagtgcttcttcatcgaggtcgacgcggcgcccatcgacccgacctaccgctccaacatcaccgccttctgcgacggcaaggacggcgacaagggagccgtcccccttgatcccatcacccccgacgtcgtcgaccccaactacttcgaactcgtcatggacaagaagatgccgctcaccatcgaccgcctcatggggatggacgcaagaacgaagcccatcgtggagtccatgggtaaaaagaccgaccagttcgacgccaccttcggcaaggccatgacgaagctcagcggcatgaaggtcatcaccggcaaggacggcgagatcaggaaatcgtgctccgagttcaacaacccggtgaacaccgacgacggcccgtccgtcatccggatcagctcgctgaaccccgaggagatgatgggctcctttgcgccggccaccgggaagtccccctccgccgcctcggagtccaggaaggtggcaccagggcgcgccatggaggaaaggatggcggccggtgaggcgaagacggatgcttcaggcggcgccatggcggaaaggttgccggccggtgaggcgaagacggctgctgcggcctccgaggatgaaaaccaagcggcagctggtggcgccgccggcgatgagtcggcggcggaggaggaggggaccaagtccaacaagaagaaggccgagcgggtgaccgcagaagtacctgccgacgaggcggcgccggcggcaaagaagccgagggcgatgggcggacaatcgttcagcatggccggcgccggcgccggcggcgagccgtcaaagaagtcgacggcgatgaagagccaatccttcagcatggcgggccagccgcaacagtagccgaagaagaagaagaagaagaagaagaagaagaagatgccgcgctgctagctgagccgttcgcacggcggcctgatcgagcgcgcattgccatttatcgtttttgattttctcactctctctctcgcctgtttgtagaagggacgagcatactactaccgctaattactaggcttaattttgcaagtaatgtcgtgtcgagttttttttaacagcgaccaaaagctcgatgatattttctcttttcattttccctttttttttttgtcattcttgttaagaattcgttgccaactcaatctggctggcaaataaaagtgtattaaatttcccctttttatatagagagacaggtacacaattgtaattgtttttttagatcaaccaatgcatgtgaaacgatatacgtgctactaccatgtaagcttggccaccgtttcttccacctcattagttcctaaaaagtcagattgtgaaatatgattttaaagattattttaggccgtttttaaagtcgtcttcttagacatgaaaacaaggctggttaacgaaaatgattaatcttaaaattctaaatgagatgcaacttttcttctttcttttaatgaaaaaaaaacaatggcaagcgggttacaagtgtttactctagattcagatggacattgactaatttatttatgaaaaatatttacacattacaaacagggactagcacaattggaattggaacatctcatctcactgtgggattctgatcaagacggagtagatatcaacctaaaatagagtacctacgcagctagtctaagttcaaatctttcctttggatagagtgctatatagcaaagtgaacttatttttaagcggagtaaaattgcaccggttttgatagacatctatgccgtcaatagcctaggagcgcacacacgtgactagaagcccatggaaattaaggcctaaaaggccaaactacggtccatgaggggcccgctaaaccacggccctctcgtgccggtattcggcccatcaactattcggtccgcgccacgcgcacggcattttcgctcgtgtcccgcaagaggcatgcacccctgctgctcgcaagctgcctcctcccgtttctcgccggccggtttaccctctcggatctctcccaagtcacaagcaccggacccgtagaagagccgaggagctcgtcgatcaagacgcctgcctacacgtacgtcctccacgatgacacgtgcagcaaggctgccagcgtagcacacatcgctacccctaccttttgcctccaaacaattgtcaatcacatgcatcatgtgtttggcatggaatgaaatgattgatgcgcgagtctcgtactccctctatcccataaacctaacctacttagagcaggtacaatagcgccgttaagaaggctccaaaacttattaatcagcctaataccagattagagaaagaaatcgctggaagagaaacaagcggatgcttgttttagcgccggcgcttgcacagcgccccacgctgtatcggtcacgggagatgagaaaaaatttgttatgtaggtcccacacaaaaaaaaacttgttatatttaatgtatgtatgctttaagagcaggtacaatagcaggctattaactagctataaacatattttatggagataaataattggagagaagagcagcaggctatagatatgtagtcagctgtagcacggactccaagacacaatgtgtgtatgatatgtgagaccatatattaatagtatagtaagaaactattgtatgaattggctatagatgaattggagctagtagtgggctatactattaaacttgctctaaccaaggcagcttatagataatttgtagttagcctgttgtatgagttggcttcttaagttagctctatcttaacatgataaaattttggagcttaccgcttgctgcactattgaccttgcagggatgagacattcattggagaggtaatgtcctatccctaactagattggatttttggaacggaataagttggtacttgtaggctcaatgctagaggatagtggctgtgttcgtttcccccaattaggaactagtgccctacgtacggaaaacggagcaatccattagcgcgtgattaattaagtaactttcgtatagattttttttttacaaaaaaacacaccgtttagcagttggaaaagcgtgcgcgcgaaagggattgggttgggaaccctaaggccgtgtttacttcttgggtgtaaaatttttgaagtatacgtacacacatttgaagtattaaacgtagactaataactaaacaagattatgcctgtaaattacgaaacgaatttattaaacctaattaatccgtcattagcaaatgtttattgtagcacctcattgtcaaatcatggcgtaattaggctcaaaagattcgtgtcgcaatttacacggaactatgcaattggttttttttctacatttaatactctatgcattgtccaaacatttgatgtgatgtttttggctaaaatgtttttagatctaaacaaggcctaactaacaaacgcagcctaagtcagagctttttttttctttagtactatatcctttccagagtatgttatcttgaaattggcatttatgttccattattataatgcacagtatgggggttccattctgatacatcatacattcacgtggtcttcacaatgctacataaaccttcgcggacaagttttgaaaatggctgaatcaaggcaaaacataagcacgattgattcccaaagagaagcagattaatttgctacaacttggatgatctcacttgggcgataagctgccttctcagaatctttcctgaagctgatttgggcacgctgcccacaaaggtaactctcttcaatcttttgtagtacgccacctgataatgcagttcattagtgaaatatattagcacctttgtgtcaaaaaaaagtatattagcacctagggtagtatgcagtcgatggaaaacacaaaatacttgttcattcatggattgcaaatgttggatgctaataccagtgtttggccagcacagcaaactattcttgctatttagatcttggatttttaccaggtacatgtatagtcaaagtgggtagaactctaagaaaaatatgaatgaaactcgatgtactaattgatgctccatgtttcattaacattagtatctggacgagctttacccaaattgtctcatgctgctaaaaagttccactagtctacaatcccaattaaacaaggttccaacttccaaatcagcctcacctgtttttcaataaatttttggacatcaacttctgtcaatgaactgtcaggtgaccgaacaacataggcaatgggaacctccccagctttagcatcaggaaaccttggaaacaagtagagctccgttaagaaacaaggcacaacagagagagaacgatccaaaacaacaatgttgtaacaagcgaacagtttatatcataaggagcaagaaacacttaaatttttaggtggttcaacttacgggataacaacagcatctagaatctctggatgagatagaagtaacccttcaagctcggcaggtgcaatctaaagaagtaaaataaaggagatgattagctatttccatatattggacaaaatatgacgcgtgctcaagcaagacaaaacacaagcattaggttggattcctgttatgattgttatagtggatactaaaacaagaaggatcttattcagacaactcccatctataaatatgtgctttggtaaatggtaatagagaaaaggcttttcagtgtattgtaatctcagtagatgcaatctatcagtagagtaaacaaaaaagacaggaaattccataaaaaagaaaaggtgaggttatggtatgctcaagacaaaaatgttaagatacatgacgaacggagcccagaaataatcctatattattctctctttggtgttctgattgtaaccagctctattctatatgattctttctttagtgaatggaaagagctcctgctaagcatttttttaataaataaataatatatgcacgaaattattctagtaagccacgacaatttcagaaggtttggtgtgctatatcaatctatccttgcggcaaactctgaattgatcctatatgtatatgatctttcaagtctgcttataaaactcatcagcacgagattcaatgacataatttacatagtattagcaagggccctgatgtgactaacataagtagaggggctgaccagaaattttttttggacaaaaaaaagtatttagggaaaaagaatcaatttctttacctggaaacctttgtacttaatcagttctttaagtctatcaacaacaaaaagctggcctcctccgtcgaagtatccaagatcaccagtgtgcaaccacccttgcttgattgtaaattcagtagcttgcacattgttgaaataccctacaaacgcaacattcagataggtaagcaattgttttgttctattattattgcaggacagaatgcataagatatattgggatctattgtcagtgaaaaatagtgaggtctagtaggtggaatattttcaaatattttttgtatgctcgacatcactagtctttgttaaattgtgcattgtcaatgactcaatgtacaattgaaaacaaagaatacaaataaatagctacagttccattgtaatatgattatagtattagactgatactggtatttgaaatagttattttgagaaccagtgtataataattgatcaaatgtataattcaaattttaccttgcattacatttggccctcgaacacaaatttctcctacttgattgggcggtagatgttttaatgtctttatgtcgacaatctttgcctcaactcctgagacaagcgtgccagttgacccaaattcacgagcctgtcctttttctgggtactcgagcgatatgattccacaagtctcagtcataccataaccctgaaagaggagcataacatgccatacaacttgagatataaaattcttaaccttactagttgattttacagatacactgtagcatcatggaagaaaagaatgccaccacactaatcatgttcccacaaggagtgtggtgcaacaaactaccaaaccactttaagatagttctgtgatcttattgcagtggttgcttaggtgctagaccatgacggtgtatgtctttttttttttttgaccaaaactggattacggaaataaatccagcctctgcatcaaagatgtatccggacaatgtttattacagctatgtcaacaaaaaggccttagctgtcataagttgcagtttgaagacacactagaaatgcctgcacacctcttgagtctagaacagttggctacagaccagaaatcacatcttttagagcaagtttttacatcttgacgagttgtcttggtgttggcctgtggaccacatcagactgaaattagcacatacaatataccaaattgatccaaacagatctgataggactagtttacgaatgaaccagttcaatgcccactgcattaggcaaaatatccattattattcagatattgcaagttgacattcttaatttcctatcaccaacacacacgcgaacacactttaaggatttaagtataaatatagaaacaaaaagaaattaaatgtcctttgcctcaatgaggttatatttataggacaaaattgtcagtctcccgcacttaaatgtcattttccagcttctatcgaatcaatatttttttagagattttttacccggcctctacatccaaccggatatatgcaacctttttaaattaggaacttagcctatcaaccaaggaacttagccctcaaataacacaatctgaaattcactcctatgcagatttgaactcaggaccttggggtgctactcaggtcactgcaatcactaggctacatgccctttcacatatgaacactatattacgccctggaaggcacaaccaagatcagaccccacaaaggcacagccaaagaaagacttaatttcgtagtcattccaaatcaaaccaggtatgtccttataaaacgtacggtcagaacaaatgttgttatgaattcactgcccaaacgtaactctgaaccattatttcgtgttaggtttgaggaatgcaatgggttggtcaatcaatgacttgactaatcccatcgtaatcacgggatgatgccatgatggatcaacctatcctgtatggattgacacctcaaagcaaccaaccataagctaatttcaacaattcatcagcatatattatgaaagtaaacagtgaaaaatatcaaatgttcagttcaattagtacctgaacaatctcactgtccgggaatttcttggccacgacctccatcacatccttgccgagcggcgcggcgccggagccgatgaacttgagagagctgagatcgtacttaccggccttcccgtgcttggcgagcgcgataatgaccggcggcacgcagaacaggtgcgtgacgcggtgcctctgcacggcctccatcagggagttgatgtcgaaccgcgacatggcgatgatggcgttcccgcgatgcagctgcgcgtacgtgatgacggacaggccgaagatgtggaacatggggaggaagcagaggaacacgttgggcccctcccggcgctcgtcttggtcggaggtcaccatcctcgccgcggcgatgaagttgcggtgcgtcaggatgacgcccttgctatcccccgtcgtgcccgacgagtagaggagagccgccgtgtcgctctgcttgattggtgggcggcggtaatccgcctccttcacgccggcgacgaggttggtgtagagcgtgacggtggcgtccggaggcaaggaggcggccgcggcgttcgcgtcgtcgtcgaggaggatgacggggaggcggagccccgcaatcttgggcaccagggcggagatggtgatgacgagcttggcgcgcgcgtcggagacctgcttggcgatctcccgcggggtgtagtccgggttgacggtggtgccgacggcgccgaggcgggtgacgcgaaaaacagaccgggtagagcacgcagttgggcgccaggagagcacggcgtcgccgggtcgcacgcccgcgcggaagaagagcgcgacgccggtggagaggacggccgacctcagctccgcgaaggtgagggcgcggccgccggcggccgcgtcggcgagcgcgaccgcggaggggcaggcgtcggcgcggcggaggaggaggtcggtgagggagaggcccgggtcggacgcgacgggcgcgggcgggcgcagcgagcggtacacgccgtccgcgccgtagccggcggccggcaccgacgcgctcgccatggcttcccccgcctcttgggtttggttggtgcgggagaataggagggctttgttgtggtgagtgctgactcgagggtgcgtt

SEQ ID NO: 691 - DNA, 1391 bp, Oryza sativa
  unsure (1)..(1391): unsure at all n locations
ggctttgttgtggtgagtgctgactcgagggtgcgttgaattggaatttttttgagaaaaaaattaatattatttttatggaaaatcgtaaaagtagtggccaaccggggaaaatcgtgaaaataggtccctgtcgaacgggtgcaattcgatagggcacctatcgaacgacgggcagtcgacaaagctctgtcgaacggctggcgttcgacacgctcacctgtcgaacggagggagttcgacagggcccaccacccggcgccgcgaggcctgttgaaccgggggcgttcgacagggccctccaccgaccctgtcgaacaatgggcgttcgacaggccggtttaaagccccgtccacccaggccgcgagttcgatttgtgaccacatcgccagctgccgccaagagtcgccacatcgtcgccgtgagcgccggagggagcgagggaaggggatagcaggccggagaggagcccgaggaggcaccggccgggaggaaagggttggcgacgccctccagcagtgaagttaaggtatacattagtaatccctaagtacaatgcatatgaaagtttaataaaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataagtgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcagactaagcaaggtcgagggnnnnnnnnnnnnnnnnnnnnnnnnnnnnnnnnnnnnnnnnnnnnnnnnnnnnnnn

SEQ ID NO: 692 - DNA, 635 bp, Oryza sativa
gaaaataatggtcaaagttattttttggagaccgtgttcttgtctaaaacgataaatattattaacccggagggagtacgtaggattgagcaaatgcacattctgctattacattaaaagatttggcgcaacgcgcgttttgattttacactcgatatgccaaaattctgtcgtgctcatgtagacacaatatgagcacgccgatatatcgtttgtatgctacgacaaaaaaaaaactactttgcctcgcccacaaagctcagctctcaccggatgttcttcgctttttctttttccttttttcagccccatctgacctatccgatcgtcttgattgttcctgcctgatctccatcagcttcgctcttgcatctcggaagggagcatctgatctcatggccaacaattcctagcagaagagggatttcacatcaaagttaagaactagtagcaagagtttttgatggaaaaggagtttttgatggaaaaggcggaatcttacttttatatgatccattgcagcaaggttgaaacctatagcatccttgcattcctaaaggatgaacatcacataaatacattaccaggttgctgcgaaaggtataacgggagataacaaaagtaaccaaaagtta

SEQ ID NO: 693 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnncatactattgttcctactatggtcaactgagactttttaattcttccatttttgcgctcaacaccttatccctactagtgtcctagaaatatagattcccatccttatccacaaaatttagacctaaacccatacatgttttgaggcagcttttatcacaaaatccaattccatcatttgttcagacacatgggtacaaaatccatttcgtaatcttattaacttgggtacaaaactgagttcccacgttttagagcttgccacagtcatagtccgccattttcagaagccttccggcgagcactccggccaaccacttgtcccgcagaaagctgatgaccgcattgttactctgctgcacgatgccgacgacgtaggctggtccgacgagctcgacgcttcttcaccgccggattctagcgtactcacgtagactcgcctcgatcctctcgctctcggcggcgcccccggcgccgagaagggcgtcggcgaggcatcttgccagcacgacgcccgtctcgagcgccgggcaagccgccctggccaaggtcaggcgttatcgggtgcagcgcgtaccggcgacgcacgcgttccccttgctgatgctcgcgagcaagagcgacaggcggggccggaaacgcagcggcgacgcgaccacgtcgtttatgttgcttctctcgacgacctcgagcacctcggttgggatcttggagcctctcagcttg

SEQ ID NO: 694 - DNA, 906 bp, Oryza sativa
  unsure (1)..(906): unsure at all n locations
nnnnnnnnnnnnnnnnnnnnnnnnnnnnnnnnnnnnnnnnnnnnnnnnnnnnnnnnnnactctagttaaaatcaaatttcgcttaaccagtcaagaattgatctaaaaaaaatgacgctacaacagaaggggtaagtttggacaaaaattgatcgaaagcataacaacacgtttggtggatgcctctgatcttctaagtctaaagtcctcggtatgtacatgtcgtcagattggcctctgagctctgtcgccggagacatggcgatcacatcaccgagcaggcgttggggttctcgtcgctgaacagctgcggcgccggcgacatgtcgagctggtaggggtacggcgggtacgacggcggcggctggtaggtagggacgtcgttggggtgggggtggtagtagccgccggcgccgccggcattggggttggcgtagcccacgccgtcgccattgccgccgccgtagtactggtagtagctggggggaggtccctgctgctgcgggtacgcgaagtagccgtggccgtacggcgagacgtggtacgtgctcgcctcggccggcgccggcgccatggacgccgcggcggcggcggtggacgggccggcgacctcgatgctcttgcctttgtccttcttgtcgccgccggcggcgtctttcttcttctcgccgccgtcggcgtcaccgcccttgtccttcttcttctcgtctttcttgctgccgggcgccacggcctccacggcgcggttgagcttctcggtgagataggtcagcatggccggcacgtccattgtgcccgacaccttcacctcatccttggcattgccgtccattaccacttccttcacccctgacacatagcaaaagccagaaggcgtcagttttggagccaaagcaacaaaacaaa

SEQ ID NO: 695 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnnnnnnnnnnagcctgttactagcttatgacccatttgcatatgatattttgttatattggcctgagagaatgtagaaactattctgataaatctcgcagagcgtgttagaaggatataatgggaccgtgatggcttacggtcaaacaggtactggcaagacatacacagttggtcggcttggaaatgacgacccttctgaaggtggaataatggtcagagcattggaacatatcctttctgtcatgtctttggagacagatagtgtggcaatatcatttctccaggttctattctcaacaactgaagttatttgttttgtacatgtatcattatttcttattgatcgacattattcttttttggcatggaatggtggaattggtttaactttcttattagctaggattcttcaaactgtctcgattaatgcaggaagccaggaacagtcatatttatatgctaaagcttatatgattatcgtgccacattgtcacaatcatttttggacagattatgtaagacataacaccagtttttgtatttaatacatgacatcaaataggtcatgtattacaatatgtgtttgaacactttcactcactttaatattatccattcatagntccaggtagtttggcatggtaaacgtggacgacaagataagcatttttctatcg

SEQ ID NO: 696 - DNA, 1877 bp, Oryza sativa
catcaagtgtgagcagatgccttgcattgttacggatacggctcaaagcatactgaacacgccacagctcacgcttgcacctcagtccatactcacccactagcttcagctctgcatcaagacgctccttctcgtaagggcgacgtggcttcttgaatgtcttaccatctgcaatgaagtaataaatttgttcacaacacatgacagagaaagaaaccactgcagatagcatagttgttcatgaggaaccaaacaataacatagaaagaagccctacagtcccaaattccttatatcctgaccccaaaaatatacaaagcaagaaagaaactgcacacacaacccggaaagacaatgcaacaatacaaataaagaaaactacagtagttgttgagattacgcccaataatagtatggatattcaagacaaatagtagtagggatcttgtgtacagtaaatactaagagcttcagatatacaaccatgtttgacaaggatttaaaaaacaattcataacattgtgtctgattaacccaagaatagcttacatgccagatttagttttgctgtgttatccctggttgcccatatcatacatacctaaattatttgtcctgctgtaaaatggaattcatgacctaaagcgacaatacttgaaagatcttatcagggactatcatataatatatttaagaaaatatacatatagaatgcaattagtatactacaacttacacagaaattttaaaaaaaattaacaaatatagttctcgatggatcactctatggacaaacatacagttagtgcattacaagtatatagtcctctatattaagcgccattattcattttcataaaaaaattcacaagcttatgcataactccattccaccaaaatgagtgatcaaacagagtatttgagaacaaaaaactctagttaatgaatatcatatttccagtccttaaaaccggtaaattatcaaattttgtaccataacagaaataaacattttcgagctacataataccaaatgccagagtaaaacatgtcctcattcctcagtactatacaacacatattagcattctagttagaacccccaaataatctactacatatctcgaaattaaatccggaccacacacaagtttcaactacagaatgcgcagtcagtcgaaatcagcacgaactaatcggcatagatacggatccaacgcagtggaaacgagaaaatgaacaaagctacgggaacagaacgcatcgaggcaaatcttgatccagatcatctcgccaaccgaaccagccatcgcctaatcacctaaccgacactcgctaatcaactaagacacataagcaagagaagagggaaaataaaaggagaacattctctcgctgcgtcaaatcgcactagcaccaaccaagacgacgacgaagaacacaacaggtaaggcccgccgttcttggacgagagagagggagaggaggaggaggaggagctacgcacagttgcggtagaagctgacgtgaaccatcgtcgccggaccgcctatcacgggccgccgccgccgccgccgattgctggagctttggtttctcgaggggaggaggagtgaggaggagagcgcgtttatagtgcggcggcgagaggaaaccctagctttagggctaggttaaatgggccgagatttcccggcccattaacggacgggtgggaattaggcccacatatcgaatgggccttcggtgcaggggccatatttacaccgctcgttaaatggtctttttctcgttcttttttccttatttttataacagaaatgctagtcaccggtatactgtttcgagtcggtcccggacaggacaatttcccacgg

SEQ ID NO: 697 - DNA, 7140 bp, Oryza sativa
  unsure (1)..(7140): unsure at all n locations
nnnnnnnnnnnnnnnnnnnnnnnnnnnnnnnnnnnnnnnnnnnnnnnnnnnnnnnnnncaaaatgttcgaattggaatagatcgcttgaaatgcttctagctgtaacaagtattgcttggagcaagcaattttgccgttaacaagtacacactgtcttaaaacagagaaatctccattcaactagtaggattttttttgggtgaactgaagtgtaaacaaaatcagagaaatccgcatcactcggttgctagcttctagttccgggcacgctttgcttgacaattgctatcctctttgtcatagagggcagtgcgtggtgacaaagttggcaaatgcagctgagtcatagatgcagatgatttggattttttttttctgttgatgtttgcatatcttagtggctacatgggtgttttctgttttaaaatgatttgatacttttgttcaatcgaggatgaatcaccattgaaatgatattttctttgtcctttcacacatgtgcacagagttgaaatggcattgccacctgctccaagcgaatccgatttcatgcatgtttcaaagaagacaaggtgctctccaaggttgaacaagggctcagcttcacccccactttgacaaatctaacactgctcattcttgtcatctatgcaggactacatgaaagaatatcgtagtaagctatgcaaaaggttactgtaccatcgcttcaacgacttacatccaaaacgtcgtttctaagcttcagaaccaatatgcttattcggttcaagcagtgtcggatgtgtgcttaggccatttttgtagccccctccctccctctcccccaaccaacatatgtaacaagtcaagtttcagaattgtgtatgtagctactatttttgtcttgaactggaaggttgcgaggggcacaacaatcaaagacatgaactctgtatgtggctactgttttcatgtacagatatgttggtaaagaagtggattatattgggtagaccttttctgtggactatatatagtttgagtacgttgtacacaatgaaatcgagttcagtatcatatgaaacctgaggaaatgatactgaggaggatcatgatacctcccagagttcacatgatcctactcaagtatcatatgtgaaaccagtagggaaccactttacaagacatcgatattggataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtggtacatgtaaagtatcacaccatcctactaagtatcatctgtgaaacccatagagatcatgttagaggacatgatacctaagtaggatcatgttagaagacatgatacctaagtaggatcatgtgtgatacctcacatgtatcacacttaatgatacttttttgagtaggatcatgtgtgataagtatcacgccattaagtagcatttgtgaaacctattgggatcatgttagaatacatgatacctaagtaggatacatgatacccaagtaggattatgttaaaagacaagatccctaagtaggatcatctgtgatacctcacatgtatcacacttaatgataatatttttagtaggatcatgtgtgatacttgtaaagtatcacaccattaagtaccatctgtgaaacccatagggatcatgttagaagacatgatacctaagtaagatcatgtgtaatatctcacatgtatcaaacttaatgatacttttttgaggagaaccatgtgatgctatagaggtatcacatgatcctacaagataacaagagtaccatgtgatcctacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggctgacgacgtgtgcgccgatggaatcagccgagaaaacaagcatggaggcgcgcgattccccggatgaatcttcgggatgcggaggagctcgcgccggcgaggaatcacgcacggaggcgcttgattcctaggaggattcatcgggttgtggaggagctcgcgccgacgaggaatcgcgcacggaggtgcgcgattctgaggaggattcgttgggttgcggaggagctcgcgccggcgaggacgcgcgattccgaggctgattcgtcgggatgcggaggagctcacgccggtgaggaatcgcgcttcgtcgggttgcggaggagctcgcgccggcgaggaattgcacacgggcgcgcgattccggaggaggattcgtcgggatgattcaggcggggcggtgagcactggtacgatacgtttctgttcctgtttttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggacttggcccgtgcagagctagcacggcacggcccagtgtgcttcgtgccaaattgggccgtgtcggcccagcacgccccactcgtcgtgccgtgccgtgccagcacggcctcttcaggacgcggcccaagcacagcccaatggcccgacgggcctattcgtgccgggccggcacaagcacggcccaaaagatgggagcaggccggctgcgctgagaagaaactctggcggcgacgcggcagcggtggcttgcggcttcgtcgtcccgtcgcggcgacgcggcagtgacagccacacccatcctgctcctcctcgtcggctcgtcgcggcgacgtagcccaccggcgcggcggcgtgagtcagccaacaatcttgccaaatgctagtgctggcctgctgggctgctggccttgctggttgctgctacgtgctaccgatgagccgatgaagaaaacgagctgctacttgctgctacctgctggctgcataggaaatttgaccgtggatgggtgatgactgatgacctcgtgctgcagcagccattcgcgtaccgtgccggcccaagcacggcccagtggtcgtgccgtgccgtgccgcccgtcgtgcccgttgtccaggcccaggcacggctcacgtacgggccgtgccggcccagcccatttacgggccgtgtcggaccgtgctttctattgtaccgggccatcatgccttgggccggcttgataaagcatggcccaagtcccagctctaagcaaggggtaaactttgccccctcccccccaaaaaaaaaaaaaattggccaaaaacacatttcgcccaaaaagcctacttaaagataaaatactcagagagtttcccctaaaatataaaaactcgaatgaagttctcctctttatagaaaagttcttttaggacatgtttttacccaaaggaaacagcgttatgagaaaagtacattcgagttaatgtcaagtagacagatgtattcgagccaacttcatccacctgacattatttttcctaatagttgtatccgagcaggttcctatggagtgacaaggcgccaagataatgggaaagtatattcgagttctctggtgcggccaagccagctgaaataacaagaaaagaaggaaaagtcttatcgagcagttgactcattcgaggaaaataatcgtggggaccacttcgactactctaaccagctggcaccagatgtcgcctagggaccactagcaaagtactattatacccctagggcctatggatcactaggggtaatacggtaactttatgtaagcccatgatgacaaagatgtaaatatttgtggtcatggtcaaacactataaaaggccgaccagagtcctgtagcaagaacacaatgaaatagagaaaaagtaccttatatacatcctgacatctacttttgggctcactctcagggtaaacgggaatctacactttcccgtttacccccaactctgttcgtgccctaaggtcgtgacagtggcgccgtccgtggggacgtaaagtctccattggagtgggcccaagtggtaaatgcgacgttctcagagaccgaaaactgtgccaattcgttacactgacacttttgcaagtgggacaatagcacttgagaaggaacttgagaaggagtttgaaagagcatttgagcaaagtgatattgcgaacgtaacaaaaacgcttgaagagaagtgggcggaacaagtcaggaaaaggaaactgcgaatccctcaaaggaggaagcggggaaaacaaccacaagtgaagtggaacttgccgaaatggcacaagcacaaggggctgttatgataagcaaagaccaatacgaaggactatagagagagctacaaagactccaggctttgcacagtcaagcaattggagcaagtggatctggtgatcaactggagacataagaggctgatggaaaacaaccaaacttggcagaaaacactcatcaaggagatactttagctggagatcctcaagtcgtgaagttagcagaagagattcctcaagcccaaattatcaaaatacaagttcccacccaacaaatccttcaaatgcaaaaccccacccaacaaatccctcaaatgcaaaaccccacccaaatccaaaatactcaaacataactttccacccaagctcaaatttctcaaaaccgaattcctatccaacatcccaaccaaattcacttttcaactcaaattcatccttctcagattccataccagatataccaaaaccaaacacaaaatcctcaaaaccacacaactcacgctcagatttcccaagcatacacccatataccccagatacaaaacactcaaacacaaataccgggagggnnnnnnnnnnnnnnnnnnnnnnnnnnnnnnnnnnnnnnnnnnnnnnnnnnnnnnnn

SEQ ID NO: 698 - DNA, 547 bp, Oryza sativa
  unsure (1)..(547): unsure at all n locations
nnnnnnnnnnnnnnnnnnnnnnnnnnnnnnnnnnnatgctgcaatattatcagcagtgagccaactatacaatgaaataatagccccttttgaccaaatgtggaaaataaatctcatgagaggttggaataggcattaccattcattgccaaattagcaatagcaccagctgtgactcgatgaattgtggtattttctgatgtttctagaagtgacagaagagcatccagtcctccttcttcaacgattttttcctgattaacgtctgcaatcccagatggattggtgataacaattaactatggttataacagttgccttctaaaggagaaaacatagcatagacagcagataactgaaacaaatcactggcttcaatattatgaccaagtgcaaattacaattcgtatggaacagttgaatatgttcgtcaacagaatttgaacaatatgccactttcacatttttcacatattataannnnnnnnnnnnnnnnnnnnnnnnnnnnnnnnnnnnnnnnnnnnnnnnnnnnnnnnnnnnnnnnnnn

SEQ ID NO: 699 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnntcctatgacttagtctagggggtctggcacaagtgcatcatgattctgcctgttttctagaatctgaactagttcagttatcaggtgagcaggttcatatattggcgtgcatgtccgcttcgaagcaagaaacacaggtcatatctccctttagaattgctgccgtgatgtctaagaatggaaattctttgcaatactccacaaataaatctagtcatgccacagaaaatggtgatagtaatgtaaagaatggagagaatggttcccaggttgttgaggatgacatgcaaagtgttgaactcaacagcgaaatgtctcctatgacacaagatgacatgcaaaatgttgagctcgacaacgaaatgtctccttcaaaacaagatgacatgcaaaatgttgaactcaacaacgaaatctcttcttcaaaacaagatattttggagaccgaatctcttcttcgattggaagatcacaagcaacaaattgaaagtatgcttcaaagattcaaaatgtccaatttttttgtccgaattgcagagtcagatgaacctctctggtccaataaaaaactagctgtatcaaaggtgccaaaagagcaatcatattcagacaaccaggaaaacaattagggttcaaggagtaatgcttataataccatttctgataa

SEQ ID NO: 700 - DNA, 1328 bp, Oryza sativa
  unsure (1)..(1328): unsure at all n locations
nnnnnnnnnnnnnnnnnnnnnnnnnnnnnnnnnnnnnnnnnnnnnnnnnnnnnnnnnnnnnnnnntatttcagattggtgcaatatcctggtgagtttgtggtgacattcccaagggcttaccatgtcgggtttagccatggtgggttaaatcatacatattttgaactcacaatacttgttatttgattcatcagtatgtgctagttgttaaatcatctgaaccttgtatgctttaatttaatttctttatggtattgtcaatgaacacaaatcttttacaatacacagtgcatgtggctgcatagatctaggcatgaagtgcagttgtcgatgtgatggagccgtggtagtaatacacactcagttataatataaccaatatttgctactgttttgtcttgtcatgaatcataattcaagataataaactaggttattcagatgatactaatgggtaatggcaaaacaaattactctttcatacttgtttcctgaagcaagattatggtgatccttttaccgttgtcttaactagtttggtgagtttgatttttttcaacttcatactaattttttgaagaattcaagcttcttcgtattaacctatttgcgttcatagttttatggaacacttgagatcctcttaaggatctcactttatatctgagagtcaacctatctatgagattcatttactttgtggaaccaaaagaaacaatttgtagattgtggtatgttgtagaaactgaatatccaatgcagtcagcagcatgtcatgttcagtagattccttattttattttgttgctatgcatgctatcggcaactctaatgttcgtgtaatataatacaggattcaattgtggagaagctgccaattttgcgactccccaatggttgaagtttgctaaagaggctgcagttcgaagggctgtgatgaattatcttccaatgctctcccatcaacaactattgtacttgctagcagtttcatttatatccaggtttttttttctttttctttttggagtttggttttgtgctgtccaaagtgtctttttagtttttgcacctcattaataggttgatgaaacaaaatatattacctttgtcctccaacaaaccaaatgctacagctagtgggtaggggttagatgcttgttaggtctgccatacagaaggattacgcataaccgcaaaggtgaagttgtcatggtgctcctgggagacgccgcattacaggatcaccacaatgctaggtgtaagctagacttcaactaatcacattatatttcaagtatatcaggatggaaatataaacggcaa

SEQ ID NO: 701 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnaaataatccccaaaatgataaaggaggctgttcttgactctctggtgtttctttcctaatcttggaactatgtttgaggtttagacccatccgtgatgtccaatctgttccctcttcctcatatccctcatcatcaattgaaatattaattagatgcaaattagacttggacgcatttgctagtgcaacatctttatagtcaaactgaaactcaatttcctcagctattgatattgcaagtgcttttagtttgacataatctgcagataatggagggaaaaaggttatcactgaattcaggggacaaattaatcaaataatcacagttaaaacaactacattgattttcaatcatgatttaaaaagttcaagatatttggaaggaatcaaaagggcccataatacttaaatcccctcggctaatatctcttattttcagttaacttcagctgacaaaaacatgtcaaataaacaataaataaaattccacatccagtgtgcaggattaatacaatctacgggagttacattgaatgtgacaacagaagtctgcatcaatcgtacctgcattgcatatgatgagggcatgaactccacctttgctcgcaagcaactcctcaatctcaaggcatggttgtagcaaaagatccgagccgtgcaaatgcacag

SEQ ID NO: 702 - DNA, 729 bp, Oryza sativa
  unsure (1)..(729): unsure at all n locations
agttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccataaattctcgcaagaattctttctctgaaacttctcctctgctctgtttgctgctctgttcgttgttgccgctgcagttcttgccgtgccgggcgtgaacagtctgccagcaaggtgtttgatcggaatttttttgctattgccaacagccgagacgaaagccatggccgaagaacatcttgaacttgggatcgaagccgtggccgccagggtaacacgcgaggcctctcgtagccaagcgccccgagtaggacggctttgggagccccagccatttcgccaccacggaattcaccccgtcgcagccgatcagcacctgcatgcgtccccgccattaacaattcaagcatcccgggtaatacttttaatctccaagatagatatatataagctgtaacaaaaataacaaatcaaactctcattagtatacatatattcacagttaaatttgttgtttttgttacttccttcgtttcacaatgtaagtcattctagcattttccacattcatattaatgttnnnnnnnnnnnnnnnnnnnnnnnnnnnnnnnnnnnnnnnnnnnnnnnnnnnnnnnnn

SEQ ID NO: 703 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnntatctgtcaaaagacacggcattaatcagtaatacgattcagtgttcatgtcctccttgcagccgatcgagtgttcgacacttggatcttggcagctcaggtgactgaccatctggggaaggagaccacgtgaagaaccagtagacgtcggtgtcgttgcagggcaccatgcctgcacggaatccctggccgaccaactgcagaaacctgggctcgaagccatggccgtccgggtacttggcgcgtccgcgcgtggccgtgtgccccgagtccgacggcttcgcgagccccagccatctcgccaccaccgagttgatcccgtcgcacccgatcagcacctgcatccatcgccaccatcttctcctcagcaaccgatcgatcgacagagacagcacgcacgccatgtgtttttacctttgctctgagagtcgatccgtcagacagatggaggatcttggcgttgccgtctttctcgatcgagacgatcttggaggagtagcggatggtgcctcttgggagctcttccttcaacgccagtagcaacgcggtgcggctcacgcagcgtgcctcatgggttcccctgcgtcacaagtgttttcaggtgtgcgcatcacacgacaggggggaaggggagtagacagatatatcttc

SEQ ID NO: 704 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnntttggtgtgctatatcaatctatccttgcggcaaactctgaattgatcctatatgtatatgatctttcaagtctgcttataaaactcatcagcacgagattcaatgacataatttacatagtattagcaagggccctgatgtgactaacataagtagaggggctgaccagaaattttttttggacaaaaaaaagtatttagggaaaaagaatcaatttctttacctggaaacctttgtacttaatcagttctttaagtctatcaacaacaaaaagctggcctcctccgtcgaagtatccaagatcaccagtgtgcaaccacccttgcttgattgtaaattcagtagcttgcacattgttgaaataccctacaaacgcaacattcagataggtaagcaattgttttgttctattattattgcaggacagaatgcataagatatattgggatctattgtcagtgaaaaatagtgaggtctagtaggtggaatattttcaaatattttttgtatgctcgacatcactagtctttgttaaattgtgcattgtcaatgactcaatgtacaattgaaaacaaagaatacaaataaattgctccagttccattggaatatgattatagtattagactgatactgg

SEQ ID NO: 705 - DNA, 1175 bp, Oryza sativa
  unsure (1)..(1175): unsure at all n locations
nnnnnnnnnnnnnnnnnnnnnnnnnnnnnnnnnnnnnnnnnnnnnnnnnnnnnnnnnnnnnnnnnnnnnntctgtgcccaatgtgctagtttagaccgaatcatagtaatgtactgaattacttaaattgtgctagttatgaaatgataattacttaaaagatgttgattttagatagaactgcaagttttattatgtattcaccattatttcccatattatctgtactcacttcttttgttatattttgaccagaagaggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttctgagaaaaaaaaagatttaaaaatggcgcacatggacaatgatgtggcgttttatactgaagtagattgcgaagcaaacataacggtgcccaaggaaacatgccaggtgtagctaagttttttctaaaaaaaaacttaataaaaggttgagtagaaatgctaaattgtcaatgtttttaaaggaggaaacatctatctagtcagctcttgtacatttggattttttttagaactttacatttggatactaaactgtgaattgagtaaagggcgccaatctgcaggttgtcacggcagagaaggcaagcaaagatggcctccaggagaagttgaccatgtctgttgcagtgccatttgttgtggggtgttccttcagcatcagagacccttcatgtcgcggtgcggagcggtggaggcattgtggagaagatctactggcaatgggacttattttaaaagtcccaagccgtccagtcattaaca

SEQ ID NO: 706 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnnnnnattctttcagttttttctccaactgcattttctcactgtttttaagcttttgctgcctctccatctctgacgtaagatgatcaacttcatgttctaccttcttatataggctttcataatcaacttcctcctttatccttatcgtgttcactattttcattgcctgaaatcacataatgaacgacttaatgtggtgttataacttataacaaaaaaggaacaagaagaaggaaacgatataaaacaactagacaacatgagtttctttctttgagtaaatgcagagttgcaattttaaacaacgagagccattgaattcatttcaagaggaaccagtaacaagtagtttagttcatgcatgaattaagtctctgatgtaatgcaacatgcacagtttgcactgtgtgcaaattaatgctgctcagttcactctagtaatttatccagatagaagcagttgaaatgatgttttcaactccatgaaactaagagcattatgttggtataagacaagtgcatggcataatttaatggcctgggatggagtagagttcaaatattaactaaccatcatatatctaatgggattcactaaaaatatatctagtgggaaaagctctgaataccatttacaagaat

SEQ ID NO: 707 - DNA, 745 bp, Oryza sativa
ccacccaaatccaaaatactcaaacataactttccacccaagctcgaatttctcaaaaccgaattcctatccaacatcccaaccaaattcacttttcaactcaaattcatccttctcagattccataccagatataccaaaaccaaacccaaaatcctcaaaaccacacaactcacgctcagatttcccaagcatacacccatataccccagatacaaaacactcaaacacaaataccacaagtacaaatcccacaaatccatatacctcaaatccaaacatctcaagtgaactttccacatacacatgccatacaaaatcaagcaacacaaaactccagtcaacatattcaaaccttttctccttttcttacccaataagatgcgacaaatgaacaagtgtacattccacaaatgcccaaccacatgcaatacacaggacaattaccaaaccaaacattcccattccaaacaactcaatcctattttcaaccaatcaaagcggtggacaccaaaagccctctgatccaaaatctgcaaatggcgccttggccattaagttttaagttgtcaaatatcaccaaatacaagggtgatacagatcccaatgaatatttgagggtatatgaaacagcagttgaagcagcagggggagatgataccacaaaagcaaaaatacttcaaaccatgttagaaggagtagcattgtcatggtatacaacaatactaccaatgtcaatatattc

SEQ ID NO: 708 - DNA, 270 bp, Oryza sativa
acggcgagaggctctgcctgatcccaagcaactcgatgaactcgacgggcaccatggggacatcccgcgcctgcgcgaaaaagaggccgagcacgaacagcgcggcgaggcccttggtgagctgcgcgtcagagtcagcctggaagctgaccctgtccggcgcgccctccttcggagcggcgtggacccagacctgggagacgcatccccggatgcagttagcgtcagtcttgagcgcggggtccatgggcggcagacgcgcccgcgcgg

SEQ ID NO: 709 - DNA, 640 bp, Oryza sativa
  unsure (1)..(640): unsure at all n locations
cctcaatcccccacgccggcggtgctgcggcgccgctcccatcacatccttcctccgatcggaatcggctcctccactcggcgcactccactttggccgattcctccatcctccacgccggcagggctgcatcatcgttcggttcccttcgtttctttccgctggtacccatcgtgctctggctgatttctcccctctccccacgctgatggcgctgcatcggtggcgagatccttcacgcgcaatcccctctcgtgcagcagactcaaaactgcaggtatctgattcatcttaatttctaagtcccatttcctatgtcttctcgcaccccaactttgcaacttactgattcagctccctatctacatttgtgttctagggtttacaggtagtgaggctgaagcggatggggggagtcatgtttgatacctgagctgttaaaattaacaggttagttactcatctcatgaaacttttttgtttgtggttggaatctattttttgtgatgcgctagtacaatatggacacacatacattttgtttccagcaatttttattagaaggggttgatacctaagatgnnnnnnnnnnnnnnnnnnnnnnnnnnnnnnnnnnnnnnnnnnnnnnnnnnnnnnnnnn

SEQ ID NO: 710 - DNA, 551 bp, Oryza sativa
gtgcccgtgcgttacaacggagaaaataattcacacctaactacgactcaatatataaatgatgcaaaattgtgaaaaatgcaaaagagaaaggaacagcttacgcctaaatctcttattctaacatgaacatagaagagagagagaaccatgcatgatactagctgtttctgaattttatcagagtccacgaattccgtagcaatttggctgtcgatcaatgcagccttgtccgatcacttcttggccgtctcctcggctgccgccttgttcgcctgcgcatccgccgccgccgcggcggtcaccggcggaccagccgcgggctccttctcgcctccggccgcctttttctcaatctctccagctgccttttctgcctcgccgtccttgttggcgtccgtgtcgccgccggtgtccttcgctggctgcgggggaggaggcgccatgtgcggcggcggggtctgcttgagcttcatgaggacctggcgcatccgggagaggtcggtgggcttgccgggcttggtgccctggacgaccaccacgccgggctg

SEQ ID NO: 711 - DNA, 18263 bp, Oryza sativa
  unsure (1)..(18263): unsure at all n locations
nnnnnnnnnnnnnnnnnnnnnnnnnnnnnnnnnnnnnnnnnnnnnnnnnnnnnnnnnnnnnnnnnnnaaatggggttggtacctacaagcatcggaggctttgattggtacctcccagtgaaggtatcatgacatggtaccttggtacctcacacaatggggtttggtacctagtaccaagtaccacatctgaacctagggttactgtggaacatatggtacctgctaccaccaccttgtctaaactaggtaccagacctggtacctcaaagaaaacccaggtatcaggtataaacctaggaaccagacatgacacctcacaggataggggtaccagcctcacaaatataggtaccagggtctggtgcctagcaataaccaaggtaccagacctagtaccttacataaaacccaggtaccaggtctaaacctaggaaccatacatggttcctcacaggataggggtaccagcctcacacaatacaatacaggtaccagggtctggtgcctagaaacaaccaaggtaccagacctggtacctcacaaaaaaacccgggtaccaagtcttaacctaggaaccagacatggttcctcacaggataggggtaccagcctcacacaatacaggtaccagggtctggtgcctagaaacaacccaagtatcaggtctggtacctcacaaaaaaaccaaggtaccaggtcttaacccaagcaccagacctgatactttacagcacatggtcactataggtattatgactggtaccacacagtcatgaccagctcactacatgtattagtcatgaccagctccgtacatctcacaacaaggtaccaagatcacctcacagtacaagtatcagataaaattcaagtctcaagtgcaacaaaatttgacattctctgaccatacatcacaattgttcagaagctttcaattcagtatcaggcatcatcatcatgacttgatacttgttccatcgctctttcaacagagacatcttccttgccactctgttggtctttgatacttctttcaccaaggaaatcactcccttcatttgctatcttttctatcattcttccagcggatccaaccgaggagtccattttttaactgaaactgcaactgcatgaataattcacacatttttttcagtaatttttttggccccacacaggcagaacacaaaccattatagcttgaaaaaaaatagagacatgctggtacctacactagagacaagctaatacctaaactagagaaaaaaaactcatgcccaaaaactagagaagatgatacctatctgggaggacgaaggagcactcctgctcggagtgaggcgtgctgggttctggctggggccgctcggagtagttgcggcgtcgcggagcgtcaccggtgaggtatcgcacacctccgcgcgtgataccgagcggggttctggcttgggggagtccctacttggagtaattgctggcggtgccggcgaggtatctagggttcggggcctcgatacggggcggaggaagaagcactcctgctcggagtagttgtggcgtcgcggagcgtcgccggcaaggtatcgcgcgcaaaggcgcgcgatactgagctgggttctggctggggccgctcagagtagttgcggcggccctctgcgccactggcgaggtatcgcgcgcagctgctttctggttggggttgctctgagtagttgcgtatcagccgggttctagatggggaatcgagcagagttgaccttggtcggaaaaacgacgaagtctggtattaaatctgtcggggtggttttgttaattatcccatgactactgcgttgcaacggaatcccgtacggtagctgccctcatccttcaaatgaagtacacgtatagtcatcttgctgccatgggacacttggcataccattgaaaaaataattaggtacgtagtacttcctccgttttatattataagactttctagcattgcccatattccaggggcgaagccaggataaatggtcaccggggtcagtattaaccagggtttacgtttttgaccaaaaccaaccaaaaatcatgtaatttgatgtttcgacgtgggacgaaaagtatattttgagtgaaattttgaatgttttttagaattcacgacaaaactatatcaaaacttattaaaatttggtgaaaaatatcgtatcgctacattggaatccaacactaactcggaaatgtcatctagtttgtaattaatgatctaagactatacaaaatacaagacaaaataatgacaatacattatgataaaatgaaatgactacaaatttgttagaaaccatacattattaatttgtaaaagacaccaaatgaaccaaagattatcaaaaccactgattcttgcctttcgttctgctagaaaaaaaatgatataagatgtcaagatgtgcagcgctggtgcgggacaaagtgctcgaaggaatatgatggcgcaacaagagaatttgtggagttatttttggacccaaatctcaatcctatatgtatattgggctgatgtataaatcataagtgctagctaattttttatttgttggttgttagtatcgttcctagtcactaattgggctttgacagaacaatcagtaatatcactagggtctagtttttctctttgctggggtcatagatggtaaaataaagaggggtaggagaggttcgcaaaacatcgttcgagtcaacttatccctatgaatggttgtagcttcgcccctgccatattcagcaatgctagaaaatcttataatatgaaatggagaaagtataaccatataaatcgaagtacttgcgctgggtcgaagactcgacctaaatggataggttccaccaaaagaaacataaccgtcggtaaaacgcactcatgctcacgctgtgtggatgcaaaactgaacaactcttaactctgtcgaacatctacaaataactgaagaacagagaaaacagtatgtgtgagcagagtttgcactgcatatactagcgggctgattcgcttcagatcgtatcttccagccagctgctgcaagtatacagaatccagaagaaaattaacgtgcagatactacgtgcaactagcaaagcaaatttcaaagttacgaatccaaaggaacgcttttggcactgaagattatcagctcataatctgacaaccaaccgagttattcgctgcacacatatacagtgactagctgagtgcccgtgcgttacaacggagaaaataattcacacctaactacgactcaatatataaatgatgcaaaattgtgaaaaatgcaaaagagaaaggaacagcttacgcctaaatctcttattctaacatgaacatagaagagagagagaaccatgcatgatactagctgtttctgaattttatcagagtccacgaattccgtagcaatttggctgtcgatcaatgcagccttgtccgatcacttcttggccgtctcctcggctgccgccttgttcgcttgcgcatccgccgccgccgcggcggtcaccggcggaccagccgcggcctccttctcgcctccggccgccttcttctcaatctctccagctgccttctctgcctcgccgtccttgttggcgtccgtgtcgccgccggtgtccttcgctggctgcggcggaggaggcgccatgtgcggcggcggggtctgcttgagcttcatgaggacctggcgcatccgggagaggtcggtgggcttgccgggcttggtgccctggacgaccaccacgccgggctgcttcgccttggcgttggcctccgccgactgcttctccctcctcttgccccgcttctccagccccgggatctcgtgcggcaccatctccgcgatcgccttccagtactgcttctccgcctccccgtggaacttctcctgcttcgccaagaacagctgcaccatccatggcgatgatggcgggtcagtctgatagttcacgagttgtatgatgtgcagctcatcaatggcggagaagaagatggtgaccgaccaaccttctcccggtctctgttctgagcccggttggtgtcgccgttgagcttgcgcttctcggcgaaggatcgcttgaactcgtcggcttccgcgatgatctcgccgcgccgctccctctccttccgctccttctcctccagcatcagcgcgttttggctgcagaattaaacccatcgatttcttgatttctttttcgatcaagctttgggggaggcggcagatcagatcaagaaatgcgcgcgaattgatgctttttgggagattatgggatgatcggagtggagcacactcaccggcgccactcacgccggaggatgccctcctccttcatggcctcgggcggcggcaggacgggcccgtcgtcgccgtctccggcgccggcgaagaggtcgtcgtcgatgccaccgccgtcgccgaccaccacgccgccacccatgacgtcgccgatctggtccacgtggccattcatcacgtcccccgacccgccgtacccatacgcggcgccgccgttcgagctcgagcccaggggaatgccggcgccgacgccgccgtcggtcccggcgccggcgccagccaggtcgtcctcggaggcggcggtgccgaaggacgagtaggacgtggcgaagcggtggccacggcgcagggcgccgagcccgccctgggcgccgtcggcggcggggtcgaagggagcgggagggagcacgtcgtcgtcgtcggcgtcgccgtcgccggcgacggccgcgacggagtcgaaggatgacatggcgatggcgcacgcgcgcggtaggatgggatagcggcttaacggatctttgggaggtttttttggatccgacaagagtgttggagaggaagagggaggtaccgttattttcttagagacattgctcggttaagtttgaccgttattttctcgttttgacattttttttacataataatttttttttggcttttacttaaaaaaactacgacataattttataaatgaataatgattacaaaattacatcttataacttaaggaaaactaattacagtgtattgtataaactttgcccatcctttttatttccgtaagttttactctttccattgcatactttggatcacttccatactcttttgttagttgaccataattttttatgaaaattaatacaacatatttgctgtaaaagaaatctatttatacgatacataaataatttttaataacaaataaataatactagtttagtcatttctacaaataaataatatatcgcataataaactcatatatactatttaaaatgttagttgtggtaatatccatttccacaccatccttaccaggctaccactgacatgtgggctccataatctatactattatattatattatattatattacaatgagtcatctcccgtttcattattggctctctccaaatttcaaaatcacctacttgttcaataaagaaaattatagtattgcctgaactaaataagtgcttattaattgatttaataaggtagagactcaatttgttttctgttacaatacattggctctaagctagtaattataatattatcatataacaaatttctaccctataacaatatactacataaatttatatgtttctttataccaaaatgtaaaatggactttttgatagaaatgaatggtcagcttaagatcaactgatgaaaaaggagtaagagagaaagagagaatctattatatgccaccgagtttatcacaagtccataatttaccactgactttgtcacgttctataatatatcatcaactttggcttaacttctacgatttaccattgtcgtccggttagccttcgttagtactgtacaattttgtccaaatgaccaaaatacccatatgataaaaactttcaaaatttggacaaaaattctgaaatatcagatattaagtttttggcaaaattttggatttttacaatcttatatttctaatatgatattttgaatttttgtccaaattatggaagtttttttcctaggggtattttggtcatttggacaaaattatatagtgctaggaggctaatcggacagtgatggtaaatagtagaagttaagtaaaagtcggtggcattttatagaatgtgataaagtcagtggcaaatcgtagagccgtgacaaacttagtggtatataatggattctctctaataaagatcaaaactaaaattcgaagatagacaatgtaatgagcaaaaccccacagtataaaagggattgaggaatatttcaggagtatatagggaatatttcagttagcgtgagtatgcataactgttatttctcccaatagcttactagagctatatatattccttctttttcgtaaatcagaaaagtagaatcttcgaaatcatcagcccatgaagtagaatcttcgaaatcatcggctgatgattatgtcgatcaaagttcactcgtttcaccgccgactaacgtctaatcaatgtggaagacaacacaggtaactgagccgtaaataagtgattcgtccaagcgaacccaatctgatgaggacaccaccacaagagcactatactaatagggaacctccagtacaacgcctttaaatagatcgagacatctagaatatcgtaatcgctatccccgaacatatagaacattttttttttacttgtagggtctaccgaagacatggaagagagacggggcatcacaacatcgtctctaggaggataaatagtgcccacatgtgtcactgatgtctctcctcaagtggtagccggctctcccacaacagcaatggtggctaccaaacggatgaattggccgaattggccacagtaggagaagtctagaatggatgaattggccgagctctcagtatactggtccttcaattgctagtctggctagtctgaacacggttttctaaagaggcaatttcattcttacccctattttaatatccaacattaattttatctctgttttttaggtttttttatttcttttttttaagaagccaaattttactcccactttggactggaggatggatatggacatgttgacggtattaaattttttatgaaaatacatccatacctttacttgctattacacatttcacactttgtttgtcaattgtgcatctgccccctatttgtacatgcagctagtagttctgataaattaactttgacagaatttcaacaaaattttgtttccggcaccgcgttccagaatagcacattccaccgtcgccgtggacagcttgagcttgctaagcatcaacacgaaccatgaagtcagaggctgggacatacgacttccaagaatcagcctgcaaacgaatggttccacgtgtttcaatacctttgaattgaatttcttatgacgattgagaagatagcgcatgcaagaaaaaataaatgcagacatcgtcgtttttacagatatgaaccatcatattggttagccttgtctagtgcacaaaccaaaatcagttaaacattccagtaaagtaaaataaaatatggctaagttagagaactcatttcaaatagagtgaataaaaatcgaatcctcatgtcattacatcttaggaatcaacaagatacctatcaagcacaagttcacaactaaagaaaactactacattcccctgagaaaccttattttgctgagaggccaagacctgaaacaaattattgagacagcctctaaatggaatctgggactgaaattattgaggcaaaataaacggatcaactgcaaaaaatgggaatccttagtttccaactcttttcagactcccagcacgcccagatatatacatacaggcatagcagaaatgtatgtacagatattctgaagccacaacgttagaacagctcaaaaccacactatgttagttggtgcccagaatcattctgttccagccctacctagacttctcattgtgcacctcgattgtacctaaatcaacctatttctaaagtctcaggatttatctggtccagggacctcgaaattgcctgttcgttaagttgggcattccaggattctgttgtatcaggtttgtccactgcatgttattcagagaacctacagatgctacatgactgcttgaactactgggcagattctgggtgtaaccatatatactaggagcttgaagatttgtgccttgagttctaggaacaaaacttccagacataggaacttggttccttatttcaaggagctggctagggctggacctaccagattgcatgtgtagcgacgatgacggtagtctgtactgggccaaagcactgaagaggcttccatctgtgttgctgcttccaactggaaaggcctggggcaagcagttatttgactccattgcaggccaattatcatgtggctggtgctcctgagggaagcggttatatctatgatccatagaaccagaagaagcgaaagaatgctgttcaaggatagaattgtttcctttagtttgaaaactcacatcagaatacaaattcttgtgaagttcatcataaaggacactgttgctctgatcaaccaactgttgctcctgcaagggactgggaaagtgagtgggctgagagaatcggttgttgtccaaagaatgcaaatcagttgactgcccaatgcaatctgtatgttcaagggagtaaggaagcattccaatgtcatttgctactgtctggacctgaccattgctttgccggtttgaacaaggttgcataaatgacgctggattgtccattgggaaggcagccgcaatggtgacttgtgactgctgctgacttaaaataccattctccatgcaaactacagaaccctgttgtccagcagggagatgtctatgcccaatctgtaagccacctgaaccattatacacgctactattctccagtggaaggtaataggaatcatcaggttcaggcaactcccataaatctttaacaccttttgctgcttgaccatttagatgttcttccacaggaatttgtccccctgaggtgttggaaagcaatgtggaactgtttgatggtatcactgtagtattctcaacctctttcgaatccatagttacatcattcatctctggataactgtttactaaagaaatatcatttgcactatggcctttgtctatcataattttgtatctggtgcctttcaggccctgattttgctcatgagcatgcattgatggccctgtgtaagtaatgccctcaagactttgagcttgtgtattttggctctcacgagtgtcaatgggagcggttgtataacaggtagtcttgatctgccgtctctctgggctatgatcaataatagttgtatctgtatagcttatttctttgaaatcttcagcttgaacatctggaccatcattactgaattttgtattcacgaaatcttcattctgctcctctacgttgctggcacagaatgaaatgcttctatctgcacagctggtgcccttgtaatcttgggcttgcaaatcagagttctccctaccctgactatcatgatggtcagcagatgtttcaatatgcttggtttcatcatcatcacaatcttgacgagatgggcaatgatcattaccaccttgcaacatatcttcagacaactgttctaccagagcatcctgcaaatcagtgctgccgtcattttcgcaggcaccatgttgaccaagctcttttgttatgcctgctaactggtctgccttctcatcataaacaaaaataaataaaccataatcatctattgagtactcaaataattatttcttttcaaaggaaattatgtccgtataaataagtagaacccctacaactaatcgagtgttattgtgttaactttctctagaaaatgacaaggtactacaacatatcagtaagaaaacactgcacagcaatttcccttcagtaatgacaattttttagatcttccacagtagatccattacaaatcagtattttatacacatggtaacagagttttagaatgaacatcatgtcgaatagtaactttgctgctgtgtatgatatgatacatgaaaaatacaagacacatagtagtaggaacaaagtgatatcatccactatatttttcatacattcaagtaaaataccttgatctggaaaatcaaaagactttcaaacaagaattgaaaggattagtcacagcgaacctttctcatgatagatacattcttttcgcctagctcaagaccaagtaaatttctcagtttctctgttgtcaccctattgttcttaaggacctcgaaagcagcaggtatatcattgcaggatatgttcaacctatatgcaaataatttaccataagaatcttgaacccaaaaacaagataaaaatgttaaaattaaaatgttactaaccaatgttcacgcagtctcctctgttcatcatctattaatgttccatatggttttacatggaatttatcaaggttaccaattacacgagtaagatgcttggttttaatgccatcaccagactgcttcatgctcttaacaaggttgtgctgtgttctgctgatctgaaaaagttaaacaagcattaatatcacagaacatcgaattatatattccatatagtaaagtatattacatatgattggtcaaaattagatatctgttattttctgtaaatattagtcaacattcagaactatataattgtttagattagctacatgcgttaactggaaagaatcatcaaatatactttctaaaagctctgctgcaaaatattatatattaaatattattggctttttatgctaaagaaacaatttggcagttagattgccatctatccaaatttgtaatcaaatttacacagctctagctgcggttaatgttacacagtaaaacaagactattaattcttcaaaagaattgggaaagaagataacaataatttaggaactaaataagagaaaggggttatatatgtgagataatggtaattaagcaatttaagatttttattatagagctgatatcattcattaagcatttaattttgctttgtaatataatcctcaaaactagaagaaaaggaaataaaactttgggagcaaagaaagcaaatatacaaatagaaggttagtttcagcaatatatacaagtttggcagctaaatgtctccttttttattttaagatgggcactgaaactaattgcatgatttccatttggctattacagaggtgcacaaatacaagactgagctcattgttctttcttaatgaagctccaatactctcccgagagagagagagagagagagagagagagagagagagagagatgctcaaatagccaatgctgaacaaaaatacttcattatggctcacataacatcttacctcaatatatgacataaacttcgaaacatcactactctgtgcaaccttcaagggcatttcactactggtaacttttggtcgcgtatctccttgcttgtgtttagcaaggttattatccctgcacacacataacggatagaggttttagcaattcagaagtcctttgttgaaattagatagcatctctctacttaaatatttaatcagattatgtcttttttttccttaaaaaagtcaattggtaaaagaaacattgatgactgtttatacaattagaaaactaagctattttaatgcacaacaacggcagtaattgaatatgtcgatatgattagccagaaaactaaggcacttggcaattttaaagcactgaaatgttagaactacacattgatcgtgttacttggaacaccactcaaatgtgaaaaaggatagtccaacggcaatataatgtatgatttgaagaacagaaggatgaatagatgataattttgcaagtggaatttaaaaggaaatgagaaacagtaatttatcaagatacagaatatagaagatcaaaaaatttaagaagcataacctgaacattatttctggatcatcagaacttagccatctcttcttccatttcttcaaggactcaaccatgctgcacaattatcttagcataaatatcatagccaaaatggtacatttataacagaattggatggtttggtatacttggaatggtagttattcaggttaacacgatatgccttctcgtcagctctaatttgcttctccttattaagtaaggcatctgggtgagtatcaccatagcaaagagaggaggacctgtaatttaataataattcaatcagcaatcaacatcttgcagaaattgagaagtatagaagtctagtgaacaattttaaaagacaaaagaagtgcagtgcaatatcatttgtgaacaactgaacaaacaggcaggcgttgtcctggagcagggctgtcagggcgactgtcctgggccccggacccaagcccacatgtgcaccacgagttagttatgtatcggtagccaggagactagtagaggcccgtgcaagccaataattgctctcattccgcttctgccgcaagttacgaaaagttgacaacgccttgttccctatttttccaaaatgtacactgatgcagctcctaatctcctgtttggttgctttctttcacataattgatttgaagaatttcaacccggcccatatctagttttgcaagatcaactccaaaaaattggatctttgcttcatagtcaaaataaaacatcgaggtaagacaagattattagatccaaacattgttgctaaatcgtaaagccgagtcgagataccatctaccgaataggagactagtattgactagtcattgagttgactattctatcatggtgttactacatatatcgattacttctactgctaggatgttattacttgctgtgcctaatggacccagtggagctctcctctcatctccctttcactcaatagggcctgataggccaggtctcccaaacaactcactgttgcagccttcactgcactcctttgcgtcttctgttgccagcaagtcaagtcgtgccgctgaagtggtgctccatgaaagactttaggattggtcataggtaggacatgaaaacagtgaatccagaatattcttgttattttgatttccttggtattgctttatttctataatacatttgcactaatttttaatggtaatgtgtccttttctcatttcagcactcctctcagagcgcttgaggactttgtcttatacgtatttttctttgttctatttcagtttatacatgatcaaaatttaggtgcttttgttccttattcctaccaaatcttgtattattgtatggtataaattactgtatttagctgatgcgatattctctcatgctccagagtgtatatcctagtagtgtgtaatattttttgaacattacatttgttactataataaaattactgttagcacctgcatcataaacaggacttcatgatccttggacaatcatggtagtaaacatctgctggagggaggtcgcttggtgacaacttcaactagaatggacggtgatgtgaggcagggattctagattaatctgtaatagaactggggaagaccagggctctgtttagggacttgtttattcgtctttgtttgacagaaagagatgccagccccatttatagatgagttgacccacgggatgcttatctctaaaactaaggaaatagataacaactcaataatatctctaaaataacaactgaatactgctgatacagtatcaaatgggaaaatagtgattgttcacatgcatgaacggtctatcgattgtaattcatgtacgtgacagacaatgtgtgcaaccacatgcctaataggaattatgcatgaaataggataaaaatgaactctaatgtcagcaactagcccactatatcacttttaatggtgtggatcaacatgtattgcctacaaaatatgatgagtgtaaagggaacattctggggtatcagtggcttttggtgttagtatgagccttccagaatgagtcatagtccctcaatttggtagctcttgaaatccaatttaaaggttttgtttgatatgcaaaagtacattttgacattatgttagcttatgcattattctattaatcatatattcatattggagctagtaattgttcggcgtacataaataccaggtagaatattttagaaagctgatcacatttacgtaacacttagaaagagagttggcatgtgagctggagcaacacatcccaagccccagctttagcaggacaaacaattatatgttcaacaaaaacacaaaatgaataagggacaaactgcatgacttctatgatggatgtaaaacatacctaacttgttcccatgagaatatgccaaacaaaataaaataaaatattcaaatggagaatcacgccacatctatgcaaggcaaaaaggagttctacgaggaaaagcatatatccacctgtttcaaaccttattgatattttttgaacatacactagaatgaagatgaaacaagtaggcccctacagaggcaatttctaaaattgtactagaacgcaataaaaaatgcagctaaaatgtctagaagtgcaaatggaagtgatcacagaaatcacatcatagagaacttgccagctgagggaaggatttccaaagtgataattttggcctttaagcaataaatgaacattttcttctgcatcaatctcagttggaagaaactgtatgagaaactttctgtcagcttctgtcagacatgtatcccaaacctataatcaattcacaattgtcaatattaatatgtaataagagtatacccctgtaatggggcatcaagatatcaagatcattattctaaagcaattaaagctttagcacgaaaaggcaggcattgtgaaaaatagatggcaaaagaacaaagcttacatacaaaggataaactaatcacaccttataggacagcacacttctcaagttctccaaggaaaatgtctctggaggaatatatgtaacatcagccagccctgaatcatgcttctgtctggaatctatgaatggtgccaagtctgaccacaaaatcccaacttgttccttttggggaaccactctcttttgatagtcatcccatttaagagcaatttgagacttcaaacttatatggcaattagaagactcaacttttgacttcttccatgtcctgttttgatctgagttagtagaccttattatacgtttcttttgcttgcctgctgccattctgcaggtcatctgatcataaaatggaggttgtaaatctttttaccaatatatgactctaatattgcctctacactaatgtatgtcccatgtcaatgaaaaacaggctgcacctgaaatgtacaataatttggtttggttggtagctcaaagacaattggtaacaggaaaaaatatatatagatttttcagtcaacttaactgtggacctaggtataccagttaaagacagaaagatgatgtaagaaagtaagaaaaaaaaagcttcccgaccacccaaagcttgttacagcaagtttgacacacccaagcaacaagacatcctacaaggaagacgattatcatgcaatgttgtctgggtgacaccacacggcctccaggcacccggccacccacagagagttaactgaggtgatcgcaagttccccaagttaagcaaccactgcaagccctctgcagccttgttcctccctcatataccttaaacaccttttttggataaacatgacagcatcaaaagaaaactaaattttacatcttactgtttagtattcacgagtcgtagcaattcataatccattttagcatttcaattttctattttgcataaatagtactttatatcacaattaaaatttaagaatgcaattacataagaaaagtgccactttgaaggaaaaataccaaatcaatatatagaatcacgaaggatatttgtcagtaatgtaaattatttcataaataagattgtgactgtccaaatgagcagtcatgtaattccaacgaacgctaaaagttaagataagtttgtgtgtattgaccccgtgatgagtataataactgtctaataaaaattgaccagattttacaccaaagaaaatcaaattttaaaatttaagataactaatatggctgcaggctgctagtatctgaacaaactgttcctacaaagttaagatacccaaaggttttaacccaatccatcgtgtcatttggctggcattgctaacaggtgtgcctaatttaaattcataacttctcatatatctgcgactcaagtattcatcacagccaaatgtcattgtcagtagttctcctactttccatatcacttccatgttaaaacaaactataggttgcagccaatcaaagtgtcaacaaatctagggccatcaaagtttaaactttgtccttaagttgagagggcctattgacacaacagcggccagcaagggtgaatccccacaataaatgtgctctcccaaaagtgccagcactacgaaatccggagcaacataaagtcaatatgaaccgcaatccgtgcctagtgtttgttcaagaaatacacggaaccacaacaattagctgctaccattatcgaattataaccaaattcatggagtattcctccccccaacccccctctacacgattctccaagggttccatcacgaacgcaacaggaacggacgagaaccctaccgctccccccgagggcaaaccgaccgcatcgatccctaacgcgtctactcccaagtcccaaaccacccacccacccaccccacccatccttccatccatcggatctaggaggccaggaccagatgccgcggaacgcgcgtacacgtacctcgcggtcgctgcgggagagggctaagcctctcctcctccctcgtcgtcggtggcggcggcagcggcggcggcgcgggagcctcggcacccagttctgcggcggggggaaaccctaaaccggccgcgcccctgagggctgaggctgaggtctccgccgagaggaaatctgggccggcggcgacggcggcgggggatggtggggtggaggtaagcaggggaaaggccctggataaagtagagagcggggataggggaagcgacgccacacgaggagggaggaggaaggagggagccttctatgtggagcggttttgcgccccgatccgggtaacaaacggtcatagacttaccttcaacttcaatatcaaaaatcaaaagagagacgctacaaaacggaatgctgttcgaacgggacaacattaatatggtagttacgattcggtccctgcgatttacggtgatatgtcctaaatatcccagatccaaaaatcaaggtgcaaaaccaggttcctcctcggcatcgcgcgcgatacctcgtcggcgtcggcgacacccagatcctcgtcggcgacggctggcaacctcattggcgacacccagatcctcgtcggcatcgcgcgcggagcgcgtgatacctcgtcggtgtcggtgacacccagatcttcgtcggccacggcccgcaacatcgtcggcgacacccagatcttcctcggcatcgcgtgcacgatacctcgtcggcgacacccagatcctcctcggtatcgcgcgccaccgcacgcgatacctcgtcggcgacggccggcaacctcgtcgacgacaccaaaaacatcctcggcatcgcgcactaccacgcgcgatacctcgtcggcgacgccaactatatcctcggcttgcacgggcaatacctcatcggcgctgaccacaaccagaacactcctcggcgttgataggtattttcatctaaacttgatacctaatactagatgttttgaaacttgatacctagtactagatgttttgaaacttgatacttgatactagatgttttaaaactggataccttatactagatagatgttttaaaacttgatacctgatacttctgtaagtagaaatgctaaatttgtatcaaaattggtgaaaaaagaaaactggtaatattgtccatggtaatcttacacttatgttttgtgctcatttatcaatgtttgtgctcttgcaaaaaggctgataattattttttagtaatctggtacttctgattgtagaactgaaaaaag

SEQ ID NO: 712 - DNA, 2057 bp, Oryza sativa
  unsure (1)..(2057): unsure at all n locations
taagaataacctcccatttgctccgataatcggggtaagcaaccatggccagactgtcctatttgggtgtgtattcctgaaaatgaaaaggttgaaacttttgaatgggtgtttgaaacattcttgaaagcaatggatggaaaagagccacaatgcatcatgactgatcaggacaaaacaatggagattgcaattgcaaaagtgctgccaagaactattcataggcgctgtatgtggcatgtgcataggaatgctagtactaaccttggtgtgctgttaaacggcaaggaagggtttgaaacagacttgaagtcatgcattgataattctttgaacgaagaagaatttgatgcaagttgggatgcaatgattgatagacatgagttgtgtgggaacaagtatatgcaacacctctatgataacaggaaaaagtgggtcccctgttttttcatggattacttcttcccattcatgagcacctcccaaaggagtgagagcatgaacaaattattcaaagattttgtccacccagctgattcaatcaggaatttcatcttccaatatgagaaacttgcccaatcttgtcttgacagggatgacaatcagcggtttataacagtccaaacagacccaaaaatgtggtctggctatccaatggaagaacaagactcaaagttctatacacgtgcaatgtttgaggagtttcaagaaatgctatacagagctaccaaatacaaaacaataaatgggccggaacctggatcatattttgtgcagctaattttggatgatgacaacaagaaattcttggttcattataccatgaacaaatgaaatctacaggtgggcgctgcgaaaaattttcgaagggataagaatcctgtgtggacatgttttanaagtgatgccacaattgaatgtgtatgtggccccagaaaaatatatgtgtgatcggtgacaattaaaggatccgaacacgctacaagttctcttgtaccagcacaaattattaaagaagcaaagcaggaagataaatattatttcactctgtaaaaaatcggcagcattgcctcacacctttgcctttccgggctgtcagcactatgacaccgcggtccaagcatgcatcgaccaaaggacccgctggaacatcgagctcgatgcggacgatgagaccgatcccccggatctctttcacatgggcgtttccactcagcttggtactgaaaagctgcttgaagttctctcctttgttggccacctctgctaagaagccgggtttttggaccttgtccaatgtggtcaatgcagcctggcaaacaaaagggcctcccccgaatgtggtaccatggtcgccgtagtttatcgatgaagcaaccttctcggtgaccaagactacaccgatggggagaccacccgccaatggctttgccaaggtcataatgtcaggtactactccataggcttcatacgcccagaggtaaccagtgcgtcccagaccacattgcacctgtgtttagtaaccatgtaacaggagtgttagattagatcagcgccccctttctgaatgcaacagagacatagaatttcagaactgttcattgatgatcggcagctttggacatttgcactgatttgaataagtatgaaaatgaaggttgctatggagtgtgatctctgggctaaactaaatgcatgtaaacaacttttactttgtacaatttcctctgttttaatacaaattgggtagtggttaccaataggtttatatatatttggattcaacttgtgagattagcattgattacttaatcaacaccaacccacaacatactaaacataaggagcaatagaagaaatatttttcatacctcatcaaaaaccaagagagctccagcctcatcccaagcatcccgcagcccctgcaagaactccttggtggcactatggatcccaccctcgccctgcatgggctcgacgaacacggcagcaattttgccggactgaatcaccttcttggcctcctctaggttcccgtacttggcgaacgtcgcgcc

SEQ ID NO: 713 - DNA, 19464 bp, Oryza sativa
  unsure (1)..(19464): unsure at all n locations
gctctgctcctcgtgattgtttgtgtggaggcggctatcgcctatcacgctttggatcaaacaaaaggtgttaagaggtgttttttttttcgttgttataccaccactgtacgtgtaacaccaaacttacatacttacaaatgtattttctaacacatgttaaaagagatgaaaaaaatgatgtaatattcgtgaaatttagtttttaaatcttggtggcatgcacccacgtttccagcaccacatcagcggcgtcttttctgtgtcctttgtttcaataagctgatagttttgctggcaacgttttaattagtgagaataaatatgatggctaaaatttaatactccctccgttccaggttataagacgttttgactttggtcaaagtcaaactgctttaagtttgaccaagtttatagaaaaaaagtagcaacattttcaactcaagataaatttattatgaaaatatattcaattattgatttgatgaaagtaacttaatattataaatattactatatttgtctataaacttagtcaaacttgaaatagtttgactttgacaaaagtaaaaaatgtcttataacctgaaatggatggagggagtattaaattagagtgaatatctctctatatatagcggtagtttgagtttcttttatacgtctaatgttgtataattatatcatttcaagagttattaataaaagattaagaacttatagtcagaatttatcaaataccaaacagtgacagtatcattttttttgagcagttgtctttttctcgaggaaccaatactttctaccagattgatgtgtaggattttgatgatatggataaggctgaaatatggggcatcataggcctatcatgtgacttcaactaggatagagttcaacgactttactgttgtgtctaagggtgtaagtgggtcagccgtgaatctatttataggtcaagataaacggactcgtggtttattttagtcgataagtgagtttcgcgggtttgtcacttacacttctaattgtgtcacgtagataaattgttgatagtggcgaaacaaaaaacacaaactttatttgatggagaggatccacgatacttatctttttaaatcttacaaaaactacaacaaatgtagtgtagttttaggggcttaagggaggcgatcgagacccctgctcaccccctccctatcttctccacggatagttgatgtatcacttgagttaatatgaagagaatacatgcgaaatatgcaaagatttaactcggatgctacagataagacataagacatgatataagagagttactacctccatcccaaaataataacatttgaccgtccgtcttatttgaaaagtttataaaaaaataaaaaaaatagtgacacataaaatattttttttcatgttttatcatctactaataacaataaaaatactaatcataaaaaaatttcaaataaaacaaacggtcaaacgttggacataaataatataaaattacatttattttagtaaaattatatttattttaggacgaaaggaatagcagttagtgttgccgtgtgcactctagtttttaagatgccgtggatgatatagacactactgatagtatgtttcgatggagaaattattatatgcttttcattatcctttttgtctttttttttgcggggattatcctttttgtctttaatgtctagctagtagcattggtatctttctttacacgcacttatttttttggaagcgtatttatttccagtaaaacactatgataagattaagcacatcttggcccgtttctttacaacacatatgttcctcttgcttatgggtcccacatgtaagtgagagggagtaggtgcgagtaagggaaatgttccaaaccaaggttggtggttggtggtgggtggtggcgtgcgtgctttcaggacaggaagacgggcttggtcagaagactagggacagagagcatgcacgccgcacacgtttgttttttgcttatacattaacaatgcacaaacttgatcatgttcttgagacgacgacgacgaaatttcgtttatgcagcatcattcaccagcttgttgatgaaaaataaatagaagatgggcataggcacagggaataataagaagagccatgtgatctaagagagataaaacaaaggaaaaccatgcagtaatatctgattacttgtcatataacaaaatgacagggtgagtacctatcaggatagcatatatagattgatagaaaggtccaaaaggaaggcagcaggaaacaaccagtcaagtcatataagtaccgaataaaaaggcactttcatggagaccaccaaatacaccagccattacatctgcaagatatttcttttagctggatgaactaactccacgtgcttgtcaaatacttattccaacattttctggaaccatatatatatagtttccatcatgcaccagatgggcttatttttcatacaaaaatcatcaggaacaaaagagggtctggtacaaacagtggtttgtcccatctccctgttgacgagggaaatcggaagttgtaaaaggccccaacaaagacagcacctacaaaggcttccgaactcaaatgttccaggaggcagaaacaattgagtccgtgaagctgaattgctgcacggcggttatttttccctcttcaggctcaagaaaaaacggacggcggacattagctgccgaggcatggaatagaatggacatgagttttttttctgtatggggggagtacatctacagactgtccagttttgctgtgtaagaggtttctcagcatcagtataacaactcctggaagacaggatcgacgctgcgttgccacttcgtctcgtacaaattgagcagcctctcagctggggtcactcctgcaacaaagtaggctacgaattattgtctgaaaacagagttaaactcttcatttttattatctagagcccagcaaaaccatgaaaatgtttatatcatcatcaatgaaaagagatgctggaatgttgaaatcttcacctgaactgatcactgcatcaacctctcttaagaaaccaacctccttgtaccctcttctttctaatccattctggaataacaaaaaaaggagcattacagacaggcagatataatctgcatgcactccgtgttataaaagaatgtacattcaagaaagtaaataaccttggacaactgcagaatttcttcagctagatctcttacatatccatcccggaagggtgtcttcaaaccggttacaggtacctaatcaaattaaatacagtaaggccgaggtgactctagtagcatgttgtaacttccgaacctgggttactttgctaatttacaaattattctgacaaaaaagattgtataattctgttaaaactggtgtgattgtaaggcaaaacaaaagtttatttatggatcaacagtatattatataacttggcagggacagagagcacaaataactcaagatacctttcgccttagcatttctctttcttcatttgtccaatcagaggtcatgtccgaaatactttgcagtgattcctcatcatacaacagcccaacctgtatacaagtaccaattccaaaactggttcaaaattcttcctatagaacatggaagatataaattactacagtacccatgtccaaactctttgtgtttacttctacttgacaccaagaccacactgcaaagtgtacagaaatacaaaagaagtgcaaaggagtaagctaacgaacccaaaatgctggcaaagcacacaatctcctccatgggccaccatcagcacctctcatctctagatatcgcttcagcctgacctgcaagccaaatacaaaagaacaaatagttattacattaagcttacagtgtcaacatgccatgatgatcagctatacaaatttaagggcaaacctcaggaaatatcgttgttagatggttctcccagtcattcaaagtaggcagctccccgggagcttgtgggagttttcctaccataaaatcctgcaaaacaaatataaatcaagttagtctagttaataaccaagttctgtattctatagccaaagctctactgcatataacagaacaagcactaaggtaacacaaacaggaagagacccgaaatgacattccagtacagtcaatgtacttcttatttcgatagacaaaatacatcgggacatctaatgcatagtccacatatcgctcaaacctgcataaagaaacaaactattatcagaatttcagtaacatggaaaccttcattttatgtgtaaaatatctttggccaaaatgaggtctttaatcaaaattgcaatgttctgggtgggggaagaaaggccaatggtntgaaattatatatactaacccaaatgagtcatcgaacacaaaaggaagcatccctgagcggttgttgtcagtatcagtccaaatatggctgcagatcatgaatgatgttggcaacttcatacaacaaaacaatgtacttttaaaagcaataaagcaatcaccttcttaagctaagatacccatttggttttccttctttgaagggagaattagcaaatattgctgttgcaatctgttaaatggcaacaatccattaaatgaataaaccaggttcatgtgagagagggcaaagtaaatgatcagggaagataacaaaagtacccacaggctgtaatgcaagaccagtgcggaatttccttatcatatcttgctctgaactgaagtcaagattaaccttcatgactcaagtaagtaaagttgtttagagaagtaacaataagttttcaagtttctttaagatggaattccaaaattagtacatgaacatataattacactcacctgaacagtgcatgttcggaacatcatatcaagcccaagagagccaactttaggcatgtaattcctcataatttcgtaccttccctataaagaaaaaaaactgaagcattaaaatttataggaacccttcttgtaagttaagttaaatatgtacgcgacactgaattcatacaaaaactaaagctttacaaggtctaaggccaaaactaccttgggcattattggtatgtcactcagtgcccactttggctgaaaaccaattccgagaaatccaatccccatttcctctccaactgctttgacctacaagaatagacgtttcggattggatcaactgctggcaaaaaaaaaaactttcggactgaagatatatatggcatggcaatgcacaaatcataactgaaaatcacataaagcaagaagttaatacagggatgcagtgcgcattacctggtaaagatgtgaattgacctcagcacaagtttgatgtaatgtttcaagaggagcaccactaagttcaaactgaccaccaggttctagtgaaatgctttgctttccctgcaaccatatacaagtacctcgaattaaggaacaaactaaaattgtcagaacaaactgtaatgtttttgtttgtttttccattagagttaattacggcactccagtgaagcacatggaaattttctccacgttaattgttggtctaagtcatgtaaggtggtattataggggaaataagagcagaatactacctgcttgagaccgataacattattttcttcaactatcttgtcccaatcaaatctctcagcaagtccattcaggatgtcacggatctgatcgtactttataggacgcaatgtatcaacttcaaaaccgaacttctcatgttctgtgccaattctgtgaaatcagaaatttatttatggcataaccaaaataactaactggaatactccatatcaaacaaagcgggagtaaattgaacaaacaagatgacattgccaatgccacaaaaactgaatgcaggcaccagcagaactttcatgcccaacgaatggtgctagcagatcaggtagaaataacaatcacagctaaaattaccaataaaaaaatgatcaaacagttgcattaacaacgcataagactaaacagtttgtctgcacaacattagagtactagagccatataaaccagttcatcagtcatcaatagaaagcccgaaatcaatcgatttataactaaaactgcaattgcgtagctaaagcagcgagttaggctatgccaataggaaattctccaattccacatttccatcgaacccgatacgataatgatgtctccatgcgaaccattctaccaacccctagtttttgtagaggaaaaaactacctaccactaccactagtgaagcagtgacaagctatccaatttcgcaaaaagaaaaaaaaaacaaacacaagggaatctcctctcctcacctccagttctccttgggcttgcacccggagacgaggtaggccatgaggtcctccttggtgagcggctccgtcatctgcaccgcctcctccgtcggtgggctcgctgccacggccccgcctcgccccctccccctccccgccgccgtcgggaccgcgaccaccggccgccccctcctcctcctcctcctccccgccgctcccccgtccggcgccacccgcgccaccgcgagccgcgacgccaccgccatcaaatccgtacacctaagaaaaaccttgagaatcacaacaaaaaaaaagggaaaaaatcagccgaaaattgacgcgacaatacgtgggctcggctcacgaggccgcggaatcgggctcactcacctcacctcccctccccgccggcgagagaggcgccgcagcggcggcggcggcagcgaggcgagtgcgagtgagagacagcgagagggagaggcgagcgagaagatagagaggaggaggcgaggcggcgaggttataaaagcggtggggtgggggcccacacgtcagtggctgggtgacgccacgtcagctgggctctcccccttgaagtgcgcgctgtttgggagtacctatacatctttcgaaagatttttatgattgtatcacacatatttttaatctttgaattaaaatccgatagatataataaaaagcaaaaagcaattaagaaacaccataatggacactaaattaccatatcctcaagaaaaagaccaaatccaatacaaaatttaaaatttacatgcgaagattcaaaaattacagtgtaacttacaaaagttacagtgtaagtttcataaattacactgtaatttataagaaaatgcactgtaaatttgagtgagaaaatcgagtgagagataagaaaaaatctttcgagtgagatatagcaaaatcgcgctgtttttgctgctgctgttgatgatgcatgagggcagtcttaattcatagtgttcataagtaatgtctatgatgccatgtcaataagacatcacaataaaaactatattttacaacccatggtttcttaaagtgggccattaataaatacatcatctcttttctctaccatatttattcttcatctattaggagggagccttttatgtggagcggttttgcgccccaattcgggtaacaaacggttatagacttaccttcaacttcaatatcaaaagagagacgctacaaaacggaatgctgttcgaaggagacaacattaatatggtagttacgattcggtccccgcgatttacggtgatatgtcctaaatatcccagatccaaaaatcaaggcgcaaaaccaggttcctcctcggcatcgcgcgcgatacctcgtcggcatcggcgacacccaaatccttgtcagcgacggccggcaacctcgtcggcgacacccagatcctcgtcggcatcgcgcgcggagcgcgtgatacctcgtcggcatcggtgacacccagatcctcctcagtatcgcgcgctacctcgtcggtgacacccagatcttcgtcggccacggcccgcaacatcgtcggcgacacccagatcttcctcggcatcgcgcgcacgatacctcgtcggcgacaccaagatcctcctcggtatcgcgcgccacctcgtcggcgacggccggcaacctcgtcgacgacaccaaaaacatcctcggcatcgcgcgctaccacgcgcgatacctcgtcagcgacgccaactacatcctcggcttgcacgggcaatacctcatcggcgctgaccacaaccagaacactcctcggcgttgataggtattttcatctaaacttgatacctaatactagatgttttgaaacttgatacctagtactagatgttttgaaacttgatacttgatactagatgttttaaaactggataccttatactagatagatgttttaaaacttgatacctgatacttctgtaagtagaaatgctaaatttgtatcaaaactggtgaaaaaagaaaactggtaatattgtccatggtaatcttacacttatgttttgtgctcatttatcaatgtttgtgctcttgcaaaaaggctgataattattttttagtaatctggtacttctgattgtagaactgaaaaaagtttgatgaaaattggtactaacctgataatggtatgtttgtctaatttgagccgtatagaatttaatgttttttttttgttttgcactatcaaaatgtgaagggggagtggaaaaaagtatgagttcgtcagttagttctattgaaagaagaatggaagatcttcaaaacatgggtgctggggcttgtgtttctgctgaaacaagtgtgaatgagcaggctacaagtgtgggtgagagatgctgaagttctgagggcagcactgcttgaagctggaatagtcacaggacccacaagtattttgcaagttgatgctggggatggatttgaaatagaaccagtaaattgaactggaggatctgaaatggaggctgaaacaagtgtgaatgagcaggctacaagtgtgggtgagaaggatatagatgctgaagttctgagggcagcactgcttaaagctggaatagtggcaggacccacgagtattttgcaagttgatgctggggatggacttgaaatagaaccagcaactacaactgaaggatctgaaatggagggtgtccaatcacaacctgtggtaccatttgttggtatggagttcttttcagacaaagaggcacgcgtgtactacaataggtatgcaaaaaattgaggtttcggtagaaaggtttcgagttgcaaaagaagcaatgtcaccaaagattacaacagatatgagttcgcttgctattctgaacgcacaagtaaggagcagaatgcaaaatcaagtattggaagcagatccaggaagtgcaacagcatacggaaaactgattgtaaggcgagaatggtggtcgttaaaagggctgaaaagtgggtggtgacaatagtagacttagatcacaatcatcctcctttgagccccaattctctaaggttcctagaatcacaccgtaacgtgtcggatgaagactatgagctaatagaattactgcacaacaacaacatccccactagaagaatcatgtctgtcctgtctgatttgtatggtaccatgcgtaacataccattcacaaagaaagatgttagcaatctgaggacatcgatgagaaaacggactactgcaaacggagacatggctgaaaccatcaagtacttccaggaattgcaagcagaagatccatcgtttttctatagcatggaactggactcggataatacggttggtagcttattttgggtggatggtgcctcaaaagaagcatacaagaaatttggtgattgtatcgtcttcgacacaacatactgcacaaataagtataacctcccatttgctccgataatcggggtaagcaaccatggccagactgtcctatttgggtgtgtattcctgaaaaatgaaaaggttgaaacttttgaatgggtgtttgaaacattcttgaaagcaatggatggaaaagagccacaatgcatcatgactgatcaggacaaaacaatggagattgcaattgcaaaagtgctgccaagaactattcataggcgctgtatgtggcatgtgcataggaatgctagtactaaccttggtgtgctgttaaacggcaaggaagggtttgaaacagacttgaagtcatgcattgataattctttgaacgaagaagaatttgatgcaagttgggatgcaatgattgatagacatgagttgtgtgggaacaagtatatgcaacacctctatgataacaggaaaaagtgggtcccctgttttttcatggattacttcttcccattcatgagcacctcccaaaggagtgagagcatgaacaaattattcaaagattttgtccacccagctgattcaatcaggaatttcatcttccaatatgagaaacttgcccaatcttgtcttgacaggaatgacaatcagcggtttataacagtccaaacagacccaaaaatgtggtctggctatccaatggaagaacaagactcaaagttctatacacgtgcaatgtttgaggagtttcaagaaatgctatacagagctaccaaatacaaaacaataaatgggccggaacctggatcatattttgtgcagctaattttggatgatgacaacaagaaattcttggttcattatgacataaacaatgaaacctacagttgtgcctgcaaaaaatttcaaagggataagatagcagttcgacaggccgtaaaaagaaaaagccaagtgatagcagcaagttctaagaagaaaaaacttgatgataccagctgtttggtgagccatgaaaagatatcatctagcaatcaaggctctgcgtgctaatatgaggtaacaaaaaatagtcaatttttattcatgtttgcatcgccaaaaaaaaagagaagaagattgatgattttggtactgtcctctttttatatgcaggattgtgatgatcccaccaggtggtaaaaccccacagttcatgtgattcttcaaaaaaaatgaaacattcctatgcttctacttttaaaaaaacaatggtattgtaatatttgatatactttgttgtggtgtggctaagaaaattatgttatcactgtgatgaatgtgggcacaaaagtgtacttgtgttctgatatgttgcgtttatgaatatttgtgctataacataagtacattgtgttatgacatgttgcagttatgcatatgaatttgtgctatgagccaaaaaaatatttttctaactaaaaaggatacctggtacaccctggtttcatctagctagtaccaggtaccagcaatatgctctgcctgataaaaaaaggcatgctggttcctggtacaaaatgggataccctggtaccagtatggtacctggtacctgataccaatatggtaccatgcaggtgcctggtgtaaaaaaaggtaccaaggtgataccctggtaccagtatggtacctggtacctgataccagggtgataccctggtaccagtatggtacctggtacctggtactagtagtatggtaccaggctgatacctagtacctggtacctgataccagggtacaccagtatggacctgataccagggtgttaccctggtaatagtatggtacctgttacctaatactagtatggtaccaggctgatacctggtaccagtatggtagcatgctaaatgattagctaaaaaagaataccatgctgataccagtgtggtaagtacctggtaaatggcacagcatggtgacttattggcaaaaacatcataggcatcatagttgaatttttttttaaaagaagggttgctgatctagaacatcaagttggatgaaaaagataccttttcgaagcaatatatgagttagtaagttgaaaatcacatgtattagtgcaaactacaaaatgatactatttggctagggagtgtcagtctacaaaacacactgctttagttttagtgcaaactgtatcaagatcagtgagggaacctatacaaaagagtctacgacctggcattacatcttggcacttttgcccccaaacaacaaaggataaaaaaaaaacagttcttcaaatgacgcgatgagggtgtagatcattgaagcggtggtacaacagcctgtggcaaatcatcgcacggtattgtcgcttgtccttctgagaaagagaaacatacaaacagtcagcttttagaagcagaaaaaatgtatgtatagggtgaaaaaaattaaaaaatgtcaaacaaaggaataaaataccgtgttgtatccaacaagagtcctgccgttgtgacactcaagcatcctcaaaaggcagaaacctcagtcatgactacattggaacagaatagaaaaaaacagtgtgaaaaaaatggtaattgcatctgatttatgtcaagtatcacatgattactagaaaaaaaatcaaaaacaaatacagtatacttacaacctatcttggctaggggacacaggatactggattttgaaaaggcaaaatccaaggtggaggtgacagtctccggcgaggtcaggtaccaggcgcactacaccaagtgcaaactcccgcgacgtgcccgctcaagctgcagcttgcgccgccggcggtggtgttccggaaggtcaagtgcaagcttgccactgccgacaagaactactagtgctaaccttgtcgtgggcatccccatggctgtgcctagctttgctagtgattacacgattgatttgtttgttcctctggttgagtttgtgatttaattcctctctgaatttgtggtggatttgaaggaattgcactattgtagtgtttgattcaacacggttctttgatgattgtggaaagggaatttctcctcttttattttctctccctcattctctctctctctgctatttcttcaagcaagcctgaggaagagagcgccggcgccggcacggcgaggcacgggctggtgcgatgcctcggcagggacgacgctgcacggtcgtgtgcaagggccagggccggcacgacgagtcaccgctccgctgccccatctagaaacaaagagggagagaggggcttacatgtggagctccgctcgccttgccggtgttgtgcccagggtgctcatccgcccgccaacaccaggtgacgaatccgaccgggtttggttcgaccggggacccaagtctaggatagatggtgaggcgcaggggcactccggttattttgaaaaaaaaactcaccactttcagtctggaaataataaaataatacgtccggtgtcctacggccaattgcacaactttgatagtgtctatgagcagtgtcacgtttttgcggtgtctctcagctaattacatgatttttgagtgtcctgtagcaaattttgcctaataataatacggtgatgatggtatttttgttaaaaaaaagacatttctactttttttataaaagggaaaggcatgtgtacttgaatatgtttttttttcaaaaattcagtggttttaaaagcttttgtctaaaccatgggtacatatgtaaaattataaaatagaaaatgtatcggtgatagtattttttttgtcagcttgtggacaaataactacatatatagtgtggttctcgaactataatttatctaaaaacattttactccaatacgacgtagataatatggtctatactatatggcgtcctgactattctaccgttcctatcacgatgtctggatatcgaggtcgatctataggtgaacgcaggtcaccatctacatcgaagcatcttctctagtcaatgcgttgggggcacaattgcaatgcgtacgggaggcggcaaagtgccgtggccaacggacctttttatatcttgttttgacttttttctaagttaaacatttttaagtttaatcaagtttataaaaaatatagaaacatttttaacacataacaaacatactatcaaaatatattcaatattaattttaatgaaactaatttaatattattatttttttataaaccttagtcaaacataaaaagtaagtttgacttgtaaagaaatggagggagtataagatacgataaactgactaaagtatttttttatttagataaatatacacatatgaatttcgtcctatatcattttctatgtaaaattgtgtttgatagtaagttccttttttttaaaaaaaatgcatgtatggcctcgttacctaataggttattgcttagctagtatattataaatatcaaaattttaatcatatattaaatacattggttaccttttaactataatgctttaaactaaatttagaaaaagttcaaatcaattacaactcattgattagttacattaaaactgaaaattaaattaacaagatactaaattgagagcataagatgaacacagcttcatatctacgatcattacaaaccaattcagccaaaattttcttgaattaacatggtagccattttatattagaaacttagcctatcaaataagaaacttagctcttaaatttattttaagataaacgaaagaggcgaaaaaatttattttaacctaaattgaaatggctaaaaagtacgaatgaaggagtacaatttagtgcctgtttgtttcaacttaggatggttataatctggattattataagcaagctgaaacaaatagatagcttattatgatatattattacaatctataaagccagattactataatctagtaatccgctttaaaggagtttattttagattattgagtggctaacagctaacaagcatctaataatccaaacaaacaactaacagcttattttatgtcggtttattataatccagcttataataatctggttcaataatctagattacaataatcttaagttgaaacaaacagagccttagtgggaaaggtggttctagttccctcagggcaagtactataatgctacatatactgtcccaaagaatgtcacatcggattgagtgatgaggtagataagagaagtgagaagagagataatgagccacccctaaatcaagtgataacctccacataaatttcaagaataaaacgtgagagtattagatatattggtatttgtgtactagagttaacatattgtatgagttgtctcttaatttatcagtgaatgatataaataaatttagagatggtagtcacatcaaccatagcacttgctcttatggttctaaagatgaataaatgtcgcatccagcatgagtaaattatttgatacgaatttttaaagaacgccctttcgtttagccagaaataaaacagaatttgtgaagctttactttgaccagaaactgtgatacatagtcatataactcaatgtgtgcgttaagtcaactaataacacacatgactaccatgctacctccattttaccagcatctcgtattagtgaagatctggtgacagattacatcaagcaagagagatgaccatgtcagcaggcaatagcgcatcatcatactaggatacgtgtattccatgttcagaatccaatccaataatccgaatagtgtacaacccaaccaagtaatctcatacaacctaacgggatagtaaaccccaaccaattacaccgtaactaaggtaatgtgttaacaagaacaatgcactccacgatcacatgctccaccttgaatccaacaagctcaaggaccggatcatcctgttcagcaagctccttttagctgtaagtgcccatgccaatgttggagccaccgtacggggcacccccagcagcatcgcgggacttggagtagctaacgtagtagaattcgctgaggatggctgtgaagaaggtgaaggccgcaccagcagcaaagacacctttgcgcacagtctcgcaggagacggactcgccaacgaacatccccctgtaccgggtgtggtacgcattccggatggatccggccatcaagcatgcctcagcaatgaggaaggtcaacctgccaacgatcagaaaacatcttattgagtaatcattttatggcaagtacatttgatttgacttattaattggcgtataccctaatttttccatattacagattcaggcagtagtagttaaattcaaataaatgcagaaatgagaaacaaagctaaaccatttaccctatgtactttggtcaatcaaaaaccaatagattagaacatgaagaagcaccgggaaaagggaacataacaaaaactgttgaacggatgcacagttgcatatcagtatatctttaaaccataggtgttgaaacatctgttcatattggaacacctagaatatgatggatatgcagttctggattaagtatatgtagtgatggacacaacaagcatcgtcagagcaggaagatgaagggaattagatttgatgacatttggctgtagactatgacaggtgtacactacatgaaggtttggctagccaaggacaccaagaaagcaagctttcaatgatgttgacttcagaacttttttgggatatcccaattgttgatttcaaggaagaccatataaccaagttaattaatttaacaattcattaaagaaacaacacaaatcaattataatttgtaaaaagataatcacaagtgcatggctactattaaatactactccctatgatcccacaaaactagtatagtgagctgtgtcaggccaggtaacatggtctcattactttatttaaagtcaatgagctaattaataacacaggtaccacccacggaacaagacaggctgtgttcgctggaggggggagtttggaactaaactctccgcacggaaaacgcagcagtccattagcacgtgattaattaactattagctttttttttcaaaaatggatcaatatgatttttttaagcaactttcgtatagaaactttttttttaaaaaaaaacacaccgtttagcagtttgaaaagcgtgcgtgcggaaaaagagaggggtgagttgggaaagggggattccgaacacacccaaaatagttgttatcaacgtctgcgtaatgttaaattaaaaaataaaaaatatttagttcaagtgtgcacctactgtaggaacactagttcaactgttaaatcctactcccccatttcataatgtaagactttctagcattacctagattcatatagatattaatgaatctagacatatatagtgtttagattcattaacatctatatgaatgtgagcaatgctagaaagtcttacattgtgaaacggaggaagtacctagtagtagtacaaagcaaccagtgacaagcactttgcgctttgtggggcaagtaaatttgaggcagttggacatatgcagtgactcatgtagcagttggacatatgcagccactaatgtaggagtagcaattaaacatatgcaggccactcatgtagaagtccagtagatctaccacttattcaagtaaactattgcaactttgaaaggataaattcttgaatgggaggtactaccttaaaatcccagaaaagaattgttcaattgtatatagagcttccgtgagactaatgaaatgcaaaagcacagctttagttcacgtcaaaattggaagtttgattgaaattggaaagatgtgaaggaaaaattggaagtttgtgtgtgtaggaaagttttgatgtgatggaatagttagaagtttgaagaaaaagttgggaactaaaacaagcctaagaaaagtgaacaagtctcccccactcttggagttttaactgtttagcttttgtgacagaggagctgccataaagtgaggaatatttaaccatttgccacatttagatgtggcaattaactttttgccactggacccacatgtcatagacacatgtggacccacatgtcattgagataggggtggcaaatactccctctgtactcgtaaaagaagttgtttaggacagcgacacggtctccaaaacacaactttgacttcttttttctataaaaatatttattgaaaagtgatatatgtatacttttatgaaagtatttttcaagacaaatctattcatataatttttatattttcaaactcaacaacttgagagttattcatgatttatattcccaaggtttgacttaaacattgtcctaaacgacttcctttatgagtatggagggagtagttatttgccaaatctaaaagtggcaaatagttaaaagcccccataaagtgaaagctgcctcttgtgcgagctgaaaaaaatagtagtactaatttccttataagtggacaacaaatcaccactttgagtgtgccacaattcaatttgacccttcaccaacaatcagcggaatgaggcagcagtcatgtgcttaaaatatatttttggttagcatgaaagagatagtaaacctaatagatctgaaggaagaacctctttgcttctgaataacagctgcccgaactgatgctcagttttttcagactaaaattatactaactgattaggtagtgaatgagcagaacagctcaataggcccggtccactgaagcaaaatggttatgagctctaaattaatagccaatccagcataaataaaccatccaataattgtcctctagatcctcccctcactaaatgcttatgtgcaagcatttgttgcagtagatctgctcaaaccactagatcccatcctccattaattgcccaccaacaaccggatctgaactgaagctgcgcgttctgtgctcaaaccacaagtggtagatctagctaaaaattaccgcggagattaaactaccagcaacccagatccagaagcaagcaacgaagaggcgcgagatcccaaaatatgagtagaaagaaaaaagaggcaaagcattcgtaatgttgtttggttaatgtggtgaagcattcgatcgagtagtagcaagcggagtgatggtgatttaccatgcgaagaggaagaggatgagggcgcaggcgcgggatccgccgggcttgaggccgcggccgcagcaaaaacacttgctggcgagcatgacgaccgcctgcgcggcggcgaggaggaggagcgcgccgaccccgtagccggtggcgatgtcggagtcgtagacgcagtagtcgtacagcttctccgagtcgggcgtcaccgtcgcctgcaaaaaaagcaacccccgtacgtacgtcagcagacggctcctccagaggccggtaggagaaaggaagggggtgagtgggagggggggggggggcttgccttgctgcggcgctgctcggcggcgacggcgaggccgaaggcgatgacgtcgaggaggaggacggaggcgagcacgatgatggacgccattgctgccgctgctgctgcgtgaggtggtgtgtggtgttcgcggctgctcctcgtggggagtagtagttaaaaggagaggagagagagaggggcgcgccgctgcggctggtgagcgtgtcttt

SEQ ID NO: 714 - DNA, 10704 bp, Oryza sativa
  unsure (1)..(10704): unsure at all n locations
cgtgtcggtgtggtagagtggagaggcggtggcgcgcggtagcacatcacctcaccgatctggtgcggtggtgactggtgagtgtggaagtggacggtctaaccgagcgagggatggggtccacctgtcggggagttctttattgatttttacgtcgcctcgggttggtggctgctttccgagttccgacggggatggcaggagtatgacttttttagaattaaattttgctaaatttaattaagtttataaaaataattaatctctactttataaaaattattaagatgtttatatgttattttggtacgtcattcgagtatgagtagtttgttcgtttttgaaaatatagatgtgtattgagtcggttttttgagttcgtttgctttcgtaaatacagaagtaattgtataataattctctttaaaaaacttgcatgctaacctaagacgatcgtactcctaattgccgctcataattttcttaaaaatatatatatccaaacgagttcccacagtagattttaccttaactaaaacgtataacaataataacattaaaatagccttacccgttgcaacgaacgaacatttgttctagtaatatctaatataccaaattaatttcattatatctaatattaaatatattttaataatatttttattttgtgttgaaaatattaattttttctataaacttgattactccttcgggctgataatatttatcgttttagataagaatgaggtcaaacattagaacctttgattataaatcagttttaaaatatttgtctatcagatatgatgattacatgtatcgattaggcttaaaaagtaatgtaataaaatcatatatatatgccaatacttttatattataatgaaaaatatgattaaaattgtttttagagactgtgttcttgtccaaattattaattcggagcgaaaactcaaactagtagtttgacttaaaaaagataaagcaatgctcgtgataaatttgctcgtgggatacctgtgtcagtggagcatgttgacgatgaattgagttgtttttatttagtacggcaattttttcgcagcaattttctgcgagcacttgcgtccggcagctttgcgtgccgcgcctagtttagttaggtcgtttcggtgtgcggcgcaccaggctgcgtttggtgcgttgtggcggggcatggttggccgtgctcctcattagctctcaccgtctcacactctcacgggacaatcgcccaagcaccacgacgcgtgcctagtgccctttactctttccgttctacagtaatctaccctataattcaccaacagtgtgttacatcctcattcctcatcgatcggtcaggatcgccccaatcaaatccaacgctccacgttactcccacctcccccatactctctccctgcaaaccccgcccctcccggattgcccctctctctgcttcccaattcccatccccgtttcctcacgtgcaaacacaatttgcgctccctctctcccgagcacagccgacgcgcaatctccgctccctctctcccatcgctccctctgtcccgagcgcagcagccgccgccgccgctgattgatcatcgccggtgaccccccacccatcccctcatgcgcaatccctctcgcccggagcgcagttccttgtcgcggtgaccgatcccccattacgccgccgcctccgaaccccgacgccgcgtggcttcgtacctaccttgccagccaactcgagatcgacggcgagcccttccaccaacaacggcgccatcccctacttcgacggaagctgctccgtcaacttcctcctcggccctccccaacgtcctccagatcaatgccaccgacgcgtctcaatccgaccgcttcgccaaacgccgccggtgcctctcaatccggcaacgccagacgccgccgatgccccacattgcttcggcatacatttgaccaacgaaggacatcgcgccaacatatataaatgttcgtctgaatatttatgaatttggctttcctctctgaatatttctgaatttggcgatatcatttctgggttgttctgagtgaattttgaatatactcatttttattttaatcatgattggtttgcacactaacttcgtcatctggcaggagcataagctacccaatcaaaaatcgtcgttagccaactacctgcttcttgggaccccttgctgtttaccgccgacgacggttcctcctcacttgtaggttctactctttttttcccctgtttcccttgtgtgtttgctaactattatgaacaacatgtcatcttggcatatttcttgcggtaaaatggctagcttttattgtacataggattcgtgccactgtgtacagtccctgactcctaccggcggatacgttcactcaagcttagctggttttatgttggcaaataaaatgggacagtgattaaggttagtgcaaacgacgatgacatgtagtacttcattttacaggttgaggcataggtgttttttttttttggcaaaaatacctgtgtcatatagctggttttggacaccaattctgtggttgtatgtgtttaatagtgtgcccgtgcattgcaacgggaaaactaatcattaatcagggttcagttttcgtgatatgaaggggatattttcatctttgtctttatataggagaaaaaattgcccatgatttatttatctcaattgcatcatgcacatcatggcaagaaataatgtctacctggaagctgcaacatggcagtcttattatagtactaacctaaaaattatataaagatcaaataagtaggcgtcaccgaaaaatgatctggtgaaatggtgatgtcaaaatcagtaggcttctatttagaaaatgtggctacattccaaagttgcatgaattccagtttgcttcatccagatagaccacttaacttaatttacgaaaattgagtgactgaatttgaccgactcaaagcttatcaaacgtactgagtgggagaggaatacaatttacttaattcagaagaccggtttattgtggtgagcagcttttgttttcttatttactatttcaaccatgcttaattgtatttgttaatcttccagcagtgcactatattttgcaatttcagtaccctattaagtagcacaccatttcagtactcgttagtcttccagcagtgcacattatttttcaatttcagatgttagctttaaattgacatgtgttagctctaaattgacattattcgacaacttccagtactaaagtcttgctctgaattcacatgtgttatctataaatttcagatgtttcatatagattgtccttgggatactgtcgaaacaagatttcggcaataataaaagggggtggctatcaagttaggaaagtggatgggtttggagacaaagaattttatacaggttcaggccttcttattcaagaagtaataccctattcctgtccggggatgattccgccgagtatgttattgattgtataaactgggaaaaaagaatcgcgccctaagaggcacacggaccctccttatataggggaaggagtccgctttacaaaatacagtccatatcctaacggaatatgggattacagataaaatacaatcgtaaccgactaggatcccgggtattttcttgacatacaagtttagaatctaacccgagtactcatagagatattctatctatatttggtaccatatatccgactaaattataactgtcgtgtagatatggggtatccataatctccacagtagcccccgaaaccttcgcagttgacagtaatagccttctcgaaacaaaaaacagtaatccgagtgcttcaattcaacttgccgagtgctaaaatcaaagactacgaagggcaaaaataaaacatggtgcatcgagtagatgcacctaattaggtgtagcccctgactatgtgattagttgaaaaaactaaacatatagtcaagaaccgagtggttatatagcgaagcacgcatggtacttagtaagatacccagccgactgcttctcaacttgaacataccaagaacaaaaatacaagaagggccgagtgataaacactcaaaggtccaaaaataggcatatttgataggaatctgagtaagaaactcgtaaaatgatccaccaaatatgataaagatcatggcaattaggaagtttaatagcctaggctataacccttaccataatcaaaataagcatataacatgctaggagaatgactactaataaatcagtcatctcaaattaacccaacagcttttgtagcctaaaaaagcttacaaaaatagtataacacctttctgtcgggtacctttttatgtgcatcataataattccaaagaattattgaattgcgttaaaaaagattttaacagcatcgggtcacatcattgtgagcacatattgccaaagcaaaaagcgcttaagtccctagggatcacaacgggccacgctgaaaacaaaattgggctgaagtaccgtacaggcccaggcccattagtactcccgataccctaaaaacaccgaagtccaaacgtcatttcgtcttccccgccgagactctcgccattccccgctccatgctacagtacagaaccgcgccgacgaagttagggttcatcaatctgctccaatcctccctcaaaaacttcacaaaatttctccccgcgtccaccgctccaattccccattccactctagccatatctcggaccaaattaaaccatccagtttacattcatggcggaagaaagagaaagcttcgagagtcagtgggcgccctccgatgtaacagaagataatctgaaggaaatggtggcgcacagcgttcttccggcgaaggaaatcatcgggtggcgaccggcgttcggcgaagcattcccgacccccgacacgcacgaaatcgtggtatttgctcatttcttctacgacggattttctcttccaacctcaagattcttccgggggattctgaacttctacgggattagcttgcatcatctgaatccaaactccatagtgcatatcgccaattttgttcatgcctgcgaagcttttctgggcattaggcctcatttcgccttattccgccgaatcttcttcctcaagccccaaccgaataagagcaaaccatgtgtggttgggggcgctggtttccaactcagaggaacactgagccaaaagtatttctctatgcccttcaagacctcacacaaaggctggcacgcaaactggttttacgtccaaaatcctgaacccgcacttcccgagtattcctgtcttcctccggtttaccaggacacatggaactcattgcctatgggagatgaagctgctcaggcagtggaattgatggaacgcatgctaaaactgaaggaacaaggtttgcagggagaacagatcactcgacacttcatcaaaagtcgattagctccaatcaaagagagatcccgcacggcttttgagtttgacggcaagcatgatccaaatcaggaagatccagattctcttgactttaaggtcatgaaagaaagaatgtacaagatcttctcaaacgctattgttgtcagctattcacatctgctgcccattgtgccattcaatgcattcaaccctcctccaccggtatgcattcaaacatttcaaccttcctcaaaagtatgcttttgtcctctattaagctaattgaaaattcaaaatatcatgcccaggaatttgccttgatgaaatcggatcctccaattgctcaacgccgatcaccttgccagcagactggtcaggcgagtggaggaccaaaaattcggtctgacgctcaaccaagtgcttccgatccagtcggccagtcagattcttgcaagaggaagctagttctaagcgacgacgaaggcgatgataccggaaggctcggagacaaaggagcgaccggaaaacccccgaagccaactaatccgaagaagaaaacctccagtcgtcctttgccaaaaatcagaaaatcttccaggtacaaatcatttggccatcttccttgtcttgcagcttacccgctgttgaaataatactaacaacataactcaaattcgtaggaagccgtctgacatagatccttctgaaaaagaccctgagccggctgacatagaggcaaacccttcaaaagaaaccgggccaactgcagaggattgcccgagtgacaaacaaccggcaaccgacaatgtagaacccagcaacgagcccccgactgcgaaccagtcggccgaagctgaagttggcgctaaccaggagcccccgactggaaaccagtcggatgtagggtcaagccaaaagattcccgaggttgaagctcaaacgaacaggcctctcgggaaggatgctgacagtgaatcagaaaccagatctcctgtgaagacaccaaagtccactcgtccccgaccgggaatcatcacaggtagacacgctatctgaaatcattttgatccaacagactttatttgaccgcttcatcttcattcatggatacactagggccaataattggtgatgaagaagaaatcctccggatacaagcagctgaggattcacgccctcctattctggtcaagtggtgggatgacaacatgcagcctcaagggatcgtgataaataagcaaaaagaggacgaagagttatgcctactgaaggaggcacttggtcaggcaacctgcattgtaaatgtaagctctctggcacctgatctcaaccatcttgtttgccatttaattcatgcgctaattaaactgtcttgcagaggattcatcttaggaacgaagccaaaacggtaaccttagagaggttagtccctcatctcggaaccctcgaagccaccaggaatcaactgcacgaagcaaaagaacttgctaggaagaatgaacatgatctgagggatcggattgctgagctccaggaatcaaattttgaactgagtggctcgtcaaaaggtatgcacaaactctgctcaactgactcatactgttatctttgcaatcttgattaaccgtgatcaatgtagtgcaagctgccaagatatctcagttagagaagcagatttaaactctggagaatgacaaggcagagctagcaagacaaaaagacttggctttaaaggaagttgaaggtatcaacaatcaatacctcaaaagccattatcctccaaatgctgactcattaatgtgaatctgttgatacagaccgcaatatcaagtctcaagctcaattcgacgtcctggttggcaagatcaaaaaacttgaaggagcccgagatgaggttgctaacgctgctgccccaattgttcaagcgatgttcttcaataacaacggcccgagtgcacttgatgcttctgaaatcttcgacaagctgagagttgctccagatacatatttcaagagcatcaaagaggttagaagtatgggagcaagtctggcgtgcgatgaccaaatctctttatccgagggttgacgttgacgccattgatggctttgcagacgggacgagcgaagaagctgctcttgacctcatcagcgatgcacaaaaatctgctgataagatagcagttgatgtagttgagagatttcaggacaccgatcttcgaccgactggtcctgataattctgataatgaaaagactgatattgattaatataccaatgattttgatgattaatgatgatggaggcacaatttgtacaatactgatgaatttatgttgtgcttgatatctcaacttagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattgaattgataaaaaatcacactccattattattatagtagcccctcgactgaaaacttcaaggaaaaacttgaagttagcagtcaaagaggaaagatacaaacgaaatgcctaagcataaaatcgacgaaggtgttcaatattccaagaattgttgatgagagtaccatcttcgtgcttgagtcgataagaacctggccgagtgactccagcaattatgaacggtccttcccataagggagataatttatgccgatcctgtgtggtttgaattttcctcagaaccaggtcgccgactaaaaaggctcgcgatcgaacattctgattatgataacggcgcaaccctcgcaaataccgagtcgactgaattaaagctacttcacgggcttcttctagtcgattgatgtcatctactcggccctcttcatagcgctcctcgttgaagttccgaaatcatagtgattcaaattccacttcactcagcaacattgcttctgcaccataaaccaaaaagaacggcgactggccggtagcccgactgggagtagtgcgtaaagaccaaagtacggacggcagctgatctacccacttgccagcatagggacgtagtcggtcgaacagtcgtgcttttatcccttgaagtaccatgccattggcgcgctcaacttgtccattactcatggggtgtgccacggaggcataacaaattttaatgccaaagtcttcacaaaagtctttaaatgctccgccagtgaattgagtgccattattagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtacccgccgactgcccttttaaacgggccgaccatgtcaagcccccagaccgcaaacggccaggacaacgggatggtttacaactcttgggctggcagatgaatttgtctggcaaaaaattgacaaccttcgcatgtccgcacaatcttgtcagcgtcagacacagctgtaggccagaaaaaaccttgccggtaagctttgccgacaatagtccgtgtagcagcatgattaccacaaatactagaatgtatatccttcaacaattgtctcccttcttccaaagacacgcagcgctgcagtattcctgatggacttttcttgtacaactccgtcttatgaataatgtaaagtctgctgcgcctggaaatccgctcggcttcatttttatcttgaggtagttcttgtttgctcaaaaattttatgtgaggttctctccaatcggtttcgattatgcttacgccttgagtatccatggctccgattgtttcttttctgggtacggttggttcgtaaagatgttcgacgaacacatcagaaggggctgcctcccgtttggaaccaaaattggccagtctgtcagcttcctcattgttatgtcggaggatatgggtgagctcgagtccatcgaatttatcttccaacttgcgtacctcttgttgataagagatcatattatcatctagacatgaccactctttcatgacttgattgacaaccaactaagagtctccacggacaattagtcggcgaatacctagagatattgcaatccttagtccatggagtagcgcctcgtattccgccatgttatgggacgcagaaaaatgtatccacaatacgtagctcaatctttctccagtcggggagattaaaacaaccccagctccagtgcctataagcctcttcgacccatcaaaatgcatagtccaatattccatcttttcctctggcatgtcttcttggcactcggtccactcggcaaggaaatcagctaaagcttgtgacttgatcgaagttcgtggcttgaacgatatgtcaaaagacatcaattctaaggcctatttcgcgatccgtccatttgcttcgcggttatgaagtatatccccgagtggaaacgatgtgactaccgtgaccgggtgactttgaaagtagcgagataatttcctgatggtaatcaagacaccatatagtaacttttgaacctaaggatatcttgtcttggaattggctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtggagtggtgagaagtttcttgaagtcttcaaaggctttctgtgcttcgggtccccactggaaattgtcagtcttcttcaacagcttgaagaagggcatcccccgctcgccgagtcgtgagacgaaccggctgagcgccaccatgcaaccagtcagcttttggacgtctttttgggagcttggcggtttcatgttgaggatggcgttgattttctccgggttggcctgtatgcctctttgagataccataaaggggatcccagaagcgatttccctgacggtactccgaagatgcactttgccgggtttagtttcatcttgaaagcacgaatgcttgtaaaagtttcttctaaatccacaatcaggtcatccttctgcttggtcttgacgactacatcatcnnnnnnnnnnnnnnnnnnnnnnnnnnnnnnnnnnnnnnnnnnnnnnnnnnnnnnnnn

SEQ ID NO: 715 - DNA, 26897 bp, Oryza sativa
acccgatagttggcctggttgttttttgttgggggggggggggggggggcgaggggcggaggtcagtacatggttcaaaagcactatggagttgcctttacattttaaaacaaacaccgtcactagctttagatgacgcgatgtggatgtaggtcgttgaagcgatggtaaatcaacctatggcataactgcttgcggtatttcatggtgtctctctggggaaaaaaatgaaacaatatgagaaccaatgagcatttctctagagatggaacaaacaaccgatttttggtagcaaaaaaaccagtaccgtcgtatatccaacaagactcctgccactgtgacactcgagcatcctcataacacagaacccgcagtcgtgtctacataaaaaatgaaagtgtgaagtaaaaaaaaaacatgtacagaaaaggatgtgactgtgagtgagataaatcaaaaaaaaattgttgatacttacaatgtatcttggtgaggcgattcaggatactcaactatgaagatgtcaccaaatccaaaagggctactgtttgttcgtgtgtcaagggcaacatggagattgctactctgaaaaacatatggaagaaagaatgaaaagaaaaagaatgatacctagtaaaaatacaatgaaaaagaggaatagtaaaaaaaaaaagcttaatcacaaagaagacaattgaaaaaaatatgatacctccgtttcagtttccatcttcttccttttgttgctgccacttatggcatttgatttatctggtaggaatttgttaacgaccaaatttggtagtgtcagcatcggagaagaaggttagatcgaagtggagtccaggacgaagatcgttgcggaaacagagaaagaatcggctgtatccaacggatacggtcaggatcgacagagtttgagtcggacggggttagccaatatagccgattccgataatacgacttggtgtgcgatatcgggttgagttaatgtgcttcatggtgattgccacgcaaggatagagtcctgagaaggcaattatatctattaattaggatattttatgtaatttccttagagatatgtttgggcaaaagtctgccgtaaagacttatggtattttagagtttgttagagataatagtcatgtccggtatggacacatcttagaattctcgggtataaatagaccccgagcctcatgtaaaaaaaaaacagacgttcaatacaatctcggcgcatcgccatcctttttgctttagttttattttgacaagttcttgctttcgggttgagctgcatcggtttcgatcttcaacaagaggtaaaacttgttatggcggtttgcattctcgggattggtgcttccatcttcatgacactctaatcttgtttatgtaattcgtcgagttatcatatatcttacataatttttagcaatatcgttatctaacctacaattggctaacatctgttggtagaggacagccgattaggttaaatatcgatgttgattcaaattatatcggatatccaccactctatgaaactttcagcgggttgattgtctagatattggtcttcttttcatacttaatgctgcatcagttgagtttgatctattaagtcgtgtttagaatatcaatctctagcctgccttctggttgctgattagggtagtatcggggtttcagccgatcttacctgatttaactacttttattccatatgcttgattgatatgttaaatctgtcctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcgactatcgtttataggattaattgtggtttctttgtctttatttcttgttgattgcaggatcaaatcaactggcacgctcacacgtccgaaggcgagttttggacctgcactaaagttaagcagatctcccaggcctcgtgttttctgtcaacacgcttttggcacgcccggtgagactgattagaagtcagaaaacaaccttcctcatggccgagaagctgccgctgtcgccatcctcggctagtccaggttctgttaaggagaaaatccagatgctgggcctcagatacatcaatgaagggaacgttgtgactgttgatccggaaaagttcacacctgatcaaaagaaggacttcgaagcaatgatgcaacaagcgcgggatcaattcttaaaatcattcacgcagactcgcaaaggaacattggttcagaagtataagataaaggtagttcctgatgagcctgagaccagtatttctaaggaatgagaagggaagagaggctcagaatcggctcaaccaagtgacaaaggtgctaccgacggctcggctcaagagaatcagggtgaaaactctcaaggggtacatggagttcaaggtgatggtgttcatgggccacaaggaggaaatcttaatcaagacggcgagacagtgcaggatttcttcaacaatttccaagatcgggttgattatgttgtgcacaatgctttgatcaatcagtctggggtattagtcaataccttgtcaaacatgatgaaatcaatagccgatggatcaataaccgagcatcaggctgcaggcccggtttatttgcaagggggtgtcttcccaaattatcggcctttgatcactggtgctcaactgtctgcccaaccagttcctcccattgcaccttcagctcagccgacggtaccgccgttgactcctttacctgctccagcagcattggcaccaggccagccgattaatcctcggctgttgatgagggagcagccatagcatagtgggcaggtgacaaatcggctgacacaagaccaggttgctgctatgtttttaccccctcaacctactgttgatccggtccagcaacagccgattcaacaaacgccgtctagacagcaaactatccagccgattcaccagcaaggcttgatgaatcaatcggccggacaattggctagacacgtcctgaatcaggttgttccagagggtttggttcaccatatgcagccagatcatacggtaatgccccagattgtacctgagcacttggtgcaaaatattcaaccgaattaccagaactaccaagggggcaatttgaattatcaatatcgacctccttccccgcaagcccaatatcagcaaggggggctaactcaacctcagttcactcctcagtgtaatcagttcgagccaatgcagcaacaatcgcaaggagcagctcagcaacgaccatgggccgatgtgattgctgacgtgatgagggaacagttcgggcttaaaccaaaagatactggaaacttatatcggcaaccttaccctgagtggtttgaaagagttcctcttcctatccgatttaaagttccagatttctccaagttttcgggacaagatggtgtatcaacttatgaacacattagctgatttctagctcaatgtggtgaagcatcggctgtagacgctctgagagttaggttgttccggttgtccttgtctggatcggcttttacttggttttcttctttgccgtatgggtcaatcaacagttgggtcgacttggagaaacaatttcacagctatttctacagcggagttcatgagatgaaattatccgatttgacagtgattaagcaaaggcataatgaacctgtgcatgagtatattcagagattcaaggagatgaggaataagtgcttcagcttaagtttgactgatgcccaattagccgatttagcctttcagggcatgattggtctgattagggagaaattctcatctgaagactttgatagcttgtcacatcttatacagaaggtaacattgcacgaacagaggtttgcggaagctaggaagagctctaagagggttaatcatgtgtgtccttacatgtatgggtcggatgacgatgatgatgactctgaaatagctgcagccgaatgggtaaggagtaaaaaggttataccgtgccaatgggtaaagaattctgggaaagaagagaggtatgattttgatattaccaaggctgacaaaatttttgatctgctgcttcgagaaaagcaaatccatcttcctcctggtcatacgattccatcggctgaggagttaggcaaaaagaggtattgcaaatggcataattctggatctcattctactaacgattgcaaagttttcagacagcagattcaggtggctattgagggaggcaagattaagtttgatgattccaagcggccgatgaaggttgatggccgaacagccgatgctagacgtacgagaggttttcagatgaattcggccaaggttataaataagtatcagaggaaatatgacaagcaacaagagagatgttataaagaggatgatggtagttttgatcctcattggggctgtgagttctttaggttctgctagaacgagggtatgaggttaccaactatcgaggattgtcctggatgcggtgatgttgcggaaagttcgagccgatcatacaatggaaacaatcggctgaagcaaacaagagtccctgttcatcaaagattgggcccagtaaaccaacatagttacttggaggatgatgaagataggaagactcagtggtgtccttctggtatttttacaaagaatcagaagagaagggttcaaaggttggggaatagggaacgctttcaggaggtcgagcaagaaattaatcatcggctgaggaaggcaaaaccgaagcaggagtggcatgttaagggtcaagctcctggggccaatgatgtcgcagccgatgatgcaaagaggttggcaaaagggaagagtgtggtaacagcgtcaattaacatggtttttaccttgccggccgaattttggatcgatcaagccgatgtcgacgaggtggaagaggaatcggctaagttggttctattgccagaacaggcagtctttgaaaagcctagggggacagagaatcgacaccttaaaccattatatataaatggctatgtcaatgggaagctgatgtctaagatgatggtcgatggtggggctgcggtaaatttgatgccttatactaccgttcaggaaattgggtagaaatgccgaggatctcatcaagacaaacatggtgctcaaagattttggtggcaatccattagaaacaaagggtgttctaaacatggaactgacagtcagcagtaaaacaattcctaccacattttttgtcatcgatgggaaatgttcttacagcttgttgcttggaagggattggattcatgccaattgttgcattccttcgaccatgcatccatgcttgattcaatggcaaggcgacaagattgagattgtgccagccgacaggtcagttaatgttgccagtgctgatttagctctttgggagatggatggccttgattgtttatctggaaaggtttgggatggagattttctaaaagtgtccgattctgatatacaaccaattaaagatggagaacccaacctattactttgagggcgtcgtggagggttcaaacgtctacaccaaggatacagtagatgatctcaatgacaagcaaggtcaaggtttcatgtcggctgatgatttagaagaaatagatataggtccgggtgatcgaccaaggtagacatttattagtaagaatttatcttcagaatttagaaccaagctgatagagtttttgaaagagtttaaagactgcttcgtttgggaatattatgagatgctaggactcagccgatcaatcgttgaacatcggctacctctcaaaccaggggttagaccgcactagcagcccctgagaagatgcaaagccgatatgcttgaacctgtcaaggctgaaatcaaacgtttgtatgatgctggttttattcgtccttgccgatatgctgagtgggtttctagtatagtttctgttatcaagaaaaatggtaaggtgagggtatgcattgattttagagatttgaataaagctaccccaaaggacgaatatccaatgctagtggccgatcagttggttgatgctgcttcaggacataagatattaagttttatggatggaaacgcggggtataatcagattttcatggctgaagaagatatccataagacagctttcaggtgtcctggtgcgatcggcttgtttgaatgggttgtaatgactttcggcttgaagagtgctggagctacgtaccaaagggccatgaattatatatatcatgatttgatcggctggttggttgaagtctacattgatgatgtggttgttaaatctaaagaaatagaggatcacatagccgatttgagaaaagttttcgagaggaccaggaaatacggcttgaagatgaatccgacaaagtgtgcttttggtgtatcggctggccagttcttgggatttcttgttcataagagggggattgagattgctcagaggagtattaatgctattcaaaagattcaacctccagaggacaagaagttacaggagttgatcggcaagataaatttcgtcaggaggtttatttctaatttatttggaagattagagccttttacaccattattaagattgaaggccaatcagcaatttacttggggggcagaacaacagaaagctttggataatatcaaggaatatcttagttccccaccagttttaattcctccacaaaaagggatacctttcaggttatacttatcggttggtgacaagtcaattggttcggtgttgattcaagagcttgaaggaaaagagagggcagtgttctatttaagttgtcggctcttggatgcagaaacaaggtattctcctgtggaaaaattgtgcttgtgtttgtatttcttttgcactaagttcaggcattacctattgtccaatgaatgcactgtggtatgtaaagccgatgtgatcaagtacatgctatcggctccgattttaaaagggagagttggtaagtggatattttccttaacggagtttgatcttcggtacgagtcaccaaaggcgattaagggataggctatagccgattttattgtggatcatcgtgatggttcaatcggcttggttgacattatgccttggacattattctttgatggatctatatgcactcatggttgtggtattggcttggttataatttcgccttggggggcaagttttgagtttgcctatactattaaacattatgtaactaatgatcaggctgagtatgaagcagttttaaaagggttacagttgctttaggaagttgaagccgatgctattgaaattatgggtgattcgttgttggtgatcagtcaattggcaggagagtatgaatgcaaggacgatcattgatgatttaccacagaaaatgctgaaagttgatgaatgagtttcggctagtaactttgaagcacatatctcgagatcagaatatagaggctaatgacttggctcaaggagcgtcaggatacaagccgatgacaaaagatattgagatagagattgctacggttacagccgatgattggagatatgatgtgtttcaatacttacaaaatccatctcaatcggcttcgcggaaattgcgttataaggctttgaaatacaccttgttggatgatgagctctattatcggacgattgatggggtgttgcttaaatgtttgagtgccgattaggcaaaagttgcaatcggcgaagttatgtggcactcatcagtcggctcataaaatgaagtggttgcttcgacgtgccgggtattttttgctgacgatgctcgaggattgtttcagatattataaaggttgtcaagattgtcagaagtttggagcgatgcagagagcgccggcatcggctatgaatcctattataaaaccatggccttttagaggttggggaattgatatgatcggcatgattaatccaccatcgagcaaaggtcacaagtttatattggtggcaacagattattttaccaagtgggtagaggcgattcctttaaagaaagttgattctggggatgctatacagtttgttgaagagcatataatctatcgatttggtatccctcaaactattacgaccgaccagggttcgattttcgtatctgatgagtttgttcagtttgccgatagcatgggaattaaattgttgaattcttcaccatattatgcacaagctaatgggcaagccgaggcatctaataagagcttgatcaagttgattaagaggaaaatttctgattttcctcggcaatggcatactcggttagctgaggcgttatggtcttatcggatggcttgtcatggatcgatacaggtttctccttataaacttgtttatggtcatgaggccgttttgccatgggaggttagaatcggctcaagaagaacggagctgcaagttactttaacagccgatgagtattataaccttatggccgatgaaagggaggatctggttcaatcacggttacgagctcttgcaaaagttacttaggataaggagcgagttgcccggcattataataagaaagtagtgcccaaagatttttcggaaggtgaactcgtatggaagttgattttgccgattgggactcgagatagcaaattcggcaagtggtcgccgaattgggaagaaccgttccagattcataaggtggtatctaagggagcttacatgttgcgaggactcgatggagaagtttatggcagagcactaaatggcaaatacttgaagaaatattaccctagtgtttgtgttaacgcatgatcggctgatgttgccgatacatgatagccgatgtgtttacatcgccttgagatggccgatatggttatatcgcccttagttttttttattgtaatcggttgcaggttgccgatgtgcaatggccgatatggttatattgcccttagtcgtttttataattttatcaatgttttggacattttaaaattaggggggcacatacatggaaaatcgcaaatttttaagcgtatttgggaaatatgttaatcggcacaaggattatacagacaacaaagttactagggtatcttagccgattacaaaagttttctaaagtttgttacatagaaagtcactgagacaaatatcgctggatagccgatatagccctttgtctaatctgttctacttcttctatggcttgggaatcttgagcgtcggttacagggatgactctcaaggatttggtcatatcagcgacgttcttgatagccgatttcagctttgccttctgttcttcgacagcttgcgggagatcggctagtttcttgtgctccatatccagctcagcattgcattcttggagttgtgccatgagatcaatcttacgagcttcaagccgatcgatatttgatttgatcgggccctcagacaactgatcaagtttggatttctctgcatgcacaagctgccgattgtgctggattgtagcttcgatgtttttgcgctcccggcgatcggctaacctctgcctggccttctccagcttgaattggtgttgctcaagatagacggctagagtaagggcatcggctaaattatctggaaggagagcttggatatctgtgaatcttacccggatcgagccacagttggtcaccaggttatctagtgttgcttctagccgattagagatatcctcaagagttctcttcacattatcagacagaggagctgttgccttgctggtggtgtcttcttccgtttcatcgaggtaatctttgatgtcgaaggagaacagatcggctaaaacctgcaaaagataatatcatggatggttaaggatcaagacatgattggccgatctcaaatttatgtcaacaaaacttactggaatagcaggagtagctggttgttcttcctcttcaacatgatgactgtctgcagccgatggggtgcggtcgcctgattcgatctgcacaagaggtgaagaagaaggaggaggctgcaaaagggacaaatgttagacataattggcccagatcagttaatgagatgattgagagcatcttactggtggaaccggtttaggagttggcgcagccgatttcttcttcatagcagttttctttttctgtaattactaaaactgtgaggaatcggccataaggtaaaacgattacaaaaggagtcaaagaaagctgcttactcttaagaagtggactggggcagaagcagttggaggggtctacttgggtgaagccgatggtgttttttctgtgtcacttatttcggctgcagcttgatcgacatcatctccaattacttcttcatccagagcttgttcgatggatggatctagagcaggcagatcgtcagctggtgtggtcttcttcggcttaattttcttctttaaagctgggactaaagtatcctcagccgatgatctggttttccgcttcttgccggcatcggctagttctctgataagccctcggagaagcgctgaagtcttgggggcgttgtagccgatgacggaaggagatggcgcacctccatttggaattagacctggcgcatatttaatgaccttgccactgttactttggtgaggaggagaggattctgttgtctgcagatcagaagaaaaggttagtcaaggttcaaatcggttaccagtcattcaagcaagattgataaagtgaagatttacctgaggaatggcatcggggaacaggtctgtcatatacatggaagccgattgatggaacaaatgcagcttccattcactccaccatctgtcaaatgcccggttcctggaccttgccaactctatgttctcaatgcttccaagttggggtcctgggatgttcagcaaccgatccattattaaggttgaagagatgtcacctctacactggatcttgtcagcaaagtacaggccgattggcagctgtcccattccaaattgtctagccgaagtcattgggtgataaaactcgtaggagacctgaatatttcttccttgatggatgccaacagggagaatacatgggctgatagcagtagtgaaaacttctctagattgctgaaatttttcatgattaatgtcttcaaatctaaaatcggctggtagttcaaaatccattgagtcagcatagaagaaccaaactcgggcatccttttgaaatccatcataaaaactgaagaaccaatccttcagaagttcagccgatagcttcgctcccgcatcggctggcgtagatgcatattctccgtatgacatgcatctacgatgagtgtgttcttctccatcatcttccatgatcggctccaaccttggaaattcggcttctatcacaaatgaccgattgacaactttcatgactaccaagttcagccaagtttgcagtaaccaccatggtccacctgccccaactactgagccgacgatcactttagctgatgcattattcaacatttgatataggtagccgaggaggattttgcccaagggaaattgtttcttcgattctagggcctcggctaagaattaccaattggttgtaggaccatagcttaacccgcagaagaggaatttttccaaccacatcaacaggaaggccacatgttctctaggggtaactggtcctttgcccatatatgctgcaatatatcctgaccagcctccaatgcttttagtcttgaactcgaaggtgttcttggtattcaagttcatggggttagccgacgaggtcacatctaagccagtgagcatgatgatatccagtagagttagggccatcggcccttggttgaagaggaaggcattgagggtgttggaccaaaaataagtagcagcagctatcaggggttcatctttggccgagtttgctattgtaagggctagggcttggccgattccaatctcatcccaatgggcttgcttgttagccgacatccgtttgtaccatacaggccagcttttctcaagagaaggccaggatttaaaagtatttttccaatgacttatatttggattggccgacctaaaaggggttctattggtttcggctatgatgaattcagtgggatcaagattgccgattggaccaagaaagtattgttgatcgtgcaacaaactgggaaccgcaacaagattggaaagatgctacaagtacagaagaagtagagaagaagaaaacaagatgagatgaggaaaatcaatctactgtgtaggaaaagggcatctagccaatggatacatacctctgcgtactcggctgatggtgtagcagacgggctggttgatggcgcagcggacgggtcggcggaagtcgacattgccgcgggtggagatttggccgaggaggaaatcgccttgcgcgtcgggggaatcgccggagagagagaggacggaattcgcttaagcggtgaaaacggaagtcacggtgtgaagattctcgggggcaacggttggtatttaaagcactgtgtaacggtcagaaaacagcaagtgcgatatttactcatagtcgatgtatgtcaaatccgaaacattaccaaatattccggacttggggggcatgtgttaacgaccaaatttggttcaaaagcactatggagttgcctttacattttaaaacaaacaccatcactagctttagatgacgcgatgtggatgtaggtcgttgaagcgatggtaaatcaacctatggcataactgcttgcggtatttcatggtgtctctctggggaaaaaatgaaacaatatgagaaccaatgagcatttctctagagatggaacaaacaaccgatttttggtagcaaaaaaaccagtaccgtcgtatatccaacaagactcctgccattgtgacactcgagcatcctcataacacagaacccgcagtcgtgtctacataaaaaaatgaaggtgtgaagtaaaaaaaaacatgtacagaaaaggatgtgactgtgagtgagataaatcaaaaaaaaattgttgatacttacaatgtatcttggtgaggcgattcaggatactcaactatgaagatgtcaccaaatccaaaagggctactgtttgttcgtgtgtcaagggcaacatggagattgctactctgaaaaacatatggaagaaagaatgaaaagaaaaagaatgatacctagtaaaaatacaatgaaaaagaggaatagtaaaaaaaaaagcttaatcacaaattatctaacataatttttagcaatatcgttatctaacctacaattggctaacataagttggtagaggacagccgattaggttaaatatcgatgttgattcaaattatatcggatatccaccactctatgaaactttcagcggcttgattgtctagatattgttcttcttttcatacttaatgctgcatcagttgagtttgatctattaagtcgtgtttagaatatcaatctctagcctgtcttctggttgctgattagggtagtatcggggtttcagccgatcttacctgatttaactacttttattccatatgcttgattgatatgttaaatctgtcctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcagctatcgtttataggattaattgtggtttctttgtctttatttcttgttgattgcaggatcaaatcaactggcacgctcacacatccgaaggcgagttttggacctgcactggagttaagcagatctcccaggcctcgtgttttctgtcaacagaatttaagcttggtacaaggtttcgagttacatttcttcctctgttctccagcattacattggttggatttcttaacccgtggtgagcgacttggaccactaggcgcaaaatgtacaaaatctgaattatctgaatatgtagccatatagactctgtgcaccaaaacaaataaaggaaaacatgacaattagtccgctttcaatcattgttactctatccctgtaatgtcagatttatagtgatgcatgttgcaaaatcaagttaaaaaaaatcagtagatgccattcctcccatggtatcaacaaaaaaaatgtctatttatcactatacagagtaatagaaggtacatttatcgcttcatttcaatagcttcctctagtgcaatgcttcagagtagtatatattgtgtgcaagatatatgtttatagtacactagtatccccgggaccatgtaaactgggcaaaaatattggcctgtcagataaattttggtgaaaccaatactagtaagcagtgagtagatgcagttcatgcatctcatctcccctcttatcaaaccagaaaaatcaaaacacaatgtatgtctgtaatctacctgatacctagtacaataaagtagtgcatcttaggtatcaaccccttctaataaaaattgctggaaacaaaatgtatgtgtgtccatattgtactagcgcatcacaaaaaatagattccaaccacaaacaaaaaagtttcatgagatgagtaactaacctgttaattttaacagctcaggtatcaaacatgactccccccatccgcttcagcctcactacctgtaaaccctagaacacaaatgtagatagggagctgaatcagtaagttgcaaagttggggtgcgagaagacataggaaatgggacttagaaattaagatgaatcagatacctgcagttttgagtctgctgcacgagaggggattgcgcgtgaaggatctcgccaccgatgcagcgccatcagcgtggggagaggggagaaatcagccagagcacgatgggtaccagcggaaagaaacgaagggaaccgaacgatgatgcagccctgccggcgtggaggatggaggaatcggccaaagtggagtgcgccgagtggaggagccgattccgatcggaggaaggatgtgatgggagcggcgccgcagcaccgcccgcgtgggggattgagggaggaagaggagcggcggcacaggctccccggtgtggggaggcggagggagggaggggagtggctgcgcacgccggcgagcgctgtgaacaaggttgtcggtatcccgatacgtatcctagtatcttacgatactacgatcctaccaagtcgaaacgataccgatcccacatagtatcctaattttcatagtatctcgatcctactattcattagtatatgatcctacaaaattttaggtggtatcctgattctacgatccctatgatactataaaatattatttaaaataacatggtatgaaaataatgtaaataaatatgttcaaatttatataaaatcagttaaatatatcaaaaccaacgtggtttctcttaataaatgcctctgtttgcatgatatatatcattactacatttttttatatagaatggctacatataattaatataaatattaattaaacttaaaaaagaaaatcttatagtacccgatactacgatacgactctacgatacgatattactttgagtaaaacgatactaactagtatcccgatcctgacaaccttggctgtgaattgaggggaaaaagcacagagagaggaaggaagctgtgagctgcaagctgtaagccgtggcggagaaaacgttttggacgccgtgcgatagattttctgttgaaggatatatacatgctatcttaggcattttacaatgcacctcgatatatttttcagtaggacacactaaggatgtgtttggttgctcgcatccttctagcctggcccatctcccagattcgggctgagcttagcctggttaaggacatacacatgcaggtatttgtttgtctgattggaactaaactggatatggctagatattgtttggttggttgcattgaagatactggatgtagaagattttgtttggtaggtagtatgaacttccagtgcagtcacctttttatttgatagggtgagattaccccccacaatatcatatatattaaaaaactatactaatatctaatttaagcaattagttatattttgaccacataataaaaaagtgcatttactagactttaagcacggtatacattatttttttctgaagactacagtaattcacttggatatacagagccggtgaattaaaaaaaaggggaaaagaaaaggggaaaaaaaaaagagaaaacactaagcttcgtggtctcggtgagctcgcggcggtgcaaaaatagaaaagaaaatgaaaaaaaaacaaaaaagaaagcacgaagcttcgtggtctgggcgagctcacggcggccgtgaactcgggaccgccggatctggctgcctggccgctggagggaaaacggatggtgttggtgaggggatggatggcgatggcgaggaggggattaagggcgacagtgcgacacagaggaagaaagggagcgcaatggcggcgacggtggcacgctgttggccaccaaatctggcaaagaagagaggaggaggaagacgatggcggcgcgctgttgaccgccgaatctgactgtggagattatggataccccatacctacacggcatgtatagtccgactgggtatggagtgccatgtatagatagaatttctttaggaagactcgggttaaattctaaacttgtgtatcaaggaaatacccgagatcctagtcggttacgattgtattttatctgtaactatatatttcgttagggatatggactgtattttgtaatacggacccctttccctatttaaggaggggtccgggtgcctctaggggcataactttctcccagatcatactatcaataacacactcggtggatcaatcctcggacaggagtagggtattacttcttaaataagaaggcctgaacctgtataaaattccttgtctcttaacccatccacttttccagcttgatagccactcccttttagtattgccgaaatcttgtttcgacagttggcgcgccaggtaggggtagcgtcaagttttttgccgactagtgcgatgggtttcgtctccggcatcgacgacttcgtcttcccttccgggtaggcgttccggttcggcagcctcgacttcatcaccaacgacttcggcaagatttctctcctcgactcggatccaaaccaatcgggaagaggccaggtctccgccccgttcggtgtcccaaactcggccgagatctaccccaagatcatctcgatcgagtcggcttcaatccactcggacgagatccaatctactccaacacgacctgatcaagacgatgggtcctatccctcaatcttaatgagacttcccgatgatctggctgctgtcttcacgaccaaggcgtttcccacccgaagacctagatgggatccagcttcggctccgatccgatctagctctagggaggtcggcgttatactccaacctctcgggacggtctcgacggaagaattggacagctacctcagctccctcggtgtcagttctcgaccaacagagatcctcgagtacgacgacttcggctatcgttacgactacactaacttcgacgaaagctacgaggacaactacacgcctctcttcttcggtgtattcatggccgacaacgagacggcagaacagcgccgagcccgagaagcagaagaagaacgcacgcgacaagaagctgaacgtcgccgactggaggaagaacgacaacgacaagaacaagaacgactgcagcgtgaacaacaagatcgcgaacgggctgccaaggaggctgaggaccaacgacagcgcgccttggaacccggacgactagcacgagagctcatcgggcaagacgacgttgacgggacgacggtttttcgtgccccacaacagaacgcggttgtagcgatcaccctcctcgacaccctcctcactgaagatgcgctcaaccaagctgatcacgtcgtcaacatcttgaactagaccaagaccatgatcgccgcctcggtcccggctaactgcgcaagcacccgcacgccgactggcagccgagttccacctcttcggtctcaagactatcatcagccaagcctcaatgtcgtcgccgagggatccaatcgtaggagcagggatcatggtgaacgatccgttcattcaccccctgaccggcacagggagcgtcaagctgaacgcccccgctccccccaccgcaggcgtcccatcgatcttcgcgagaccattaaccagcgacgcgcggcgagaggccacaatcctcatcattcaccagatcgctccgacgacaacgtggatggagtagctgccttcacaaacgacctacgttaagtggattggccagctggcttcaagccgctagaatcgagaagtatgacggcaccactaaccctgagtcttggctcaccgtctacggtctcgccatccatgcagcaggaggagacagcaaagccatggcaaactatctacccgtggctctagcggattctgcccggtcctggcttcacgggttaccccgtggcacaatcggatcatgggcggaacttcgcgaccacttcatcgccaacttccagggtacctttgaacgccctggtacacagtttgatctctacaacgtcattcagaagtcgggagaatcccttcaagattacatccgacgcttctccgagcaacgcaacaagatatccgacattaccgacgacgtcatcatcgccgccttcaccaagggcatttgccacgaggacctagtcggcaagttcgggcgcaagcctcccaagacggtcaagcagatgttcgaaaaagccaatgagtatgccaaagccgaagatgctattaccgcgtccaagcaatcgggcaccacttggaagccgaagaaagatacgccgactacaggggggagtggaagtaccaatcacaaggaccgcaagcgtaagcccgaggaacttgtggcaaccactacaccatcctcccgacagcgttcccgcgtcaacacttttgacaatatcatgaactccccatgtccgcatcatcccaattccaatcacgcggccaaagattgcttcgtctacaaacagtttgcagaacaatacgccaagaatgcacgcaaggcctccgacggagatcaaagcacgtcaaagaagaaggatgatgaagatgatgccccgactggttttcaagaccatcgcaaggaactcaaccacatcttcggcggacccctggcttatgaatccaagagaaagcaaaagctgaccgaacgggagatcaacgctgttcagcccgacacgccccaatatctttggtggtcagagacaacaattaagtttgaccactcggatcatcctgaccgagtggtccacccggggcggtaccccctggtactagacccagtggttcgtaacgtcaagcttcgaagatccctcatcgatggtggcagtgcactcaacatccttttcgccaagactctggacgacatgcagatccctcgcacggaattaaagctgagtaatgcgccctttcacagagtcattccagggctatccgcaacaccactcggccagatcactcttccggtcactttcggcactcgggagaacttccgtacagagaacatttgtttcgaggtcgctgacttcgagacagcatatcatgtcatactcggacgcccggcgttagccaagttcatggccgtcccgcactatacctacatgatgatgaagatgcccggtccccgaggagtcatatccctacggagtgacatcaagcaagccgtcacgtgtgacaaggaaagttgcgagatggcccacacccgcgagatcacgctcgcccgagaagaaatccgactggctgcgtccacagcaagcgaaggagaagtgcctgcgaccaagacgccaaagaccggagaaagcgacgccaagaccaagaagatttcactagatccctctgatcctaccaagactgctgtaataggcgttgagttagactgtaaataggaaagtgcgctcatcacctttcttcaaaataataaagatatctttgcgtggaaaccatccgatatgcctggtattcctagagaggtgattgagcactctttacatgtcaaggaagacgcaaaacctattaagcaacgactccgccggttcgcacaagataggaaggacgcgatcaaggaaaaattgaccaagctgttagcagcaggcttcatcaaagaagtccttcatcccgactggctggctaacccagtcctggtccggaagaagacggggcaatggcgcatgtctgttgattataccgaccttaacaagtcttgccctaaagatccttttgggttacctcacattgaccaggtagttgactcaacggccgactgcgagttactcagctttttggattgctactctggatatcatcagatccgactaaaggaatccgactgcttaaagacttcattcatcacgcccttcggggcttactgttacatcaccatgccttttggattgaagaatgcaggagcaacttatcaacgcatgatccagagatgtttttcaactcagatcggccgcaacgttgaagcctatgtagatgacgtagtcgtcaagaccaagtagaaggatgatttgattgcggatctagaagaaacttttgcgagcatccgcgctttcaagatgaaactaaaccctgaaaagtgcatcttcggagtaccgtcagagaagctgcttggatttatggtgtcccatagaggcatacaagccaacccagagaaaatcaatgccatcctcaacatgaaaccgccaagctcctagaaaggtgttcaaaagctaaccggctgcatggtggcgctcagccgattcgtttcacaactcggcgagcgggggatgccctttttcaagctgttgaagaaaaccgacaatttccaatgggggcccgaagcacaaaaagcctttgaagacttcaaaaaacttcttactaccccaccagtcttagcttcaccacactcgcaagagccactgttgttataagtgtcgacaacttcctaggtggtaagcacaatcctggttgttgagcgtgtagaagaaggccacgttcaaaaagtccaacgaccaatctacttcgttagcaaggttttggctgactccaaaacaagatatcctcaggttcaaaagctactatatggtgttttaattaccgtcaggaaattatcccactacttccaaggtcactcggtcacggtggtcacatcgtttccactcggggatatacttcataatcacgaagcaaatgggcggatcgcaaagtgggccttagagttgatgtccttggatatatccctcaagccgcgaacttcgatcaagtcccaagctttagccgactttgttgtcgagtggactgagtgccaagaaggcgtgcctgtagagaagatggagtattggaccatgcattttgacgggtcaaagaggctttcaggcaccggagcaggggttgttctgatttccccgactggagaaaggctgagctacatattgtggatatatttttctacatcccataacatggcagaatatgaggcgctccttcacggactaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgcctcctgccgacgcccccgcacgcgactcgcctgccgacgccgccgccgcgtgccgcccgtcgcggccaccggaacaccgcccgcagccaccgccaccgcctgccgccgccgatgcgccgcggcctgctgcccccgtatgctgccaacgcagacgccgccacaaccggttgtggccgtcgtcggaggatggggaagaagatgggccatcgtcccccaacagccgctctccgccgctgccgcagccccccgccgccagcctccggccgcgcgtgcgtgccgcccgtcgtcatcccgcagccgccgccgcccgccgctgtcgctgcccgtcgccgtcaacgctgccgcagcccgccgatgccgccgcactagctcgggattgggaggaagattgggggaggagagagaacgggaggaaagaaggggtgaaagggtagttgagtggcattttcgtgtaaatacactaaaatattagagggtagtgggtcttttggggtggagtggagctgtgtagcagcaaaaacccagctccacccccgtagttcattttctaggagtagctctgccaactccactccaaaaaaaggtgaatctggaccatttggcacagctcccgctccaggtaagttggagttgggagctagagttgtgccaaacggggcctaaggattgcaatctctttgggaatccggcatctgatagtctgtgtagattttcagttggttgttaatcaagtcatgaaagaatggtcctgccttgatgataatatgaccgcttaccggcaggaggtacgcaagttggaagacaaattcgacggacttgagctcacccatgttcttcggcataataacgaggtgtcgcgaccgagaaaattgccttttcccgaacgctagtgtattaatccccgtcccaggaaatgccggggtacaccaaacaaacatgatacaaaaggcacatctttattatatcgattatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaaagattgagcaagagtgagtacaaccacagtactcagcaagccacaccggcagatgcatgattaatgcaaggggggtacaaggggataataatatcggggttaagttttgcagtaaacagcatttaaaagtcacttagttgcccaaagctattttgtaaacacgatcctagagctatacaatattattaatcaaggtcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccagccctgtaccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattgcaacaaaagccaaccattccaaagtatccaagtgatatgaatattcccaaagtctaaagttataaaaccacctaatgttgcctaattaaacagcgaagcatctacctaaattcatactagtggaaccatgaatagagtacccactagttggggttttgtttattccagggtgaacaaggtaataataacaatagcaataataataaggtcataacaaaggtaaataggcatggctaaataaaacagtgataacgcaggaatttaaataaagcgataatgcattaatttaaatcagaataattttataaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaattataaaacatgtgtaagcgctagcctagaaaagacaggaaggctgcgccgttgacatgcggacctcacatgtcaacaaaaaggaccgcggtagaccgagtacacagagacggtccacgggtcgacggaaacggatcccgtgtgtcaaccgaggcgagtggccgacaaacggactccagtagacaccacacgggttgcacacgtggaaaccatgcggctaccgagtgggcacactaacacggtcaccacacgcacacctggacgactaccgacaccggtacacgggtaccggggccgacaaccgcacaacgagcacgggcgacaccgaaaggacgaggacggggcagcgagggagagggacccttaccaccacgcaacgaggcgagggaacgacaatgacgaacgggcgcggcggaggcggccgggaacgacggagacgaacggcgaggggacgacttcggcggcgatccttggacgaaggcgagacgcggccggcgcaacgcttgacgatgcggagccgaggacgaagacgacgacggggctgcagcggctcgcttgacgaacgcggacgacggacgagaacggctcgatggagggacgaacgccacgacgaccgggaacgacgagaggacgacgacgactacgaccggggccggcgaggagacgacgagggcagccggcagcggctgcacggaggcgaggatggcgtggaacacgccgctgcgatgccgacgacggaggcggcgccgcgagacgacgagccggcgaggatgaacggtgaagacgacgacggacaccggcggtgttcggccgaaggggaagcgatgccgaggacgacgtcgcggctgcgatgccgaaggtggtggaggtgcggccgaccggtgcacgggcgaggagggacgggcggccgaaccactccggtgaggcggatggagaggttcgcggcgacgtgcggcggcttccgggcgaaaccgaggggtggacgaggtggagggctacgtcaccgtgccgagagaggggacggcagcgccggctgatgcacgggcgcggcggaagggggctgccggaggagacgtcgacgaggaggaagaagaggccggcgcgggcgacggcgttccggcgaaattcgggcgacgccgtggccttgccgggaaagaggacggcactccggtgccgggagaggtggtggcgacgtcggccggcgcacaggggacgcggcagaggcggccggaggcggaatcgtggcggcaataccacggttgccggcggggaggcacttccggaggtctccgcggaaaacagagggtaggccggcgaagaggaggcggctgcgatgctggaggaggcgacggcgcgaccggacggcgctccggcgaggagggagatgcggctggaggcggccggcggcacgggagagagaggaggacggcggggagaggtgatacgaccacggggaggctcgggatgaggttaaaacgatagaacggaggatggggattccattttatgggatgggggagggagccggccacgggaggagcaggaacggcggcgggaaacacggccggcggcaatggaaggcggccgggaatggcgcggccgttcccggcgattgggggcgccattcaaggggaaattaagggggaaagagagaggagggaaaggggattaattccccccaattaattttggaatccaacgcttaaatcaaggggat

SEQ ID NO: 716 - DNA, 17771 bp, Oryza sativa
  unsure (1)..(17771): unsure at all n locations
ggccggggaaggagggagggaaggagagggagagaaaaagatgtaggagagaaggacttcggccgcgggccgggggagagagagggaggctttgggccagacttggcccaaaggactgtagagggatcccctatttttaggtttttctttttaataaactttgataattgtttttgttgcttaataattatttccggtgctctggaaattcaagtaaaatttgagggctccttttagaccaaagagaatttaacaaaaattctccaggccacatttgaatttttcttgtatgtattttagtgtttgccaatttcttttcgaattttaattaattctattattccttttagaaaatgatttttatttcgggatgaatttatcaggacgtgacacgaggcagccgacagattggccaacttcggttcaaaacgagaagcagctccttttgacgtattcgtcgagcatctctatgagccaaccgtaccaaggaaagaaataatcgaggccacggtcactcaagatgtaagcatgattgaagctgactggagagagccccttataagatttttgcccaaacaagaactccctcaagataaagatgaagccgagcggatctccaggcatagcagacactatgtcattcacgagaccgagctgtacataaaaagtccatcgggaatcctgcaacgctgtgtgtctctcgaggagggaaggcaatttctaaaggacatacatttaggcatctgtggcaatcacgctgctgcacgaaccattgttggcaaggcataccagcagggtttcttctggcccacggctgtgtccgacgccgacaaaattgtgcgaacatgtgagggttgtcaattttttgcccgacaaactcatctaccggctcaggagttgcaaaccatcccgttgtcttggccgttcgtggttcgggggctcgacatggttggcccgtttaaaaaggctgtcggtagatatactcatctctttgtagctgttgacaaattctccgagtggatcgaagctaaaccggtcattacaatcacggtagacaaagccagagatttcttcatcaacattgtgcaccggttcagggtacccaatcggatcatcactgataacggcactcaatttacaggcggagtatttaaagatttttgtgaggacttcggcatcaaaatttgttatgtctccgtagcacaccccatgagcaatggacaagtcgaacgtgccaatggtatgatacttcaaggaataaaagcgcgagtttttgaccgactgcatccctatgccggcaagtgggtagaacagctgccgtctgtactttggtccatgcgcaccactcccagtcgggctacgggccagtcgccgttcttcctactctatggagcggaagcaatgttgctgttcttccgagtagatgacctcaaccgactggaagaagttcgtgaagcagcattaattcagtcggctcggtacttgcaagggatgcgccgttatcacaatcgcaatgttcgatcaagagcttttttagtcggcgacctggttctgagaaaaatccagactacacgggattggcacaagttatctcccttgtgggaaggaccgttcataatttccgaagtcactcggcaaggttcttaccgactcaagcgtgaagacggtactaatatcgacaactcttggaatattgaacatcttcgccatttttatgcttaggcgttacttttgtatttccctctttgactgctaacatcaagtttttccttgagttatcagtcgggggctactataataataatggagtgtgatttttatcaattcaatttgcttacttgatttgtcattgccctgtttgattttttgacttggttgatgaggactgaaagtttttaataacttttgcgggttctaagctcaataaggtttgacaaaaacttttaagaaatcagaagctaagtctaaatcatcaagcatagcatacatttatcagtattgtacaaattgtccctccatcatcatccaaacacaatgttagtcagctttttcatcatcagagttagttgatccagtcggcctgaggtcagtgtcctggaacctttcaacaacatcagccgctatcttgtcggcagcattttgagcttcactgatgagatcaagagcagcttcttcacttgtcccatctgcaaagccgtcaacagcttcaatgtctatcttcgggtacaaggacttggtcatcgccagcgacaggccagctcccatacttccagcctccttgatattcttaaaatatgtatccggagcaattctcagcttgtcgaagatctcgtcagcatcaaatgaactcggaccattgttattgaagaacatggcttggacgagtagtgtggcggcgttggcaacctcatctctagctccctcaagcttcttgattttgctgaccaagacgtcaaattgagcttgggatttgattttgcgatctgcacagatatacctacatcaatgagtggtcatgaagaggtgaatattttttagtgcttcggccgtcggtaccttcgacgtctttttgggcccagtccctttgcttagtcagttcggccttgtccttttccagagctttaactcgcctttccagctcggaaatcttggcagcttgcgctatatcgttcccttttggttagtcgcacatgaacaacaacatgaagcaagtcaggcaatgagaagagttaccttttgatgagccgctcagctcaaagttggaatcttggagctcggcgatccggtctctcaggtcatgctcagtcttcttggcaagctccttggcttcgtgcagctgatctctggtagctttcagagttccaagatagggaactaatttttcaagagttgcagtcttcgcctctttcctgagatggattctctgtaatacaaaagtatccttattcagcaaagtggccgacaggatgataagagacatgtatgagaagacttacatttacaagacgagtggcttggccgagagcctttttcagcatacacaattcctcgtcttctttttgcttgttgattacaatcccttgaggttgcatttcatcatcccaccatttgatcaatatgggtgggcgagaatcttcagccgatcatatccggaggacttcttcttcttcaccgataattgggccttatatattcatggacgatgattagacggatgaagaaggtttatcggatcaaaatggatttagaagagtagctttacctgttattatctctggtcggggacgagaagatccttgaaccttaacaggagacttggatcccgggtcagcgttggcatccttcttaggagggctatcggcttgggcctctgctttcgggatatcttcgctctgagttgtgcccgactggtttccagttgggggctcctgttcagcactgacgttagcttcggccgactagtttccagtcgggggctcattgctagcttgtgcattatcagatgctggttgatctttactcgggtgatcttcggtagtcggcccggtttcaactgaggggccagtctctgtgccgatcggcgtggggtcttttccagaaggatctatatcagatggctttctgcaaattcgatacacgttgtcagctctgctacaatgatgagcgactaatgatacagaggcattttgttagatgatacacacctggatgacttccttatttttggcatgggacgaccggatgttttcttcctcgggttagtgtcacgccccgaactagtcccgagcagaactagcccgtgacgctccaaattaacctgttaaccgataccagtcccagaaaacagtgctggtatcacaggaagacagaatatcacagcaacagaggtctctttattatagagtaggagtacagtcatgttgggctgcggatagatcccgagctcacaactgcattacaaaaggggaacggaagccagacttggaccaaacatcacaggcgcgacttgggaactaggccgaaaccctaaaactcatcgtagccagcttgctcctagaagaactcctcgtcagtgggatccgcttcatcttcttcagcaactgggggggattatttatatagagcaagggtgagtacgggagtactcagcaagccatgggaaataagtgtttaatgcaggcttcaaagaaaggctgttgtttttgcaattgattttatttgaactcttttctgaaacaactaagggagtgcttctcaaacgacatgggtgagacagtgcgtctcgtccggtcggagtatgtgcaatgtatcagtcttttgaattgattaagattgactcccggccaacagctttcaaacggccacccgggcctggctgatcccatcagccgcagattttccaaacatcaaacccattcaacaacagcaaatttcacaaggcagtagtcaaacaaactacgctaggaatcacctcacatccgcccatgaccgtgggcacggctgttcgaacagttttaacaacctctgcagagggtgtacactttacccacacgacattactaacccggatcatccagttcgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatatgttcggatgaaattccaaggaaacggtccttaagtgcaagagcgggaaaccgtacacccggtacgttccccggtccgcggttttggaaattcatttagttcgcaagcaccgacctaggtgtcgggttttccaagtcttttgtaaaacccaagttttacccaagatgtttctcagattttaagtttgaaggcgaccgtcgatacccgtgcagagtgcatgattaccgaggcgcgactaggtgggtacaagggagcatggtataacaattacaatgggagggtcaaaagcaacaaattaggtaggtctgccaatctgccttgcagatgggacaagcagattgagtgcgatcctatcaatccataatatttttcaagcaacataattaagttcaaatataggctcaagatgttcaaaggtggcttgcctcgctcgagatcatgagcttgatcctcgaaatcctcgcactgcgggtcttcgggctccgaaactacacgcgaaacgggacaactcagcaaacggcgaaaataaagccctattattgacctctaagtgtgccattagatagatctcgagatttgatgaattttggaagttgaacggagtcaaacggacttactgttgggaagatattgaatttctaagattattggatttttggtctaaaggaaaaggatttatttaaatcctttttgaaaaagaaaagaaaagaaaagaaggcaggagggaaattagacttttctcgggcggctagggcgcggcccgagagaaaggggcggctcggccgagcttaatgggccggccggcccaagaaggcggcccaaggcgcgcgcgcgggcggggagggagagagagagccggtgggctaggtccatcccgcgtggtcccgggtgggacccgcttgtcggcgactcggctcaccgtgaccaaggtgcacgcggggcgagctagggtttggggagggaggcgcggcgcatgcgcgcggttcgcggaggacgcggtgcggcgggcccacgcgcagcctcacggctcgcggtggaccgcgcgcgcgagggggcggagggaagcggcggaccggggtctacttgacccagtcgcggccgaggtggtgccgacgtggcgcctacgttgctgccacgcgggccggcgggaggtagatgacgacgccggccggaacggatggcggacggcagcggagtgatctctccggcctcgggccagggaagaggaagaaggcgagctcccggagtccccttccgcgtccacgaacgcaccggctctcccggtgcttggcgatgaacggcggaggcgagacagaggggcagcaatggcgcggtggcagcgagcaaaacgagaggaatcaatgggagggcgccttggtttataggacgacgatgtcggtttggaaaccaaccttgggcggtcaaggcgcgagctggcactcggcgctcgcggccaaaacagcgatagaggcggatgacgccggctgggaggggaaaaggaaaaaaaagaagggagaaagggggcttgccccttgccactttgggaaaaggaggaggggatgggggcgacgcggcagagggaggaggagctctgcctccatcccttggaggctagcgcggggagaggcggggccgaggcgatgacgacgacgatgacggccaggcggtttggagcggagcgacgacacgggcggcaggcgcgggcaggtgcggcaggcgctgacggcggcggcgactggccggtcggccaccatggcgtgcccgcgcgggaagcaacgggcggcgtggcgatttgggcggcgtcggcgagaaacggcagcgagagcggagggcgctcggctcggcgcggctcacgcgcacgcgtgcgcagcgcacgggcagagcgggggagagggagagagagagagagagagagagccagggagggaggggaagatgggccgagagggattcggcccatcgaacccgagggaggcgaaaaagacttttgtggagggatttgatttgggaaggatttggattcgggattgaactcgacgatagatcggggatttgaggtctgagatggcacggacactagacaacaagcaaagaaacggaattcgcaaatagggtttttaagagatagttttcccgctaggcgccacgacggaacgggcgctacagttagccagctttggctgtctctcagctccttcctttttgctgccggattttttggcgtcatgaccctcatcgtcggtcagcactgatttcctcttccgagagtctgactgagtggttcatcttgaggggccgggttgtacaaccgaccgattttttggccccccactagcttgaccagtcggttggcgtgatgagcgtcgttgaacagttggaggatcagactttatcaaggtgaattcctgtgcatgatgattcacattttcaattacttttaaagaagaccaaaggatgtaacttgtaaaggctgagacgagtgatacataccggagaaggagggttgaaagcgttgtacggcaccactggtagtgcatgagagtaactgactacaatggcattagagaagattttatacattctctcctgcataatcttgtattcaagagcctctgggtcctctcggttgggatcatgcagtgcgggatctctccttgattggggctaaccgggtcttgatgaagtgccgagtgatttgctctccttgcagaccttgctctttcagtttcagcatgcagtccattagagtaagcacctgggcggcctcgtctcccattgggagtgaattccaagtgtcttgatatactggagggagacaggagtactcgggaagagctggctcgaggttttgtacataaaaccagttggcatgccatcctttgtttgaagtcttgaagagcatagagaagtatttttgtcccaaagttcccctcaactgaaatccggctccaccaactacgcatggtttgctcttattcggctggggcttgaggaagaacatgcggtgaaaaagcgcaaaatgcatgaatgaagttggcgatgtggactatggaattgggatttaggtgatgtaagctgatgccgtaaaaatccaagatgccccggaagaaacttgaagttggaagggaaaatccaccataaaagaagagagaaaataccaccgtctcgtgtgtatcggaggttggaaatgcttccccaaatgctggacgccatccgatgatctccttcgccggaagaacgccatgcgccaccatctccttcagattctcctccgttacatcggaaggcgcccactggttctcaaagctttctctttcttccgccatggatgcgaactagatggcgagatttggtctgaaatgcggttgagaatgaaggggagattgatgcggtgggtgcacggatgatttctgtggaattttggaaggtggatttgagcgaatcggttaaccctagtttcgccggagcagcctttgcactgtagcgggaaatggggaaagtggcgagagtctcggtgaggaagacgaagagacattctgtttctctttggtgttattagggtatcggaagtactaatgggcctgggcctaaaatagtacttcagcccaattttgctaatcggcgtggctaagtggtgatccgtagggacttaggcattttttgtttcggcaatttttgctcaccacaatatggcccgatgctgttaaattcctttttgatgtagttagataattccttggaattactacgatgcaaataaaaaggtaccctacagaaaggtattatactacttttgtaagcttttttaagctgcaaaagctgtttgggtttggttgagatgactggttttttaatggtcattctctcggcatgttatatgcttattttttattatggcgtgggtcatagcctaggctatttagactcattaattgccatgatttctatcatatttggtggatcatcttaagagtttttactcggattcttatcaaatatggtcatttgtagaccttttgaagtgtttttcactcaggtttctttatatcttctttcttggtatattaaagctaaagcagtcggttggatgttttgctgaacgtcatatctgctgagctacataactactcggattggatgatatttgttccttaactatatgtttagtttttaactaatcacatattcgggggctacacctaattaggtgcatctagccgatgcacctggttatttatatttttcagcccttcgcagtctttgattttggtactcgggagatcgatgcagaagaaattgaagcactcggattatcattttacgctaagagaaaaggttatttcgtcgactgcaaaggtctcaggggctactgtggagattatggataccccatatctacacggcatgtatagtccgactgggtatggggtgccatgtatagatagaatatctttaggaagactcgggttaaattctaaacttgtgtatcaaggaaatatttgagatcctagtcagttacgattgtattttatctgtaactatatattctgttagggatatggacagtattttgtaatacggaccccttcccctatataagtagcggtccaggtgcctctagcggcagcgagtcggcgatgtccgacaggatcacctccacctccacctccatgacgcctgcagagctccccgctccgccgcctttcaccatcaccggtgccggcgccggcggcagcaggttggccaccatcatcttgagctggttggtcgacttctgcgccttgaggatgtgctttaccgtcgccgccgcgccgccgccccggccgccgccagccatctcacaatgagaaatttatgtgttctctcttcctcttgtgctgctgatttgtgatactaagtctcactgactaatcatgcaagtgtgtgctttcaagggtaaaggactaggatactcaaatatctacgaaagagatacttcaaatgcatatcatttttttagggtaaaagcagaagctctgcctatttcatataaggagaagagagagggaccaaagtttttacaaacaaggttaaaaaagatcctaagaggaccctcctctgagagtgacaggtcggaacaagaattttaggtaatgtaaagaaactaatgtgaggatacgagaactactaatctaaattgtgagctccgtcataggctcatcttcaaatgcatatcatatacgcactttattccttttcaagactgccaaatcgaattcactttgttgaattaacaacttcttgaagtcgggtcaagacggtgacaggtgaccagttagcatctcactaattaatcacagcttatgtagtatatggcctatcttatccatcatgagcatcatggtgacagctcggtgtcaaatatttagcattattttagtacaagtcaagtcttcattcctactatgtggtcggtttgtttcacagatcagaacatgtgcctgcgtcagtttaatctattcttgtcttgttgagaattagccaacattaatttgataatctaaccacgtctcgttgcaggaacaacttttgatcaatatttgattctacttcttgttcactgtatttacctgcaaaacaaggtgtttaaactgtaaatatattgtcacaaagaattaattcctcttctagcaaacaaagtacaccctacttcttaaactaagaaaataattttctgatcatgaaccaacgtggaaagttcgtagttaaaaatggctaaaagtttaatgcttttagtacggggagtgcgttctgtcatgcatggttctctcttatatgttcttgttagaataactgaataagagatttatgtaatatgctgttgttgctgttaatcagattgatagccactttggttgctcacccctgacctgagcaggatcgatttagttctgttttctttttcttctgtaggaaaataaaatggtcttcattcagtttgtccaatttgcgatcttttgccacaagtttttcgttcccctggacatatgtacattgttcttttaggtattgcaagtttgcatgattggcttggctctctttctcggatcatacagcatggattttgaaatttataaaactctcaacggaacatcccctcatttagctgactcaaaaaaaatctggtcaacagcatggatcttcaatttattaattggccatcataaggcactttagtacagccatacggagtaccaactatatatgtatgcagcgaataactcaattgttgtcagattatgagctgataatcttcagtgccaaaagtgttccattggattcgtaactttgcattttgctttgctagtcgcattcttctttggatttcgtatgcatgtagcagctgactggaagatacgatctgaaatcagtcaacctgctagttaatttatgcagcgccaaactctgctcatactctgtttcctctgttcttcagttattgtaacagttggacagagttaagagttcttcagttttgcatccacagacagcgtgagcgcgcatgagtgcattttgatcgtaagcatgagtgtgttttgctgacatcgcttatgttccttacggtggaacctattacctagtcttcgatccagcgtaagtgctttggttgatctttgattattttttcaatggtgtatcaagtgttcaatgacaacaagatgcctatagactatagtgtgaaaaaggggcactatatgtgtactcactccatttgaaggatatatacatgctatcttaggcattttacaatgcacctcaacagattttcagtaggttttgtccagttggacacattactcagagctgactatacgatgaaacacacgctgactagtcactcggcagcggaccaaaagggatgagtctcctatgacgtaaagtcagagggacattgtcacttactgacatgtgggacccacaaagattagacccccgtgtgggtctctctgactttacctcatagtatcgcgatccgaccaaaagaactttctcctgcgatttgctacataaaatccggcacgacggagttgtggagggcgagggagtcctcgtcggcgtcgctcggcttcttgtgctcctccaccagctccaccggatcatacggctcctgccgcaccacccgcagctccggaacctccccctccgacagaagctccgactgcgagcacgccggcgagggtatgaacagccacgacggcgtgcaggccatcatcatgtcgtccgacgccgccgggacatgttcctccagcttctgctgcagagctgacggcagaagacggtgactactggttgctgcgtcgcaacgcgggccgtcggcggggttggtgggagccggcgacgacggccggtcgccgccgcaggtgtgcaggccgatgtaggtgatctccagccgggacgggtcgtcgtcggattgctgcacctgcttcctcgccgtgcagcccaacatctgggcgcatctgtagtagctcctgtaagcacagacagcttcagatcactttcaagctcaatttattatgattattctttattttgttgcttttgacccaaaaaaaaacacagattcctattgatcctcaacgaaaaaagttgcgttgcgttttatgaaaaaaattgcagccggagattgcaaggtttctcacaagtcatcacaagttcacaacccaaaccaaacgttcttcaaaggtttactgaaaccgtcaatctagacttgtcgtgttataccttgcaaacctggcgccaagaatgtccttctgcccgtacttcctccagggataggaatcgtcacgatctccaagctctagtataattcttcgggatgaaccatctgccctgctgcattcaaaatcacaagctcaaattcagtattcatttatttgtaattgtgacaatttttcatgacatcactgctgaatacaacaaattaatgattcgtgacaactgacagcactgccaggcgatgattatcggggcttttttctggttcatttctaatatgttaattgaatcttgaacaatttagattttgggggcaacagaatcctaagagcatctccagcagggacctcaaatccagcccctattcaatttttgagtgttaagataaaaaaactagatccagcagggaccctactacagcccccaaagtgaggaggccctcaaatcctccccccaaggccccagtcctgggggactccggagcacgcccccatcgtcattttttttggcgcggatataattttgcttcgcgcattttcttgttattcccgcacggctgcgatgacagatcttctccggcgagtactgacgaattcccagcacctccatcaagactgccctagaaaggtaagacttttccatacctttcttgcccaccgttctcaaggccttcggcggcagtccatgcgcatgcccggccgccgatctcccgccatctgcctggccacacgccggccgtcgcgtgccctccgaggctgcccgcacacacgtcgtccacctgcacgccgtttgcccccacgctggcctcctgcccccattgatttttctggagaaactctaagtaggtcatgtggtgcgggggttcagtggtagagtactaatcaattttctgaataactctgttcttgacacctgtggacatgtggtggtagatggttctggtggagactgacttgtttttaatattttttttggagaattgtagtggactttgtcggcaagaaaaatctaaattctcagctagtaatggttgtgtttagttcacactaaaattagaagtttagttgaaattgaaacgatgtgatgaaaaagttagaagtttatatgtgtaagaaagttttgatgtgatagaaaagttggaagtttgaagaaaaactggatctaaacacggtgaatatatcactgtatttatacttagtagcactgtacaattgttgcaatggatcgattagaaccatatatatatatacaggagtaagtggtactgtactagtacgattccactgcttttcatagattgaatgttgcatactgtatatggggtatactctgtaccgtgtatgtgtagttggatgtgtgcatatgctctaaattttcttattaattttatgatcttgtgatggcagtgttttttacatggacttctacgacgacgatgatctcattaccgattggtgggatcaggaggagttgtctgacgatgatgactactacattgcagctgctcttcttacagacatagagcataagaggaccaaaagaaagcatcgtggttcagtcccaggtcgtgagataattaatagggacaggtttgctggcaatttacgcatagtggctgattattttgcagatcctcctgtatatagtgcaaaattatttaggaggaggttcagaatgtcaagggagctcttcttgcgcatcgtggctagtgtggaggctcatgatgactacttcaggcagagaccaaatgcagtgggtcttctcggtgccactgcattgcagaaggtgtatggtgcaattcgcatgcttgcatatgatattccagccgatagtcttgatgaagtcgtgaggatttcagagagcaccatgatagaagctttcaagcactttgtcaaggctgtggtggatgtgtttgctgatcaatacttgagagcaccaactgctgaggacactacaaggttgatggctataaacactccaagggggttcccagggatgctaggttgtattgactgtatgcattggaggtggaagaattgaccaacaggctggaaaggacaatactcagggcatgtggatggcccaaccatgattcttgaagctgttgcatctaaagatttgtggatttggcattccttctttggactaccaggttctcttaatgatatcattgtactacagagatcaccactctttcaaaggcttacattagggacagctccagagttggagtttatggtgaatggaaataaatacaccatgggttactatcttgctgttggcatatacccttcttgggccacttttgtgaagaccatttctaatccacaaggtaacaagagaatacattatgcaaaagttcaagaaggagtgagaaaggatgttgaaagagcatttggtgttctacaagcccgctttgcaatggtgaggggtcctgctagattttgagatacagagaccctatggtacataatgacagcttgtgtaatcatgcacaacatgatcattgacaatgagcgagatgaagatgtagattttgactatgatcaggaggacagtgaggtgttgaggaaggaggaataccaacgacgtaataaacctgtgttagaaaaatttctaaagatacataaagaaattgaagaccgacgggtacataagcaacttcgagatgatcttgtggaacatttgtgggcgcttcatggtgctcggtagtttgtttcattgcattttctatcatgtgtgggttatgttcattatttacttctaggatatatcatttccatgtttgaaaattttgaattcaattttgaatcgtggtgtttgaaattgcaaatttgaatatggttgaactccatgcgctagaattatttatgtttaaattactatgtgttaaactagatataaatataaattctataataaaataaaagagaaaaaaaataggggctaagatatggaggctactactagacataaagacatatttagggtctagaacattgagggcagcccccatttaacttttagggactcgaaagtaggggctactgctagagatgctctaaccctctccaaatccaaatacacaaccatttccttttccggagaaaatctagaggaaaaaaaaaagaccttttcagtatcctccctcgacatctgaaatgtcaaatcggaagagacataaacagaatttgcagacacagcaatcaaacttaatgaagaccacaagatatataattaatttataccttctccgttgagctttcctcttcgagactgaccggccgccgctgttcgccaccacacactgcccataggacggcaacaagctcgcctccggcggcggcggcggccgccgccgccgggagcgactggtcgtcgcacgccgcgcggagcatgagagacgcgagcgcctgagacagcgagtcggagatgtccgccaggatcacctccacggcgccggagctcctccctccgccgccgccgcctcccgctagcatcgccttgagctggttggtcgacttctgcgcgctgcggatgagcctctccgtcgccgccgtgccgcctccggcgccgctagccatgtcaaaatgaggggaataaagtcaagtgtttctctccttctcgtgccaatggtttttgatgctggtcgatcgatggtggcgagtgtgcgctagtacagagggtaactattaggataatcaatgtatcttgcactttattccttttcgatactgtcagactcacttttgtctttgttaattactccctattatacattgacttttcctagctaacttcttaaatttaatttaatcaagtttataaaaaaaaatagtagacgtattcaatacaaaacaagatcctttaaaactaatttggtgttataagcgtgtggttaaatttttatataaacttaattaatcttgaactaattaattagagaaaaaaatttaaaacatatatagtactaatccgagtgatacccttttaaatcagtgaagatataccgtaacatatagagatggtaatgggcgatatgaactgatacccgacagattttactctattactagtcacatattatctaatttttgtactcattggtctattagcggctaaaaatccttagctgttgagtacatgggacctgttctttagtcagtcatacctataaatctatgtgtaaaaaaatgtgtgccattaatgtattgtctaattcttatatggtttgtttatttgctttgaatgttattaatgttagaattacggtcttctgtgatgaagctggtatcaccatcaagctcagaggactaatgctacctctattttttaatttgtaggacgctgactagttaatgtttaaactaaccagtgtcatataaaaaacaggagggagtattatttttgaatgatcgattaatttttatggatgtcgatagctattgatcatagaggtgacaggaacggtgaagccaggcggcggccgcctgaccttgcccggaaggtggatccgccgcgcggaccatcttatgcaccagctgaaagctacgtggcaattttttactagtaatttaattcttacgtgtttatcaaatttcagctgagtcgacgtgtacaacggcagaccatttgtatcaattttcatgagcacacgcgtcaaatgttttctacggtcaaaaaacgcaagaggataagcgcgcgtctaagttctgacactccgaagcctggtatgttattctcttcgtccaataatatacgttctaatataaatgaattgtttatctagatttattctactaggatatactaaatccacctaaagtgccttatattatgagacagaggaagtattgtatagcatatattttataaataatgtcgaatagcaagtcaagtacataaccactcgatcttaattaggacccatttggtaaagttctaactcctaaatttagcttcaggagttaagggtctatttgacacagctccagctccacctctcctggagctagagcgtagccaaacagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 717 - DNA, 2714 bp, Oryza sativa
  unsure (1)..(2714): unsure at all n locations
ggcgaattcgagctcggtaccctggagttaaatttaggagctgcagctctaccaaacgggccctaagtctggagtggagttgtggagctgcctaaacccagctacaactctctagttcattttgtgagaacgcttcacccagctccactaccatttcaagtggagctgaaactgtttggctggacctaggagaggtggagctggagctgtgctaaacagatccttactatctgtcgagcaatctttgtgtagttgctgcactgatggagaaaggaactttagtcccggttgtgcaaccgggacacatgatccgagactaaagatgtctaacagggactaaatatgcataccaagttaaaaaaatgtgtgggatgtgagatttaaactcaagatctctcacctcagccctcacgcacgttaccattccacctgctacacactaaagatcgattttttttttatcccgggactaaagatactccatctagcatcaacccggacttaaaaatcaatttttttcctggggctaaagatcatcttttagtctcggttgatatcaccaatcgggctttaaaaattgatctttagtctcgggtggtagatcgttgggggcctgacagctgttgaacctttctattcgaaccaagacaaatatgatcttttggcatccgagtaatgatcagttctccagtaatgtagtcttgcttcatggcagtaatgttttggactgaaaaaatgtatgatcccaccatatcctatgtaaaaataaggtatcattgccacaatgcttaagacaagaatatatatgaagatgggttacacatctagatgtaaaattcctaatttaagattaggcccaccataccctataaccactctcaccatatctggtgttggtgtgcatgtgtggccttatgatccattttatggcacattatagatgctctcacccactgactctttaagtagtggatccactactttaaggcattagaggtcagggctaagggcaatggtgctaaccttctcgttaactcagtgtgtcacctcaaatctcatttgccatcgcggtggggtaagtggtgttgtggatagcggcggtgtggattgctataacgtgttagacctctgcgctagaatggatggtgctaaaatcagggcttattttttaaaacatttaacgggtctaatcttacaataatatgtttttataagggtaaatggtcagattttcggtagttcaatattatcgatcatgaacaggataattttagccaacatttactaatattactgtactctcgtcgtgtcataattgtaggaactcgagatgatatttggctgtaagtttcacatttacttatacgcgattcggtcaaacatttaaacttcaaatgtttcaaaattagaaccaaatttagtctaaatgccaaatgtttataactggtgctatacccgtctcaaaattataaaatataacaatttttagttcacttgtccgtattcatagctaaaaattacaactaaaattttagggtggaggtacaatagtatttatatgttctctccttctcatggaactgatttgtgatgctaatcaactgtgcacaaatgtgatttgtggtcttaggccccgttcgtttttattaggatataaattttaccagtatgttttttaaactgttaaatggtgtatttcgtaaaaaaaacttaattaatcattggtttggctttgttgttttaggtattcgtacctaggccctgtttagttccaaagtttttttttccaaactttcaattttccattacatcaaatcttttatacacacataacttttctatcacatcgtaccaatttcaaccaaatttccaaatttcagcatgaactaaacatagccctagtctttttcttcatcattatctaacggggccttattacgaagtactaggactgtcaaatatcgtgcactttattattttcaaagattttctcgatgcacccttttctgccaaaattgtttcaagtcagtcaagatggtgaccagttattacctacgtggcatcacatcgtgctcttatgtggcatctcctgttctagctagcaaacagttggatatgcatgcatgttgcaaatttcaactgagcgccgacgtgttcacggtgcaaaccagatgcacaaaacttaatatcagacgccaagaaagatatgccaaaaagcgcaagagatttcttgtctgaatctgacgtgcacttcggatttaactaattaattagattttgttcttttatttttgctagctagtacatttctcctttggctgaccacttaattgatactatttgggtaaaagtttccttgcttgaatttaatattaattgtctcgatctatcattctgacatcgactctttgagccaatgtcatacatccaatctcctttcaggaattccttcaatatttgattctctattctttaaaaaaaatgtgcatacagttaagaaatcgatatctccgggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 718 - DNA, 512 bp, Oryza sativa
  unsure (1)..(512): unsure at all n locations
cgaattcgagctcggtacccacttgctgttttctgaccgttacacagtgctttaaataccaaccgttgcccccgagaatcttcacaccgtgacttccgttttcaccgcttaagcgaattccgtcctctctctctccggcgattcccccgacgcgcaaggcgatttcctcctcggccaaatctccacccgcggcaatgtcgacttccgccgacccgtccgctgcgccatcaaccagcccgtctgctacaccatcagccgagtacgcagaggtatgtatccattggctagatgcccttttcctacacagtagattgattttcctcatctcatcttgttttcttcttctctacttcttctgtacttgtagcatctttccaatcttgttgcggttcccagtttgttgcacgatcaacaatactttcttggtccaatcggcaatcttgatcccactgaattnnnnnnnnnnnnnnnnnnnnnnnnnnnnnnnnnnnnnnnnnnnnnnnnnnnnnnnn

SEQ ID NO: 719 - DNA, 764 bp, Oryza sativa
  unsure (1)..(764): unsure at all n locations
nnnnnnnnnnnnnnnnnnnnnnnnnnnnnnnnnnnnnnnaatcccttgaggttgcatttcatcatcccaccatttgatcaatatgggtgggcgagaatcttcagccgatcatatccggaggacttcttcttcttcaccgataattgggccttatatattcatggacgatgattagacggatgaagaaggtttatcggatcaaaatggatttagaagagtagctttacctgttattatctctggtcggggacgagaagatccttgaaccttaacaggagacttggatcccgggtcagcgttggcatccttcttaggagggctatcggcttgggcctctgctttcgggatatcttcgctctgagttgtgcccgactggtttccagttgggggctcctgttcagcactgacgttagcttcggccgactagtttccagtcgggggctcattgctagcttgtgcattatcagatgctggttgatctttactcgggtgatcttcggtagtcggcccggtttcaactgaggggccagtctctgtgccgatcggcgtggggtcttttccagaaggatctatatcaaatggctttctgcaaattcgatacacgttgtcagctctgctacaatgatgagcgacttatgatacagaggcattttgtttgatgatacacacctggatgacctctctattttttgcatgggaccaccggatgttttcttcctctggttagtgtcacgcgcccgaataattccgagcagaactagacc

SEQ ID NO: 720 - DNA, 717 bp, Oryza sativa
  unsure (1)..(717): unsure at all n locations
nnnnnnnnnnnnnnnnnnnnnnnnnnnnnnnnnnnnnnnnnnnnnnnnnnnnnnnnctttccccgatatttgagtatcctagtcctttacccttgaaagcacacacttgcatgattagtcagtgagacttagtatcacaaatcagcagcacaagaggaagagagaacacataaatttctcattgtgagatggctggcggcggccggggcggcggcgcggcggcgacggtaaagcacatcctcaaggcgcagaagtcgaccaaccagctcaagatgatggtggccaacctgctgccgccggcgccggcaccggtgatggtgaaaggcggcggaacggggagctctgcacgcgtcatggaggtggaggtggaggtgatcctgtcggacatcgccgactcgctgccgctagaggcacctggaccgctacttatataagggaaggggtccgtattacaaaatactggtcatatccctaacagaatatatagttacagataaaatacaatcgtaactgactaggatctcaaatatttccttgatacacaagtttagaatttaacccgagtcttcctaaagatattctatctatacatggcaccccatacccaatcgggatatacatgccgcgtagatatggggtattcataatcttcacagtagcccctgagaactttgcagtcgacgaaataacctttctcttaaccgaaaatgataatcc

SEQ ID NO: 721 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnnnnnnnnncagagggtcttatattcaatacaaaaataatcaggaacaaaagagggtatggcacaaacagtggtttgctccatctctctgttgacgaaggaaatcggaagaagaaaaaggcaccaacaaacacagtacctacaaattgcttcgaacgtaaatgactgacgacgttaaaacaattgagtccatgaagatgcattgcttcaccaacaccattcgtccctcttcaagctgacaaaaaaacagacgcgggacattagatgtcaaggcatgcaatagaatggacatgacactaagctctgtacggggggagtacatctacagacagtccagtttcgatgtgtgaaacgtttctaactatacagataacacctgctggaagacaggatcgactctgtgtcgccactttgtctcgcacaaattgaacacactgtcacttggtgtcactcctagaacatagtaggctacagatataaagaatgaaaacacaggctaactgtctattaatatcacttagagaccatgagaaccatgaatatgtttatgtcatcatcaaagaaaagagatgctggaatgatgatatcataccgtgacgggtcactgcatcaacctctattaagaagaccaactccttgtaccctcttctttcta

SEQ ID NO: 722 - DNA, 569 bp, Oryza sativa
tcgactctagaggatccccaccagcagaactttcatgcccaacgaatggtgctagcagatcaggtagaaataacaatcacagctaaaattaccaataaaaaaatgatcaaacagttgcattaacaacgcataagactaaacagtttgtctgcacaacattagagtactagagccatataaaccagttcatcagtcatcaatagaaagcccgaaatcaatcgatttataactaaaactgcaattgcgtagctaaagcagcgagttaggctatgccaataggaaattctccaattccacatttccatcgaacccgatacgataatgatgtcttcatgcgaaccattctaccaacccctagtttttgtagaggaaaaaactacctaccactaccactagtgaagcagtgacaagctatccaatttcgcaaaaaggaaaaaaaaacaaacacaagggaatctcctcttctcaccttcagttcttcttgggcttgcacccggagacgaggtaggccatgaggtccttcttggtgagcggctccgtcatctgcaccgctcctccgtcggggggct

SEQ ID NO: 723 - DNA, 566 bp, Oryza sativa
  unsure (1)..(566): unsure at all n locations
nnnnnnnnnnnnnnnnnnnnnnnnnnnnnnnnnnnnatgaagaaggtttatcggatcaaaatggatttagaagagtagctttacctgttattatctctggtcggggacgagaagatccttgaaccttaacaggagacttggatcccgggtcagcgttggcatccttcttaggagggctatcggcttgggcctctgctttcgggatatcttcgctctgagttgtgcccgactggcttccagttgggggctcctgttcagcactgacgttagcttcggccgactagtttccagtcgggggctcattgctagcttgtgcattatcaaatgctggttgatctttactcgggtgatcttcagtagtcggcccggtttcaactgaggggccagtctctgtgccgatcggcgtggggtcttttccagaaggatctatatcagatggctttctgcaaattccatacacgttgtcagctctgctacaatgatgagcgacttatgatacagaggcattttggtagatgatacacacctggatgactttcttatttttggcatgggacgaccggatg

SEQ ID NO: 724 - DNA, 551 bp, Oryza sativa
  unsure (1)..(551): unsure at all n locations
ggctcccgcgccgccgccgctgccgccgccaccgacgacgagggaggaggagaggcttagccttctcccgcagcgaccgcgaggtacgtgtacgcgcgttccgcggcatctggtcctggcctcctagatccgatggatgaaaggatgggtggggtgggtgggtgggtggtttgggacttgggagtagacgcgttagggatcgatgcggtcggtttgccctcggggggagcggtagggttctcgtccgttcctgttgcgttcgtgatggaacccttggagaatcgtgtagaggggggttggggggaggaatactccatgaatttggttataattcgataatggtagcagctaattgttgtggttccgtgtatttcttgaacaaacactaggcacggattgcggttcatattgactttatgttgctccggatttcgtagtgctggcacttttgggagagcacatttattgtggggattcacccttgctggccgctgttnnnnnnnnnnnnnnnnnnnnnnnnnnnnnnnnnnnnnnnnnnnnnnnnnnnnnnn

SEQ ID NO: 725 - DNA, 553 bp, Oryza sativa
gcaactaagtgacttttaaatgctgtttactgcaaaacttaaccccgatattattatccccttgtaccccccttgcattaatcatgcatctgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatataatcgatataataaagatgtgccttttgtatcatgtttgtttggtgtaccccggcatttcctgggacggggattaatacactagcgttcgggaaaaggcaattttctcggtcgcgacacctcgttattatgccgaagaacatgggtgagctcaagtccgtcgaatttgtcttccaacttgcgtacctcctgccggtaagcggtcatattatcatcaaggcaggaccattctttcatgacttgattaaca

SEQ ID NO: 726 - DNA, 652 bp, Oryza sativa
ttaaaaaactatactaatatctaatttaagcaattagttatattttgaccacataataaaaaagtgcatttactagactttaagcacggtatacattatttttttctgaagactacagtaattcacttggatatacagagccggtgaattaaaaaaaaggggaaaagaaaaggggaaaaaaaaaagagaaaacactaagcttcgtggtctcggtgagctcgcggcggtgcaaaaatagaaaagaaaatgaaaaaaaaacaaaaaagaaagcacgaagctttgtggtctgggcgagctcacggcggccgtgaactcgggaccgccggatctggctgtctggccgctggagggaaaaccgatggtgttggtgaggggatggatggcgatggccaggaggggattaagggcgacagtgcgacacaaaagaaaaaagggagcgcaatggcggcgacggtggcacgcttgtggccaccaaatcttgcaaaaaagaaaggaggaggaagacgattgccgcgcgcttgttgaccgccgaatctgactgtggagattatggataccccatacctacacggcatgtttaggccgactgggtatggagtggcatgtatagaaagaatttctttaagaagactcgggtaaattctaacctgtg

SEQ ID NO: 727 - DNA, 256 bp, Oryza sativa
cgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttg

SEQ ID NO: 728 - DNA, 610 bp, Oryza sativa
atatctgggtggtttcacgtggcatcctagtcagaaaaaaagaattaaaaaagtatatggggtccacatgtcagctgcacatatctctctcttctcttttcttctccctcccttctcttttctctcttctctcttctcttctttggccagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtgagaggggaggcggccggcggaagatggggaggggagaggcgtcgccttcctccagacgggccgacgctgtccgtcgtcgtgcacgacgccgcagccgcgtcgaaactccacctccacaattttactcggataccatgataagagcagaagtaaatttcacatggacattcggcacagctctggatacagacacctcaattaacaaaccaaaatgtacacatttagattccgataccaattaaccgatcaaagagcaaacatatgaactaaaaaacatcgattaaccaatcaaagactgaaaattcagatt

SEQ ID NO: 729 - DNA, 1039 bp, Oryza sativa
atgatcgatcaataattgatcaacttacatatctatgttagctagcaagctgaacggattgaacggattgtaagaggcttccatgtagcgtgaaagctgtctcgtttatatttgcctattttttttctctagctagctaactacagcttaagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtatgattatatgtaattacattgtcatttgcacgtaactg

SEQ ID NO: 730 - DNA, 1044 bp, Oryza sativa
ctatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtgatggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcacgtttccatctcacaaaccaccctgttttttttttttactttgatttaaggccgaaaagtagctaacaggtttgcctgtctgtcagactacgtgagttagcagcgttgcaagaaaataatcgtggcttaatttttgtctgaatcaacacagggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcggtaaccatgcatgcatatatcaacgacacaagatatcgagctcgcgattacgaattctgtgatgctgaattgctttatttggtttttaatttggcatgcagcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcacacaatatatataactcctcgatcgatctcctaatcaaccatggaagtgtagtaaacaacagcttgtgttga

SEQ ID NO: 731 - DNA, 1224 bp, Oryza sativa
ttgaactaatctagattctgaacggtgaagttttacctgtatattgaaaattctccaaaaaaaattgacaacattcacaacatatatatgaactactctaaaaaaaatcaagtaaagactcaactcacacattgagaaatgaaattaaaaaacaaatccagcattaattggtactattcacatatgaatttgtctttttatttctcaatgcgcggatcaaatttgaatataatttttggtagaatggtatatgctgtttatactctacattagtaattttttaaataattttacaactatttatattaaatataaaagaaaaggttatacgcgttgatattctctcgggggattagaatccctcttccgtgaaagtaacttacaacttcagattcttctgaatctttgctgatcaactagtataatgtacgggtgtacagattctgattaatcacaaacagatactgagagcagaagaaatatcaatatattgtcattacaacttaattcagtactggccttgattggctgcgattgctgctacagacgctgtggctgaggtagttgaaccgttgcaagctacagccattttgaactgccgcaataacggctgttatggtagcaatcacatccgaacatgcccacgtatgtgatagatcgaaatggcaatggagttcggccccagcttaactgaaatgaactctgcttgattgcatggcagacaaactcattatcatggatgcgagagctgaacattcaactgttacatggtttaaggcgaggcgtggtgtcctaactgttaggacattctcttggatcagtgtcacaacagttactgttctggtgctacctacagtagtagtgcactgtactgttatttgtttcctacgagtatatactggtagcccaaagactgtttagtgaaatggatgaccagggatggtggctgttctgttctcctcactccgttttttaatagatgacaccgttgactttttatcacacgtttaatcattcgtcttattcaaaaattttatacaaatgtataagatataaatcacacttaaaatactatgagtgataaaacaactcataacaaaataaattataattacgtaaattttttgaataagacaaatggtcaaacatgtaagaaaagaaagtcaacggcgtcatctatttaaaaaacggatgtagtattccacacttttccactcacttgct

SEQ ID NO: 732 - DNA, 2327 bp, Oryza sativa
  unsure (1)..(2327): unsure at all n locations
gtcgtggctctggccaccgcggcgtcggcgcagctgtcggcgacgttctacgacacgtcgtgccccagagccatgtccatcatcaagagcgccgtgaccgccgccgtgaacagcgaaccccgcatgggcgcgtcgctgctcaggctgcacttccatgactgttttgtccaagcaagttccacacataaccagcgcctttgttccattttgacttaaacgttactgcagtatatctctagtcaagcaacttgagtgatatttgaattgaactagaaaagttaaatatatattgtacatgtgtgcatgcagttagatgacatgttcagacaaataaccatatattgtacatgtgtgcatgcagttagatgacaattgacaagcaagacaaataaccatacattcttcctgtttgactaactgtacagggttgtgacgcgtctgttctgttgtcgggaaacgagcaggatgctcctccaaacaaggattctcttagaggctacggcgtcatcgacagcatcaaggcgcagatagaggccgtgtgcaatcagaccgtctcatgcgccgacatccttaccgtcgccgcccgtgactccgtcgtcgctgtaagatcactttccctgcatgcatagcctgcacgcttggtctcgaactctcctctcgatcgattcctgtatggttgtacgtgggaaacggatcctctaacgtgaacttcttcctaacgtgatcactaacagtaacaggtgagcccgtcagtggtggaactcatatatcagttatcacgttcctctggttttacgtcagatgatcccgatccatatatatgacattattaggcttcggcttttgtacttaaccaatggagtaataatcatatgaacgcgcatgcagctgggagggccaacgtggactgtcccgctggggagaagggactctacaggtgcaagcgcggcgctcgcgatcagcgacctccctccttttaccgctagcctccaagaactcgtagacgcattcgccaagaagggccttagagtaaccgacatggttgctctctcaggtaaagatccaccatatatgctcacaaaccatcaaaccaagcaagcttaattttctgcactcctatttcatgcgcgcacacgatcgggcaggcgcagtgctcaaccttcaggggcaggatctacaacgagaccaacatcgactcggccttcgcgacgcaacgccaggccaactgcccacggacatccggcgacatgaacctggcgccgctggacacgacgacggcgaacgcgttcgacaacgcctactacaccaacctgctgtcgaacaagggcctcctgcactcggaccaggtgctcttcaacaacggcagcacggacaacacggtgaggaacttcgcgtccaacgcggcggagttcagcagcgccttcgcgacggccatggtgaacatggggaacatcgcgcccaagacgggaacaaacggccagatcaggctcagctgctccaaggtgaactcgtaagcgagtaccctgcagacactgcagtaagtagtaacaacgtttgtagcagtatatgcagttatgcacgtataagacgatggagtgcgtgaaaaaataaggacccccacaaccactacgactgaatgaatagcaatgtgtacgtggagatgtggtacatgcagatttgccttgctctgtttcttgttccatctgtatgtgcatggaatacagaggacagaggggcatatgcatggcgtatatgtaacgaaatttctggtgcaaaggcacggaggattatactatactcatcttctaaatattattcctacaagctactagtattccacacgagagaccgagagacccatcagaagggatcagaatgcgtgtggctgggctgctgggtcatctccacatgagacattttttattgggccgtgaactttctcgttcgtaacatgtcggtgcttctatgaaaaagcccagtataactgggtcacgtcccattaaggaagtagctcattcacactagtactcctgtgtccaccgtcggatccgagtttcaaaaataaaagggaaaggtctgaacagatattaaatttttggttgaaatggaacataattttcaaaacaattcaaatacaagagcaggccatcacaaaatcagaagtacatgcaagcacacccttcaagaaatcagcagctaccacaggtgccatgcaaattcgtggcgatgactcgtgtcgtgtgtcgcttgaccacaccaggatcgatcgatnnnnnnnnnnnnnnnnnnnnnnnnnnnnnnnnnnnnnnnnnnnnnnnnnnnnnnnn

SEQ ID NO: 733 - DNA, 820 bp, Oryza sativa
ctaaaggagcccaaacgaacggatggctgctgaagcctggagaaagaacaacgttaggtaggggataatgttcccttttgcaagtggcgcctagtacttcctcagtccaagaaaaaaaggtaaatcctagattttcgtgtccaacttcaactgtccgtcttatataaaatttttttataatttgtatttttattgttgttagataataaaacataattaatattttatgcatgacttgtctttttaattttttttcataaattttttaaataagacggacggtcaaacgttagacacgaaaaccacggtttgtctttttttttttttatagatggagggagtagacagtagcctctgaacggtgttccgatgacgcgttcgaggtacgcacgacacgatgatagcgagaaccgccacaaaagcgcagtgccagcctctctctctgcccatccgcgacgggttcgcaccagcagcaacttgtatagctgactctgttttttttttaacgccacttgcatagctgactctggcttccaacaattttcagcgaaccaattggcatcgttccatgagaagctgtgtaaactaagaactggtcgactgttttatcgggcaatcgatcgagggaggaaaagtcgaacggcagctctcgtccacaagagaggcaagattttcgtccatcctgtgtcatctgacgccgacgagtcgacgaacttcagtatcttgtattcttgtccgctcatcatagcagggaattttttgcctcttattttccagcccagacatcaccaaatcgtgcttacataccacctccatgacg

SEQ ID NO: 734 - DNA, 677 bp, Oryza sativa
  unsure (1)..(677): unsure at all n locations
nnnnnnnnnnnnnnnnnnnnnnnnnnnnnnnnnnnnnnnnnnnnnnnnnnnnnnnnnnnnnnttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgngccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccctaccagtggagctatctaatctgccagcttgcgcatttttgatg

SEQ ID NO: 735 - DNA, 451 bp, Oryza sativa
cgccccctccacgccgccgccggcgccttccccggtcgccgcccgccgcgcccaccggatgatgacccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaatccgtaacacaaaaggacgtggacgtagtagcgactgccactagctaataca

SEQ ID NO: 736 - DNA, 186 bp, Oryza sativa
ggaagatgcagcaagagcagcagaagctcttgcacttgctgagaacaagggcctacttagcggggaagctacagctggagatctccagggaactgatggagagaacttgtcctacgaaaagcattttgagctggcttcaaaagctcaagatgggacgtcagctcgaggaagaagaatgaagcggca

SEQ ID NO: 737 - DNA, 410 bp, Oryza sativa
tttaatacattgtttcctgtgcatgtaggatcaattgctacctgacccaaaaactttcccttctggcatcaaagatcttgcggactatgtgcatgggaaaggtctaaagcttggtatctactctgatgctgggtgagtaagcagccctctatagatggtttttgttgttaatacaccatgaagaataatattccaaataactaaaaattataacaagctaaagctttcaggatttttacatgtcaagttcgacctggatcgctccatcatgaaaaggacgatgctgcaatatttgcttcatgggtatgagctagaagcaataaattattgatttgaaatactacacagtatgaacatgttaagatttaagagcatattctatggaaattgatttctccagggtgttgatt

SEQ ID NO: 738 - DNA, 667 bp, Oryza sativa
atgaatggatgtcagttcacgattgtactatcaattgaaatccgacgtctcactaatcctgaaatgtaacaaccaataatgttagtaaggaggatcacggtgataaaagaagtgctccaaatcattctcacatcaaaatggtacaaagcgatcaactggaatcgtcaaaacttgtggatgtcacaaaactactgatcaacgaaatggcacacttagctactgatgaatagtgagcgaatacaacgctagagtagatgccacgaattttcacaggctccttgtttcaagccaatactcctatagtctgtcatcaacacatcttcacgttgttacctgggttgatgccgtcagaaggagcttcatgatggtacagagttggagctcggctgcttgggactgtagtaccacagagggccggaggtggagggacaagtcgaacggacgaagcggcgtccccgacccttcatttcatgttatataatgtctgtagcaacaaatatattatcacatgagaaaaatctgatatggcaagagagttaacgagggcagaggtaaaaagatgaagaaaaaatttcttatgcaagaaaccatttctacccaaggattaagaatgaaaacaagaggataggtagataaaaaaaaaagataaaggagatgattagatgat

SEQ ID NO: 739 - DNA, 942 bp, Oryza sativa
agttcacgtgcaatccaatgcgtctgaaggtgaatcacgttgtttgcgtggatggaaaaaatatgttgctccgccttatcgtagacggacgtgctgtctgtccaggttcaatacacttgcctataaagtataaactccattctctcatgtgcaattcgaaataaactagtgatagtagtactgaataaacaagtcgtcgacactgcagcattatagtactgtactacatttctgaaccggaaacggctggtatactcgattgtaggaaccaaatcgaccaatacattccatgctctcaaatgggatggatatatcaaccttcgtctttctgctcgagcagttgaaccgaacgcgagccaccaccggttcttgagaaatatcaggcctgaacatcgacccaagtccccgacatgaatacatgattgatgattgagtatgggtcactttactgaagatacgcaatgcggtggctgtttacagttcagctccggccagcttatcaatgatggcagagcaaatttctattactttctccgttttatattataagattttctagtattacccacattaatatatatgttaataaatctagatatatatattaacatttatataaatagataatactaaatagtcttataatctgaaacggaataggtacattacatatatgccgtttcaagaagtatatgaaagcaaagcccgtaccatgccatattgccatacacctagacgaacagtccatcaccatggttaatcaaggagcacgcatcagcgaaaagcagcacacgtatgatatgggtggtgcgcattagcgtcaagtatgatgagaatggagcatcaatgaaagcatcggcatgatgtaacgccacgaaaacatatgcgacgtggacgtgtcgagagtagcacgaacgcagacgctgttcctgattggatatt

SEQ ID NO: 740 - DNA, 668 bp, Oryza sativa
  unsure (1)..(668): unsure at all n locations
nnnnnnnnnnnnnnnnnnnnnnnnnnnnnnnnnnnnnnnnnnnnnnnnnnnnnnnaatatacatccgaggaacgtacatttcactgtcagtaaccaccggtgttccctgcgaacctgtaattactgttaacctcttcttttaggcagttgcaattactgttaaatttaccaggcaactgaagtcagactatctgtcagcaacagaagggtcgatggcacatcacaccggaacgatgagccgtggtccatggaaacactgaagcttggctggccttccaatggaatgcctccagagatgcagaaaccatacaggtttgtactggagcgaactcctacgttgcattcggggggctgcgggggttttttcttcccgaaactgccttgcgtcggtgcgtcccccgccgtctgattcctcgcaataattgtacggttatgttgctgtcaggaaacggacgagagagagagagaccttagtcggcggacagatgcaaacattgatgaggacgctggatggagtgagtctgcccaagagcagagcagtttgagttctctcgtgcaagcggacaacaaattgcttcgatcagtttgagctagaaaattctttgaaacaaatttgagcaagaaaattttggcatatggtttagcatgcggcacgtcgaacacgagtt

SEQ ID NO: 741 - DNA, 1023 bp, Oryza sativa
cacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaagatggggaacatctcgccgctgaccgggacacagggacagatcaggctcatctgctccgccgtcaactcgtgatctgatcgaccggtttgtatatatccagacgctgggcactcgacaacatgattaattaccagtgcacgaatgcatcaaggaaagaattccagttgcaattaattacaggtgaaacatactactccgtcttagaaagaatccaatcctaacaatgaatcttgacacatgttcgttattaggattggatttttttttttttggaacggaggaggtacgctcgtattagcatacgcaattatagtcctttaaaatcgtagagcattcagtgaagatgtcaccgagaatgtcacggggaatgttactgaatctgcgtccgtttattagcaggtttgcatgcttcttgatctgtaccgacttctctctccaatacaaaatccactcctgttacaagttattttttccctctctctttttttttgagagagagaggactcccgctcttgcaatcttgctagacctgttcgtcctccatcttgcagtagcaagattttttgttttctggattgccgtcggccggtgaccacacgcgcgccgccggcgcgagttaagatatctccaccgcctcggcgatattttgctccacgttgcaaaggcccgtgaaggtgacgatttggcccatctatgccggtgagcgtgctacgtggtggatggggcgtgggccggcttattttcgcggcgcaaaggcctactctttacttggcaggctgccactacttcggcccattaaaattcaccagcggcagaaattgaaatgcttttttttggcgggtagaaaa

SEQ ID NO: 742 - DNA, 672 bp, Oryza sativa
  unsure (1)..(672): unsure at all n locations
tttctagatctgtatttgttctgcaacgcgaggtgttgtggttgatgcgattcatgcgaaaacttaatctgtcatacatacttggaagggtaaaaaaagaaaaaaataatctcctttctactggagatgcatagcgtgggaattataattagcctcttgttatctgctagcctggttgttgagcgaagctttcggatccaaccttttaattcagggtagctttatgtagtacagaaaactgtgtaactgtattgtgtttcctgttactttcttttaaaacaagttctggttgaaaagcgtagaaacagtcttaactggcatgtcttgttttcatgcatatgtgctgtgcagtagattaatccttttacctagaacttctcaattgagttttatgttagttgattccaactagtagttgtccatgactgaccttattgcatcttcttcttttggcagaattactagacttccaataagaaggaaacaccttagggaatgcagaaagatgtgcttgcatgctagagagctaccttgtgagggaattggcagggtagcaagccatatttctccttccacaactcttcatgacattggaacacaagagtatatacagcgcttgnnnnnnnnnnnnnnnnnnnnnnnnnnnnnnnnnnnnnnnnnnnnnnnnnnnnn

SEQ ID NO: 743 - DNA, 394 bp, Oryza sativa
tgtcactcacacactcatcacgcatgattatgttcactcaatcattaggcagcctccatatatgacactagtttctacgtctctagtacgatccattgacgtgattgtactagaaatgctcgagtccaagatgaaaaaatgtcttctcgaagatgccaatctgaataaattgtaaggtacgtactaacctccatttgtctacgtctctacgatccatcgacgtccatcaacatattgcactagaaatgctcgagtccactatgaacgcatggctttctaaagatgccaatctgaacgactgtacagtactagctagtattccttccattttatattataagattttttatcattacccatatttatatatatgttaatagattcattaacatat

SEQ ID NO: 744 - DNA, 604 bp, Oryza sativa
gcatttctagtacaatcacgttaatggatcgtactagagacgtagaaactagtgtcatatatggaggctgcctaatgattgagtgaacataatcatgcgtgatgagtgtgtgagtgacaagttggaaattaaaggatccatcaaatgtcttgaacgagattacatcttcgttaagtgcagtagacgacccaacggtagctgaacatggaggtggtaacacgaacaaacgctaccaatttcacccgtgcagaaacacagcaaagtatagccaagctggtgaacggatttgacccctaatctggtcgattcccaactgtacactgtacagaagaaacacaaaaatgatattccactagtacgcaggttagcaacgacacgtgagcatcacttgtcctctaggatcagggcaagtttccaaagcttcacatgcacatggatggacacacacgacacataggggtggacagaaaaagaccgaaccgaaaagatcgagaccgagaaattcggtcatcaattcgatcttaggcagtgaaataccgaattttgttcagtcaattcggttagtcttcttggttaatcgaatagaccgaataatgaaaaaagg

SEQ ID NO: 745 - DNA, 314 bp, Oryza sativa
aaaaagtatgagatggggaaattactcgggcaaggaacctttgccagggtttaccatgcccgtatcaccgagacttctgagagtgtgcctatcaagatgattgataaagagaaggttttgaaaggcgggctcatggatcagatcaaacgtgagatttctgtgatgaagttggtaaggcatccaaccatttgtgcagttatataaagtcatggctaccaagattaacatatattttgtgctggagcacgacaaaggtggagagttgttcaacaaagttcagagaggaagactaaagttagatgcagcaagggagt

SEQ ID NO: 746 - DNA, 552 bp, Oryza sativa
  unsure (1)..(552): unsure at all n locations
nnnnnnnnnnnnnnnnnnnnnnnnnnnnnnnnnnnnnnnnnnnnnnnnnnnnnnnnnnntcgcccattagattgtgtccgcaatcgatcgtgtcagccgtcaaccagacagcaacaacagtgctgtgctgctacggggaggggagggtgtgggggctgcatgtgtcgtccactcttgcatgctgtttgactagtacgtgatgcacatactagtagtctagtgttacgtggtagttgggcacgttgtgggcgtctcggagtcgccacgagcacacgagccgaacaaaatcccagtccattggacccatttggcctcgtatatattcgttataattaaaaaggagaaaaaaacatatccagagattaaaattagaaaatcggctaataagactcggagttttaacctccgatccccttgacctcgatgctttggtagtcatcatgtaattttccctgttctttctgcaacaaaagttggataaaattttagatactcgtggcacgctttttaaatcgttaaannnnnnnnnnnnnnnnnnnnnnnnnnnnnnnn

SEQ ID NO: 747 - DNA, 733 bp, Oryza sativa
ctgatcttcaagaggctaacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgccatttggctcaacctacagtcgagttggctctgataccactttgtcacgcccagaaatttagcccaaatttccagactattttgtgtattaaatccctgttcaggaccagccagggtacacaaaacgaca

SEQ ID NO: 748 - DNA, 611 bp, Oryza sativa
atagattcgtctcgcgaattagtccaagattatggatgagttttattaatagtctatgtttaatatttataattagtgttcaaatattcgatgtgattataaacagggtctcattgcccatgtttttggaagcttcaaaggacaggtgagtccatggatcctcgcgcaaatgggggcacccctgctggagggaaggcagagggatactgttccctattccacagggtcaacggctgccaaaactctaccaatcatgaaacaatgccaagcttcaagtgatggttcagtactagtagtactactgtacaacattagcatctcttgattattttctgtacatcttttgtgatttactttagtcactggtgaagtaaaatacagtacccctaattcaagtacaaacaccctgctgtggcttgggctgttggtattgacactcaccagtacagtggagtcaaatctaccacacatttgaaagcaaaaatgttagagcaacactactaagggtgtgttcggacccaagggttcccaacacctctccatcgttttccgcgtgcacgcttttcaaactgctaaacgatgtgttttttacaaaaagtttctatacaaaa

SEQ ID NO: 749 - DNA, 569 bp, Oryza sativa
agagtgagacttgagagatagctcgaggagttggagtacgcccaatgagccatgcacacaacgggccagggatacgtacttgctgccaggcctcctagtgttaccgtgtcagcaccggatattttcactttacccttcggtggaggtaaacagccaagatggccccggtccaccgcaaatatctttcacaccgtccgtcactctagccagccagcgagcatcagtttggcagaaatcactgatcaggtgtctagctgtcgcgctgaccaaaagaaaatgcaaagtttacagaagaagtccacggtaagtgttgtggtcatggcaaatgttcagcggaaaaactgccacgctggcatcgttagttgtcagttgtcacagccaaatggtcatatgttcctggcgttaatttatccttacgattttgttcaattaatcccatctaatatttttttcatgggaaatggccaaacaaggcctaagtaaattttgaaaaactatggttgtttagttcaaactatcactaatcactttgctacaattttaattgggtatttcacaaaattataaca

SEQ ID NO: 750 - DNA, 552 bp, Oryza sativa
cactgtgtgctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgcccgagtcgacggactacttccccgccggcggagagacgccgtcgtcgctgcggcggctccggggcgtaagaggcggaggcctgcagccttagttcgtggaccaccgccccgccatggaggagcgcgagcgccaggtgctc

SEQ ID NO: 751 - DNA, 1856 bp, Oryza sativa
  unsure (1)..(1856): unsure at all n locations
cggacagcaactcgtacgacggaaacctgacgtcgacacgctgttttgatctaattaattaatcaggcgcgcatcgatcctacatgtggttctttcgatacatatgacgagtcgcggtgcgcatgttcacggctatcggtaggccgttggattcggatatactactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttcctcttcatgtgtctaaggttcctgcgtttttcctgtatgctaaccaaacgacagtttgaagactttcctgtgtttcaaaatcccataggaatccaataagcgtggtattcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatnnnnnnnnnnnnnnnnnnnnnnnnnnnnnnnnnn

SEQ ID NO: 752 - DNA, 14947 bp, Oryza sativa
  unsure (1)..(14947): unsure at all n locations
ttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcccgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcgggtcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaagaacagaaggtgattttctcaatgccaacctctatatatacagaggtgaactctagaaagggaagagactctctctctttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcaccttccgaccacccccgtacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatctttctcgtcggcgtcgacgtatccgtttccacgagcccaacgacgaatccactcctcttgccaacgacgacgagctgtagagcaggatgagctgccggtccaaacgacaagtagctccgcggccgccgccgtcgtggtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccttgcatcctcagattggtaagaaaccaatttgcttgtgtgttgtttgtgcaacaaacaagcaaattcctttttgttgagactatttaaattgtagaattaataatggttatcacacataggagacaggggtgtctgtctcgctcaaaacatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaacccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccggggaccgggaccaccgaggctgtccaccgccggtccacgggaaccgacggctcggatcggcacaaagccgatcggacggtcacgaggcggcgcggctggggcacgggcacggcatgagaccggctcggccgacccaaggcgcggcggcggcatgcggccaccggcggcagcagccggcgacgaggaacggcggtgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctaaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcgggcacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggcaatctgcgccgccgccgcctcgtccgccacgctctcgtccgcggcgctcgccgagtgtcccgccgcgaacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaccctatacatgttgcaacaaaaataacaagttagactaaaatagttattgcacattcgcaactatattttttttatctttggtacaacttataacagttgaatttaaacttgcatgtttgtgaagtgatatattttatcttaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcaaaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggctnnnnnnnnnnnnnnnnnnnnnnnnnnnnnnnnnnnnnnnnnnnnnnnnnnnnn

SEQ ID NO: 753 - DNA, 1490 bp, Oryza sativa
ttatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactcttccactgtctgagtttgattagccatgacttggggttgaggctgatcttcaagaggctgacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactg

SEQ ID NO: 754 - DNA, 585 bp, Oryza sativa
  unsure (1)..(585): unsure at all n locations
nnnnnnnnnnnnnnnnnnnnnnnnnnnnnnnnnnnnnnnnnnnnnnnnnnnnnnnnnnnattagcctgatttgcaataatccctagaaatcgtacggggatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgaggttcttctgtgaccagccagacgcccaaagtccccagaccaacgttgccagcgttcagtttctgtgatacgacatgccatgca

SEQ ID NO: 755 - DNA, 831 bp, Oryza sativa
cagcactgtttcctgggactggtatcgattaacaggttaatttggagcgtcacgggctagttccgctcgggacttgttcggggcgtgacatttacgctctctttgttttccttcccaacagaagagaaaggggagggcaccatatgttgtatttgtcattagggcattcacaatgcgcgtgcgtggcgttcggctaacccgagattctccgccaactcagcttggagcgtgaccgaacaaggttcacgtagcccacattgggcactcgttcttcgttagaaaagctgtcgtgcgacgcagggaaaaacggcacggccgctctgtgggggtcatggcctcgcgcttcgtggccccgtgcgacgccggagagagctgctacagcaccggagagggaacctcgtcgccgcccctgctcgtcattctcctctccgcgccgccgagctcgtcggccagtctctccgattcgcaactgtgacatcctggcccaaggcttgatagattaatagaatactcataacaacaagtttgcaacttcttttctggaagccgatctccaaagaactctgtggttaagcgtgcttggaattttgggatgggtgaccgaccaggaaattcttttcaggtgcacaagtaaggataaagtgtgcagaaaagacttgtgttggtctgtgagggcaatctatatccaagaaaagctgccagatgtaagtgggcctgacttgggaggggtgggacgttacagcaacggagagggatgtcgcgccggtgccggagggaagaagggagaagccacgggccggatctggaaaagctgccagatgtaagtgggcc

SEQ ID NO: 756 - DNA, 630 bp, Oryza sativa
  unsure (1)..(630): unsure at all n locations
nnnnnnnnnnnnnnnnnnnnnnnnnnnnnnnnnnnnnnnnnnnnnnnnnnnnnnnnnnnccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctccgccgagcttaatggg

SEQ ID NO: 757 - DNA, 877 bp, Oryza sativa
  unsure (1)..(877): unsure at all n locations
cagttgataaaggcagacagcaatgggagggtctcttcttctctgcctccactagatggcgttggcgggtgaacgctctaggggccaggatctatcaaatgtgatcgttgacaaacgcagggtgatggaggatccgtttggaatgcttctcaagagcgtcttagtgtgaggattccccaagaggttgctaatgttatcaacatcgacagagaagacctcaacctcctatgagaggaggcctctttcggatatggacctcatgtttcctttgtagttcaacttgattcttctgccttctttgtcggtggtttggatcccgccgtttatgtaattattgctgttgtgttgaatttgtgtaaaagatctagctaaaatctttggtggtgtatnnnnnnnnnnnnnnnnnnnnnnnnnnnnnnnnnnnnnnnnnncttatatgcatatcacctggactatttactgatataaattgaacggccaaaaaaaaatatactgtagcttcactgcatttttcttgctcgatgtagaggatccgattcgagagtgaaatactgttactacaccaatggacggcgcatattttcttgccgcgagcacaaggccaaaggtttgattgacagaacgtccactttaaaaaacctggttgaaacagctgaaaacgaaacgaattccagcccaccaaacacaattacacaaacacctccgagagctccgaaaccgaaagccccctcacacgaaaaccccaccaaactcttcttcttcttcttcccccattttcctcgcgttcccctcgtgccgcccgcctccgccgtcgcgttcccgccgtcgccggccgtctttcccgaggggcgcagtcgcggagcgccccacccccccc

SEQ ID NO: 758 - DNA, 1295 bp, Oryza sativa
ccaagaatgaggatattatttattaaaaatgtttactatagatgtatatatacatatatcgaaaaataatatgcaccaccttatctcttcccctgcttattctctaggtcttttcttttccttctgtctttctttccagtatagcaaattatatgcaccacctaatcttttcccctgcttattctctaggtcttttcttttccttctgtctttctttccagtatagcttcatgcaattctggaatcctcttgaaatttcccatccatctaattcaatggttaagattgattgaccctcttttgtctcccagtgaatccgacggctaatatttttcagatgatgtggttaatcctcgtgtttcacttttcgttagttaaagagatatggcgaacaaattcgagagcgttttccttgtggcttttgtaggtgaactatctatatatttttcaataaattttctcataaagtggaggttggggggggggggtagaatactcccactcgtgcatgccttgtgattttttcccttagccgtttgcatgaattttgagtaaatctaactattcaaaattatatgaaagttacatacaagttacaatataattacactataattatattgtatttaattttgatttttgggagaaaatttatcaataaatgtttagcaaaatcgttgtagattaccgataaatattatagcaccctcaatgcactgagctgctgaggtaatatatgggcttaattcgaaagcccagttccggcctctttctatccaccgtacaaaaggaccgtctcgtttcagttgaaaggccgaattttgagagaacggcccaaaaaaggggccaaacggcccacttctccgtgcctactgcctacgcgtgcgtgtggcagcctggcaggtttgcagcagtggccaggatggtaaagcagtagcattgctcgatgccaaaccggcggcccggcgccgacgatcgccgtgtgccgacgcccgtagagattcgccgatctgtccttgctccgttggttgattgcggccacagagaatcgcgcctaattctccaccgtccgtttcaacaagcttaacggtgtagatcacccgacgaatttttttctcacctgctaggcgtgccgttgattgcaaattcgaacccgacagcaacaatgccgccgatgacaacacgaacagtcgaacacgacgatgatggtgatgaagaaaagggcccatgttgtacaaaaagtttctgcagcgtgtgccggctagtaaatctatagtactagtactagtactacc

SEQ ID NO: 759 - DNA, 857 bp, Oryza sativa
agcatgcaggaaataatacaaaaaacatatagaactagtcaacctcactaacaagcaaccgcaatgacgtcgaatttgatttaattcaataaaaaatacatgctaaaagaagtaggagtaaaaagaactcacaatgcaacaagggaactgcaattcccaatctgcgacgggatgtggccggtgaatgaattccgccccagccgcagctcccggagcgccactgcgccggcaatctccgggggcacgccgccgtcgagacggttggcgctcacatcgagcacctcgagcagcctcatcccgccaatgccggcgggcagctgcctcgcgaaggaattcgaggacatgttgagatactgcaaacccgcaaaagcggtgatctgcggcgggatcccgccggagaacccgttgctcgacaggtccagcgcgcgcagcgccagcgcggcatccgccggcaccttgacccacccgtacaacttgttcccagcgaccgagacgcgctgcagcggcaggccgaacacccaccaggggagctcgccggcgagcgcgttccggctgaggtccgcctccaccatcttcttgcatttcgcgatggcgtcagggatggcgcccgagaagcggttcccggacaagtccagccgctccagcgcccacatcttcccgatccacgacggcacctccccggcgagcgcattgccgccgacgccgaggaaccgcagcgcggacagccgacgcagcgactccggcaacccgccggtgaagagattgtgcccgacatccagcgacttgaggagcgccgcctccccgacgtccgccggtatctccccggcgagaaggttccggctcaagtccaccgcccg

SEQ ID NO: 760 - DNA, 3144 bp, Oryza sativa
  unsure (1)..(3144): unsure at all n locations
ccaatcttccccgtttttcgcccgcgccattgtcgtcccctctgtctcgccgatcgccgatcgccgaccgccaccgtcacgtgtgccgaaggagtcggtgcacgttaggacgcggaaggggactccggacgcaccctctccttcctcttccccggcccgaggccggagagatcgctcccgtgccgtcggcccatcgtcgctgcgccccgtccgcacggtagtgcatctccccgttctccctcctcaatccatctcttccccttagttttcggtagtagcatgtatagcctccccgtagctagccggcgccgccccgactgctgccgtcgctcgccgtgtgctcgccgccgtcgccgcccgagctcggaagcgcctctcgttgccggcctccctcgatgcgattcctcctaatccggcgtaaggggtggattcccgtagccgtgtggatgctctcgccgccgggaatcgggccctcgtgacctcatcgccggtttccccttctcccgccgtcgattgccgccaccgcaatccgccgccgtcgagcaccctcggtgaatctgagtcgttggctcgtctcccctcgtcctgtgcaacgttccggtgtactcgccttcgcctgtatcgccatggttcgctccgccgcaccgcgtcctccgcgaaccgcacgcatgcgccgcgcctcccctcccaaaccctagcacgccccgcgtgcacctcgctcacggtgagccgagtcgccgacaagcgggtcccacctgggaccacgcgggatggacctggcccaccggctctcttttttcccttcccggccgcgcgcgcgccttgggccgacttcttggcccggccggcccattaagctcggccgagccaccccttctctcgggtcgcgccctagccgcccgaggaaagtctaattcccctcccttcttcttttcttttcttttctttttcaaaaaggatttaaataaatccttttcctttagaccaaaaatccaataatcttagaaattcaatatcttcccaaccgtaagtccgtttgactccgttcaacttctaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatatcgagcaaggcaagccacctttgaacatcttgagcctatatttgaacttaattatgttgcttgaaaaatattatgcattgctaggatcgcacttaatctacttgtcccgtctgcaaggcagattggcggacctacctaacttgttgcatttgacccttccattgtaattgttataccatgttcccttgtaaccacctagttgcgcctcggtaatcgtgcactctgcacgagtatcgacggtcgccttcaaacttaaaatttgagaaacatcttgggtaaaacttgggttttacaaaagacttggaaaacccgacacctgggtcggtgcttgcgaacctaaatgaatttccaaaatcgcggaccggggaacgtatcgggtgtacggtttcccgcttttgcacttaaggaccgtttccttggaatttcatccgaacataagacaagtacgaccacatgggtggaatgggacatccctggctgagtaattagctaaacaggggagccttgatgctgagagacaagtggattcgccggggtggtgtcggggaggacccctgggcttcctggcacagtatggtctgggacctaacctgttgttggtctgggacccctctcgtcagcatatggtgaacctgtgtcggctctcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggttcgggattgatgtttggaaaatctgcggctgatgggatcagccaggcccgggtggccgtttgaaagctgttggctgggtgccaatcttgatcaattcaaaagactgatacattgcacatactccgaccggatgagtcgcactgtctcatccgtgtcgtttgagaagcactcacctagttgttttagaaaagagttcaaataaaatcaattgcaaaaaaaaaacaacagcctttccttgaagcctgcattaaacacttatttcccataagtcttggcttccgcttcccttttgtaatgcagttgtgagctcgggatctgtccgcagcccaacatgactgtactcctactctataataaagagacctttgttgctgtgatattctgtcttcctgtgataccagcactgtttcctgggactggtatcgattaacaggttaatttggagcgtcacgggctagttccgctcgggacttgttcggggcgtgacatttacgctctctttgttttccttcccaacagaagagaaaggggagggcaccatatgttgtatttgtcattagggcattcacaatgcgcgtgcgtggcgttcggctaacccgagattctccgccaactcagcttggagcgtgaccgaacaaggttcacgtagcccacattgggcactcgttcttcgttagaaaagctgtcgtgcgacgcagggaagaacggcacggccgctctgtgggggtcatggcctcgcgcttcgtggccccgtgcgacgccggagagagctgctacagcaccggagagggaacctcgtcgccgcccctgctcgtcattctcctctccgcgccgccgagctcgtcggccagtctctccgattcgcaactgtgacatcctggcccaaggcttgatagattaatagaatactcataacaacaagtttgcaacttcttttctggaagccgatctccaaagaactctgtggttaagcgtgcttggaattttgggatgggtgaccgaccaggaaattnnnnnnnnnnnnnnnnnnnnnnnnnnnnnnnnnnnnnnnnnnnnnnnnnnnnnnnnnnnnn

SEQ ID NO: 761 - DNA, 4004 bp, Oryza sativa
  unsure (1)..(4004): unsure at all n locations
ccagtggtggtgggaaagggaagaagacatgtcggcttgggaaggttaggggaatgacctgggaagggaaaaggaagcccggcgtactgtgggagattaaaatttgttatgtgtggcttcattcacttttttgtctatgtcgagcacatggtcacacgaaccaagccggatgcactgctaatgcccttatgtgaccaacagtgtgctaaaagcagcgatcaatcacacattgtccccaccagtaagtcatccgggacttgttacaaatagacttcccagccatcgtattatttgcttcattcaagttagtacagtcaatactacaccctttccttccttttttttttcatataggaagactttactactccctctctaggggtcggtttcactgtccttggccgactctacaagctttactgttgaaatttgacgatgactccttttttttttcttcagaagtataatattttgacatcttcaaggtacgaaacgtacgtaatcttgtactatcccaaaagttctaaacaatacatagcactccacacatcatgcagctccatttgttggtcccctttaccataatcagtcgattagtcaggtctcgccggcccatttcggcctaagcctgatgattgctactcctgcatgtctagctaagctggtcattaggagagaatttgttgaaccgcggtcccgttgaatgaaaccgtgcaaacaaactcggctagctaatcgtgctacacgtgcgtcccccccgccgtaacctatgacatcggaccaacggacagatcggcgacaggttcatgcacacggtttcctgcaaaaatgtgtgccgctccagtgtgtgctgctgcctaccgagacgcgatgtgaccttcagttactgcagcaccggccatttcatggtcccgggtctcgaaacagaggttcatttccatgtttctgtctgtctttctgatagagatatttggtgaccatattggtgtcgtcccggatgaactgtgcagctagccattcactgaaatggcgtccgagttctcttcagagaatctcgagttaattaccgggtcagttataaattgttactgcaattccatatttgcatggcatgtcgtatcaacagaaactgaacgctggcaacgttggtctggggactctgggcgtctggctggtcacagaagaaactcaccaagttggtttaagaaacacgataattgccaaatcaatgacctgccgaccatcatctcgccgtttcttccgtacatgcatggccgtggctcgatcgttaagtcggcatcagctggacaattggacgaattcaaagacgctacatttgacatggtacatatggcacaagcagacagctgaaacaacaccagtcttacttttgagtagcgtcactttcttggctggtaattaccaagggcttcatggttttactggccaaagcgcgtgttaaaatcattgagctaagtcagactgacactaattttgttagataatggaataggaaaatattagtgtcaagctgacagtaatattccggttccctctatcccactaagtcgttcaaaatttgtgatcgatcaccgtacgatttctagggattattgcaaatcaggctaatgcatctaattaactgaagtctacctagaaaatacaattaacaaagagtattaattagtgggtacgtacctagggtttccaattgatgccagatctcgacccctagcagtctaacatttttttttgtcaatttttgatcaaatttcatccgaattttcatgtttccaatttggattctaaaaaattattcaaaattacattcataatctactttcaacccgtgtcaaaacctcgagatttcgtgcatcgaaaatataaaccctaggtatcatggtcattttacatgactgatatgtgtgagaattgctacaaatataatgaagtcgacgaagcgagtagtcgcttagttgccgcgtgccatcgcgtaagcatcactcagtaagtaactccgagctcgtcgcaccgtccatggaagccattttccagggaatacatatatattatgcttatattgacaaatgcgaagatctgggtcaaaactactcctacagaagagaaattctaattggtcagtagaacgtcagtgcgcgtgttcgcagttttttatactagtatatattcatcgaccttaaaaacaaactagtatatattcatcacaagggagatttaatttccccgaccggttttggtcaaaacacacgtacgtgtgttgcagaacagatttctgtcagagacctcaagctacagcgacttcatagcggtttataatataaattgcagagattttgagcgttgttttgtattgttgcgtgaaactaactacgcatgcgtggatggaacattctaaaatgtgatgggccctcgccatgcaatctgctggagttgacagagaaaaaactggcgggtcaaatgcgcttgccggtccaggccgtagaaaaaccagaccgtgcacgggtctttaattattcagcttgtctatgcctatgcgtcatctctcccacgattagcctgagtcggcctagccgtcagatgcttcgagcacgaatcttgagaacacggggggaagaaagatctggaaaacataatggtgctagaaattcctgaccaattaagtgagtatcatttctgtaaggatggattatattaagccgttttctattttagccatatataaatttgacttattttataatattattgacgtcgtattaaagatgtcatcaaatacttaaatttataaataaaaaaaatcaaataatcaagaactattttctagagatgatatcgtttccaaccgttttcattttatcttggagaggttaagaaagaagcactcagccgttggatgcacatccaacagcctggagaggtttctaagtcgagatcagagcactagcaaccaacagataccagggccaatgatatgagataagagaacatcagcgtcatgttagagcgcgttagggagactggttaaatcgaatctaataaatctgagatcaagttgcacatatgcccaacgacccgtactattatttgtccaagttcggttcaatcttggtccaatgtcaataaggagatccaacttatagaatatgtcactcaccagctacatgctgaaagcggtactgatccgagatattagttaattactagtacaaaacgagtttaattagcactaactaggagtataagctaaacctgtttaagccggcccgagcgtttcgcctagagcttataagccgtagcaaattaatattagaaaaagaaaattataggtaaaactttttatgtgtatgtttttattgacttaaaacccaatgttaaaaaataaaataagtacaagatcgaaactaaaatcaacttcaaattaacttttaaaatttaaattttgactgcaaccggtaatctcgagagttgctgcacatgtcccgttagaccgtagtcctggtgagaaagcatcactatccccgttatatatatattttttccctagaccttcctagtcattgttctcacgtcccaatgagagtcagcgtacgttaaatatgatatgaacatggcatgtgtcaacttgtgcaatggaaaaaaggattagacccaatcactccgggttgacacgtaaagtattacggtgtagttagacacaaagctggaaagaatatccacttttatcacctcagaatggcatgaacgactgaaaagacaaatagaaatgcagtgtacgacttttattgtagacaatgagatgcaatgtacttggcgcaagatttgcgaatgctgaatgattctttttttcttttttggaaggtcaacgctggatgattcttaaattggggacaatttacacagtggtacatcgaatgatttacgcgcagagnnnnnnnnnnnnnnnnnnnnnnnnnnnnnnnnnnnnnnnnnnnnnnnnnnnnnnn

SEQ ID NO: 762 - DNA, 4376 bp, Oryza sativa
aactaaaatcaacttcaaataacttttaaaattttaatttttgctgcaacgggtaatctcgagagttgctgcacatgtcccgttagaccgtagtcctggtgagaaagcatcactatccccgttatatatatattttttccctagaccttcctagtcattgttctcacgtcccaatgagagtcagcgtacgttaaatatgatatgaacatggcatgtgtcaacttgtgcaatggaaaaaaggattagacccaatcactccgggttgacacgtaaagtattacggtgtagttagacacaaagctggaaagaatatccacttttatcacctcagaatggcatgaacgactgaaaagacaaatagaaatgcagtgtacgacttttattgtagacaatgagatgcaatgtacttggcgcaagatttgcgaatgctgaatgattctttttttcttttttggaaggtcaacgctggatgattcttaaattggggacaatttacacagtggtacatcgaatgatttacgcgcagagttaggaggttacggtgtagttagacataaagctggaaaacatccacttttatcacctcagatcagaatcgcatgaacgactgaaaagacaaatatatagaaatgcagtgtacttttgttgtagacaatgagatgcaatgtacttggcgcaagacttgcgaacgctgaatgattcttaaattggagagaatctacacagtggtacatcgaatgatttacgctcagagttaggaggttatgttcgttgcattgaagggttcccttttttggtgacttttatttggtagaagaccccaaaaggccaaaactcgtctgcagttagctaaaagttgatctagaaaaaaaaagttagcatctgatacattgaactcgaatctgaaacgttttggagccatcttgacctgagagaatctgtgatatacctgtgttgtgattgatcgatcataattaaactctgctctgggcctcgggtacgtgtgcacgtgtgatcgtaatatttggtttactgacgagggagatttaggcgttgatcacaatctagaaaagctttagaccctatttagatggtgttaaaaattttaagtccctatcacatcggatgtttgaacactaattataaatattaaatatagactattaataaaacctatccataatcttagactaattcgcgaggcgaatctattgagcctaattaatccatgattagcctatgtgatgctacattaaacattctctaattatggattaattaggcttaaaaaatttatctcgcgtattagcttttatttatgtaattagttttgtaagtagtctatatttaatactctaaattagtgtctaaatatagagactaaagttaagtccctgaatccaaacaccatcttaggcgttgattagtggctgagaattgagatgacccgcgggaatcgatcacacgtatctcagttagttctaggaagaaaccaattatttactccgcctaatattatatctaactatatattattaaaacaatttaaaaggatgcaccatattgtacgctagaaaccatgattatcattaaggtttttaaaatcgaacatgattaacattgagcttttttttttactttttagaagtcccgccaactgtcgtgattatgctcttaacagtctatccgtcgtcccttcttttaatcgtcattgggattatatttgagatttcgttaatagtttctagatgtcccatcaactgccgtcactcactcctttataggccagttgcttctcccatctttgttgttatcgttgtgctttatatgaacttttttaaaaaaattccatatttttattccgatatttttatttataaattgtactcctacttaaaatcttataattattttctctcttcataatttattttagttgttattctgaattttaattaatctcggtcatgtgttctatatggtttattctttcaatagtttttattttttattacgaattttagttatttataaattatatctatagttgaactcttattcttatttttctaattacagaatttattttactttttctttcgaactttaattaacctttaaccttgtgttctatatggattattcttttaatactccgtccattccataatatagcaacctagtatcggatgagacatttcatattacaataaatttagacaccctcttgtccagattcattatactatgaattcatatcccatctgatattgctatattatgggacggagagagtatttattttctattttatattttaatttcagttgtttcaaaattgtatttctacttgaactctcttttttattttcctaattttgtattttattttattttttattatatattttaattaatctcgtattagattctcagatggattcttctttcaatattgcttattttccattccgaatttcagttattttgaaattgcatttctacctgaactcttcttttcttttctaattttgaattttattttatattttattctgaattttaatttctcgtatttaattcttatttggactcttgtttcaatattgcttatttttaatttcgaattttagttatttttaaattgtatttctagttgaactcttatttttctttttttttctaagtttaaattttatttttaatttcagttatttttaaattgtatttctatttgaacctttttttttccttttatccgattaatgtgggaatttttatttccttaccatgaacttggtgtctccttaagggcaagttttatggtagaggtgactaccatatccaatttcatacatgacatacataattaaattaagaggtgatatgtataataggctatctctatcacataattcccaatatctctaacactctcacatgtttattgaagtttgtgtaggggctgccccttgcatgagaggtgactatttctctctcatccttcttctctcctccacctcactatttagtcttttgtgtcatcttgggatttatgtttgaatgtccatagtacttgccctaagttatctacagatactccgatacttcgatcagtttgatgagtaaaattttagcacgacacttcgaaaagttcatcaccgagaagttggctactctaaaaaaaagttagcatctggtacagtgagctcgaatctgaatcattttggagcgaccttgaccggagcgaatctgtgtggtacacttgcggttgtttttcggtcaatcccaatcccctgcatgcgcccttccctgcgcgcgtatgcatgtgatcgatcgatcatgagctctctgctctgtacatctggtacgtgtgcacgtgtgatcgtaatcttggttttactaaagaaggagatttaggcgttgatcattagtagaaaagatttaggcgttgatctgttcctgccaacgacgacccggggggaatcgatcgcccgtatcttattgaaaccaatcgaacaatctatctattaacttattaaagtaatagaaaaataagcatccacgttggcttttacggtctaaaaattattatattaatcggagaaaaataaaaacaaattccatataaaaatacaatttaaaaagtaaggaatattggaagaggagactagaagcctccacgctcgctctcccggcctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatacaatttagaaataactgaaattcgaaattaaaaaataaaaaatattagaagaaaagtatagagtgcatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataattaaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattgg

SEQ ID NO: 763 - DNA, 1743 bp, Oryza sativa
  unsure (1)..(1743): unsure at all n locations
nnnnnnnnnnnnnnnnnnnnnnnnnnnnnnnnnnnnnnnnntaaggaatattggaagaggagactagaagcctccacgctcgctctcccgggctagaaattctcatatttaaaaaataaaaacagagtccatatagaatacaatttagaaatagctaaaattcagaatttaaaaaataaacaatattagaagaggagactagaattcatgacgatatacaatttagaactaatgaaaattcgaaattaaacaataataaaattaaaattaagttagagtccatatagaaatacaatttagaaataactgaaattcgaaattaaaaaataaaaaatattagaagaaaagtatagagtgcatatagaaatataattaagaaataatagaaattcggaattagaaaacaacagatattagaagaagagtatagagtccatataagaatttagaatgaactaaaattcggaataaaaattaaaattaaagatagaatttagagtctatatagaaatacaatttataaataattaaaatttgaaattaaaaaatttatggaagaagagtctagagtcaatatagaagtaactgaaattcaaaaataaaaaaaaagaatattgaaagatgggtttaaagtccacatagaaaaacaattagaaataatgaaaattcaaaattttaaaaaaaatattgaaaaaagagcctagagactatatagaaatacaaattacaaataacgagaattcagaactaaaaaaatgaggaatattggaagacaagtctgcagtccatatataagaatacaatttagaaataactaaaatttgatattaaaaataattaataactatcacgtatatacaatacagtatgagacagtggtagtttagtaaagttagtacaaaatttaaaattatgttatcattttaatatattttaataataaattgagaaaacatatatgtggccaccgtgctagttctgggctgtttagttggaaaaaaattttgctcctgtatatcacatcggatatacggacacatatttgaagtattaaacatagtctaataacaaaacaaattacagatttcgctagaaaactaagagacgaatttattaagcctaattaatccgtcattagcaaatatttactgtagcactatattgtcaaatcatggcgcaattaggcttgaaagatttgtctcgcaattttctgacgaactatgtaattgatttttttatctacatttaatactgtatgtatgtgtctaaatatttaaggtgacaacgtgaaaaattttgttttggactaagcaggccctcagttgatcagatgagagatccacatggaacacaggactctgaaccatgtgatgatgtaacgtggcgacgatcgaggacacataattaaaaacttggccgcgacacgtttttggcaacttctacgcgcggtcgtcgtcgtgactctcgccatagttttatcatcatcatcagcgatcgatcgatcgagtagccgagtacagtgaccgagtagcactagtgtacagtgtggctcctcgctccatcgatgggtcgcgacaacgccataattggggacatcgacagagtagttacgtgtactgtagtagcggaaggggaatcacgttgcggccaggtgatcgagctgccgaagccgagtgaagtggcggggcggagatctcgttgtcgatcgcgcagcaacaaagcgggtgctcggtcgctgagcct

SEQ ID NO: 764 - DNA, 1831 bp, Oryza sativa
cgcgataatcgtgtggtaacggtacggttttgtactctatcatgcaaggtagtaacaggtgatttcttggtttggcgcagggcgcgtggcgccaagcccgttagggaggtgaggagcggcactacgacggacgggttcatctggagaaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctgaacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttcactggatgttgttgaatatcacaagcttagagcacaacaacgttgcatcaaataaacagaagaaacagaaaacagctaggtacatctatgacctttggaggtcaatttcttattgttgttcgaggcgaatgtgtatattacatggggagaacaaaggagcgcaactgcgaggacgagtatgcatgcaagtcgtcttctgaacccaaccgtcaaagtccacagccacttggggactaaagacaaactagggttgcttgagtttgatggggatggaaacggaaagcaaatgggccagtcaatcttcaaacccaagttcctgtgatcatctgattcatccagggtgatgtgtaacctagagaaatgccatgttgtgagttcaacgacaattggttttatcatttatgcgtaacatcatgtaactagttcagttatcatttatcaaagcacataggcagtgtttatagacctatttgtatactgtacatgcatgggaaaatagcatgaaagtaaaactgtcaagtgttaccattagttctctgcagtactctcggagcttggacctttgtgaccaccagtcataa

SEQ ID NO: 765 - DNA, 305 bp, Oryza sativa
ctttcctagctccgccgcccagctcccgtattgaaggcggaggtcgcctgcgcctcgttcatcactgcggtggcgatgagggcaggctcccgctcctcctccacctccctggcgatctccgccagctccttccgacgggcctcgagctccgaggtgtgccggcggtgtgccttgcggcccgccttcaccatggcctccaccgagcgtcgcccctcttcgacacgtgcccatgcagcgtcgagctccgcccgctctgcctgcaggacctccatctgggcacttaacccgtccaacactgtcgtgtt

SEQ ID NO: 766 - DNA, 1274 bp, Oryza sativa
  unsure (1)..(1274): unsure at all n locations
agaggcctcctctcataggaggttgaggtcttctctgtcgatgttgataacattagcaacctcttggggaatcctcacactaagacgctcttgagaagcattccaaacggatcctccatcaccctgcgtttgtcaacgatcacatttgatagatcctggcccctagagcgttcacccgccaacgccatctagtggaggcagagaagaagagaccctcccattgctgtctgcctttatcaactggtttagtcatgtagctagtataatgtggatattttcttctttaagttcatttctaaaatagattattaaacaaatttcattctgaaacaaagatcatcaagcacatattttttttagataatgaaagataagcatcatgcataaaggtgaatagagaaaaagaacacaccctatataaatgcgtaaggtctgctgcgtctgcaattgccactgttcactaagaatttaaataacaaacttatcatttcttacaaaactattcaactttcacgaataatttagcatagcaagttgattttgatctagctagaatatttgcgtgatctagaacaaactgctcttgtgtctagtattttttaaaaaaattaccttaaatctaaatattgtgaaaattgtacttgcaacaagtgtgcctttcttatacttcttttactgctaaagaaatacaggtaaaaaatattcctggtattaattgatagtctctgtgtgtgtttacaagaaattgagttactcgcgacaaggttgtcagtattaggatcttagttaatatagttttgctcaaagtagtatcgtatcgtaggatcgggatactaagagattttctttttttaaaagtttaattaatatttatattaattacatatagccattctatataaaaaatatagtaataatatatgtcatgcaaatagagatatttattaagaaaaaccacattagttttgatatatttaattgatttttatatataaacttgagcatatttcattattttcaaactatcatattttaaataatattttgttggattgtagaattaggatactatataagattacgtaggatcgtgtggtaatgaatagtaggatcgagatactatcaaaattaggatatcgcggtatcgtttcggtttgataaaatcgtagtatcgtaatatactaatatacgaatcaggatactaacaatgactcgcgtactaatgttggacaagnnnnnnnnnnnnnnnnnnnnnnnnnnnnnnnnnnnnnnnn

SEQ ID NO: 767 - DNA, 14184 bp, Oryza sativa
  unsure (1)..(14184): unsure at all n locations
nnnnnnnnnnnnnnnnnnnnnnnnnnnnnnnnnnnnnnatcttatatggtgtctgattcaagttggacggccggatcagattcacaatccatcgctatcgtcggattccgcgagataaactgacataagccagacaaatctggacaaaaaatgtaaaattcagttacagttttttaaaaagcttgaaccaaaagccaagcggtttggcccgatcagcagagtttcgtgcacaaagatggcctttagagttctggattttggtcaggaacgtacattgagcatccattgtgtttcacttggctgaatataaagaaaaagtaacatactcgggatttaggagaacatacgatgttgctctcacaagcatgagcaggaacagaaaaactcacacggcacataacgtctgacacggcgtgagtaggaacagaacgaatcgaataaatggtaaaccacatttagtaaagatgaaaccagtaacagcagatccgatatttgaaaaagaacaggttggtcctagataaagttcaacaccctggtatcatgctagatttagggaaacgactgaaaaaaggtttatcactccggagacaatcaggtgcgagcaacgttgggggcaggagcagcagctccaccaggagcgggagcgccaccacctggacgagggccttggggcctatcctcctgcaaaatagcggcaactagtttagaaacatataatctcacgattaagatcgctccaaaataaatagacttgagaacaaaaaaatatggatcaaaataacaaacaatagagcccatcaataacagcagcctaaacacatcaatcgcaactacaccatgcgctcctcttaatcactttctaggatgagtggacatatttgcagatatcttaatgtggttttgatacataggccagccactttgatactactatactatcacaaacgcatctgaattctggatgcaacaaagagggacacaaacccactagcaagaagctagatactgtaagcattggcacaaaacaatcagcattccataattagaacaggttaacacaaattaaggttgtcttaaagaacaacagactagctagcttacaatctactgaattcgatgaaaattgattacttgatgttagggccattttggattgaggccctaacaaaattttggtagctggcttttttgtaggatatcatacatatcccaacataaatgttacacataaaccatcagccaattgtgaaaatgatgctgtgaatctcaaggacctgtttatcccacaggcaacatgtagtatttgccatcagggaagacatgcagttccaaaaaagaacagtggatttcagattatagaagctggctgaatgagtatacttccttaagtatgccggtacatttgactaaaagctaaatggtaaacttcatagaatcagcacactaaagaattttaatttttcagcgtgcttgaaagatattagaccatatgtgcagataagagatatctacaaatactgtgcaaaatcattacgtctattagtatatcagactttgtttcttaaatctgcagtaacagataaaggaaatcgttccgatcatgatatactaattacactatcaattaagcactagatataatagttaagaggcggggatcaggtaccctgcggcggaaagcgttccgaggcctgcggtcccttcggttcttaccggagcggacacggacgatgtgagcatggattgcacaggacacacagtgatgcaccttggcgtaaagcttggggagaacgtatcctgcaacgagatagttgtattgtatgccatcaattcaacaatatcaagatagaataaaaatttccagcagtatgcaaatcgccagtgtgttatcggcgatcacaaatccaacctctactacgatttcgcatcacatacaaattcagcaaaagaaaccaaaagcgggggagaggaaacgcaccatcgtgcacgcacgcctcctggacgtccctgatggcggcctgctccacgatgttcctcacctgaaacctcttgatcgccttgtcctgtcccgcacccaaagcaaagattcccaaatcaacacagagatccagtgggtgcctcgcgcgcaacgagagagggcaaaaggggattcgcttcgccttaccttggggcagcacttggcgcagttggagcagcggatgtacttgacgtggccgcgaccgtgcttgttgcggccgccattgcggcgcttgaaggtctgcgccgatgcagcaagaagagaggtcagttcagcgctgaatcccgcaaagcaatctaggcgttaagcatagggaagcaaggccttaccatggcggcggatgaagaaagcgacgccggcggcggcggggggttcgagctcagaagcctccaaggtaatctctcctctactagggtttgcgccacgagtggccttttatactagaaccgggagaagcggcaaagcatcctggccgttcgtgtgttggatcgacggtctaagttgtcaggtaggaatatataagggccatggcccacggggttcataagcgaaagcgtatttgccactttccgctttgcaacaccctacacgcttttatatcagagaagggaacagaacagccgacgtaacgtactactacaactacctccgtttgcaaatgcgtagcagatctgtgaacacttttgtcttttgtacaaaagtttggtaaatacttgaatggattttgtattatcaaagtggctcccttcatcctaaatataagcatgcaatatttcttcatcatagtctaaccatttaaaagtctacaagtgaattcatcatttttgtttcgacctacacgctttccaaaatactaaacggtgtgcttttggtgaaactttctatacgaaagttgtttttaaaaatcatataaatccatttttaaaaagaaaaggaacttgtactttaattaatcgtgcgttaatatttcgttctgttttgcatgtcgaagggattagttcccatccccaaccaacaaacgcattgtgcactttactcttcgggtaaataacagacatgaaatcttcatataatagtatgaatgcaaatgtttgtttaattccagccgtggacatgttatgtacagtcgtagcaaaaataggtgccgaatatgtatgtacaagacgcagagcaaggagccttcagaactagctagctggagtgaactggagcaaaatgccgatgaaaattacaccggtttcagaccatatgtcagtcccttgatcccttctgcaggagcgggatgatcatgcgtccaagtctctgtttgacctccacattgggccctcagtcacaacaccatctgcaactttagctgacccgttctgtactaggagaagagtccctgcttcacctcctttcacctgccaggttgataagcaagggtgattaccgatgggtgagaagcaaggaattatagtaagttagtgaaagttctaatatattgacgtgtaatccttttgcacattcacgaaaaagtaagttagtgaaagaaaataacgggtcagctaaagttgcaaggacgagatatgaaaaaaatagctgcaagtcgcaaatgtagcattaaggcttcagaaaagaagtgctatctgataccttagtgtggaaaaatggagctgacaattccggggccttctgtttattctccatcaagcaaaagaaagaatacaggatcattcctaacaaggcaagaagaatccctaatatgttcctccaactaaatgggtcgttaaataaaacatatccaaaaccgaggatgatacaggtttttaagtggcctactacttggtatgttacaggagatgttttcccgatcacaagaaatgtactgaagtttaccgagacagatattagacaggaaagaacgatgaatacctgacaaaaagataacaaacagatatattactgtataatggatagaagacaaataagaaagggaacatcgagccagggaatgctcacaaggatttcactcgtgtacttgaaggcaaatacattctggttagtaagaaaaccatcaagaaatggaccaatgatgaaaagagtcagcgcttggtatggacaagattggtagagcagttgagttgaagagactttgaatttcttctggataaagtttgtcatctagcaaaattggttaagctgtatggggaaggaaatagtgatagcagaagaaggatatgatgttaaatcaatatactacgttggatccacatatttatagctgatacaaaaaaatggagagaaaaaaaacaacgtgtatcagatcagctacttaaatttgagaaacacctactccctccgtcccaaaatgtaagcatttttagctatgaatctggatacatcatagccaaaagttgccatattttgggacggaggtcgtagaaactatcagagtttcagagtatgttaaaagttatcatccactttaggtgcaagagaatgcatatcaaaatagatataagaaactatttatctggtaaattaatatatatttgatatgagctaacaccaaaagccattttttctataatgcatatgtctgattattgatctattaaaaacaaagaatcaagtgtcattattttagtgcaaagaaaataatattgaatgtatactttgtttagaggatacaatttgtgaaatgcacgtggtgagtacagcaaatagagacagcagcgatcccagtctattcagttgcaggtctgtcactgttgcaacacctacaccaaacaaaagaactgccagtgccatttggattctccggctgcatgaagtgaaaatattgttatagtctattcaatttatgatagtactacaagttattgttttatgggagtatgacattaggattgcaagacccacaggtattgaggaattcaaatattcaagtaccatgcttgtattcacaaggataccaacaatcatcatatatttagtagttaatggtttttttcagcgtgaattgacaaggcaaattttttttttttacataagacaaggcaaaatttggatcagacctgaatgttttcctgaacaatatagtctccaaagatacagtgcatggaattattgccagcttggttacctgatgcatttgatagagtgagatagcttagacaaagcagtagactaattacacaagcacagttaggtctgtagacaaagaacatgaattggctgaaactagagactgttgaattgtgtcattccatccccaataaaatcagggcaacatattgtgtgcatgttgattttcagattgggcatgaatcaaggtcaactactaaatttccagcaagaatttaagttttaaagtttccaacaggtgtcgtttgctgaagatgaatatgttcatctcaaaataggaaaaataaacaaatgcaagattggcctgatttctgaagagtaaaccaacctgataaaagccaatagagttgaatccaaggctcagattaagcaacccaatagatatgccatttagtattccaaatccaatgattgtcttggggtctaaatctttgttctcgaaaagcttcatctgaagagccacatgaagggaacaaaatgtcaccaggagatgccagcttgtcagcgtagtagctgaaagaaattaggagagtgctgtgatttttgcatggttatatagcttaggaaacagttagttttctcaggtggtattgttcgtcatattgtactcataaagtagtatagaatttgtgtgccttattaatgaaccgtgtccatcaggcaacttgtgtttcctgaattttcgaaggatgtcatttttgttcaacaaatacatgaataggatagcagtaacgttgtgcaatttccaattgtcccatggagccatgaatttgactcacatatgcagcagagcagagatgttcagaaaatggtcatcaagtctgcactgaggcaattcaaagaacacctagagtgcatacttatctagtcatttgcgttgctctaagctcgtattgccgcagtccaatgtatgcggacagagtgctagatgctagcattaaatagaacaatagtattaggcctcccttggaatggaggaatttaaaggatttttttgcgggaattgaataagatgttcgtagactcgaaatctacttaccaagatctctgcaaagagcaaacagaccagatatgtgcgcggaattttaagcgcaaagtaggcgagcgaggtaggttcaagagggtgatcgatagaaccgaggtaggcgagcgcgaggcggggagatctccggtggaacgaggaccgagggctggggcgaaggcgaccagtcggcgccaccggcggctgaggagcacggcgcagaggagaccggaggctgaggagcgtaatgatatccccggtccccggaacgccatccgggcgggatgctctgcagcgaacacgcggccatgttgctctccggccgccgccgccgccgccggcggcgtggttttgacagggtcctactcctaccgtactagcgaagacagaaggggaagcggactacacaaaaagaccgctatcaataaaacggtcatcataggagtttttttttttcgcgcaaaactcccaatcgccactcaccaatcctaacagcaggcagtgttttgcaaaaaaatggatggacacttcccgtccatttaattttgaatttaaatttaaacatatatatttgtgaaataatatatcacatattatttatatattcttaatatttttttatttttttataaccattcgagtgacacataaactgcagtgtacttgtaggaggtacttgcgtaaactatttgtttcatcttttcgcttatgcttatatttatcagccaaaatttaaattttcaactttaaatttgaagctgattttggtgtatttttatcgaactttatttttcagcatttgcttttagttcgctaagaacatgtatataaaagtttttttttcacaaattactcctcgtttgcaagccgtacaccgccgcctcctgtcttctacgcaggccaaagcattctccgtcactgagcttaatcagaaatcattatcgcaggcgatgcacaagacgggaacaacggggactctgctacgcatcgattaaaggcagtataaaccgctaagatgttcctggcatctcgaacaatggcgtccaacagaaacagactgtacgcgagataactcggataagttcagggctcaccgaacacgaagccgagtgtgctcatgagcgccttgttgcagacgacgatcgacaccgacgacaccaccgacaggcccagcgccgccgccgtgccggccatcctgccgtccaccatcccctcacctgcgcccgtggccaccaccgcgagaaccgagagagggagagaggacgaatgcgacgagaggcagaaatcctcctccctccgtgcggtggtgggtggttgctcgttgtcttgcttaaaatgttggtggatttgttcgggctcaaccaactctggccagacacagatgcctctcggtctcaggcggtgtcagcatttctcgtccagttcttcagaatgcggccaaatccgcactgcagattcatggacttcactggcttgcttattgtcggatgctacgcatatacagtttctactccataatcaaacagtcatttgatcaatcgaaggagtttggtggagtgaacagagctacgtcagtctgttggtcgatcatcgatccatcaaaaagtccatctaacttaacttgaatgcttggcttactgtcaaacgatgcggctaaaaattcaagttcgtctttgatttcaccgtccgccccggcaattttaggcttgaaaaattagcatttggcataaggagagacaagttaacgatttctgatgacggtgacgacctaccagacatgcagattcccgcgccgtgcacaggccaatttagcggatatcgccatcgttgtcatcacaacggccgaactgcaacgacaatttgtcactttggcagctctttagcctactcttgaaacagtcaatgatgaacccatcatacctaaaaaattaatagatgtttgtaacagataaaaaaaactttgttgcccttaattacatactcatttagtactcatgaatccagtattccagtctgcataaagttcttgcgttagccgttaggtcgggtgtgagaccaatcagttgaacagtctacctggtgttttatcagcatacgtgaacagaatagttatacacttatactggatagtcaagccacattttgcaatacaaaacaaacttcatatcaaagaaattttttttttgaagaatactacttcgtactactactttagtattccggattcctaatgggttgaaagtccaggccggaattttgcggtagcatagatatggccagcttttgcttttgagaatacatgctctagtgggccgaatttgtaatggcctgatagttcaagctggaattctgcggtggaatagatatgggcccgttttatttgtttcgtacgtcgaactgaaaacagacaaaggcacaaagctttgtcacaaatcattttcttctcactcatgaatcgttttgaactttgaagaagcaacatataaattctcttgtgaacttttgcctacaaatcatcctgacaatccaacaaaaaatggcgaacaaaaatagccttcaacttcgattaaaatatgcgctcacaaagatttcaaaattatcactcagagactacgtacagtacttaataatgattggtacttgataaggcgacaaaagaaagtataatcaaatcacaaacatatcatatacatagacccataaactagcatagttcatggtcccaaaagcacaagagtgctccggtgctcccccacaaactcctccggcccatgtggcctgattcggggggttacaatgtaacaacaaaagttacaagacaccacctccctgctgttctacaatataatccttaaattgccttgccaaattttaaaccaaggctacaacaatgcagaaaaaaaaaatgcccaactccatgataacttatttatgtctactggacctatgggagaaagcaaaggcctaagcgggtgctaattaataagcagcctcagaatagccaaagcctcttctcttttactatagcaaagaggcctccctcctcctccacctcaatctcaatctcacactgacatttctgcagaaaagtgaactgaaaaacggaattagccgagtactcgatcagaactggccgccctcgaaggtctggccgaactgccagccggccggcacgacgttgttgctggtgacggtgcggccgtcgctgacggcgacctggaaggagaggctctggccgtcgaggtaggagttgctctgccagttctggccccagttgcgggacatgggctgccacccggtgctggaccccttgatcgacacggactgcacgtcgcctgggccggccacgttggtcacaagaaccaggttgaagtaggagtgcccgttgatggtgaacctgatcccgcccttcttcacgcacggcaccctgcaacacaccagcaaaaaaaaaagcaaagttcagtgaaacagtagaattaactgtaatttgttactatttgttgcaacgattaatcatatggatgtgaaatgggatgcgtaaagtaattccgggacagcgaagtcaagtccacgtcggtgtcaagtcgtgcgtgcatggctttgcctacagccgacacggacagatcgtggacaaaccaaatctgccgggtggcccacctacacatggcctgatcagccgattggggatcggcccatcgaagccgacacaccgcacggggggcccatggcttcaagttgcaaacagtttgccactcactcgtgacccattgacccaagtagagctcaccttctgtaggagacgggcacgatgccggcgcggtacacgccgatctggaggaaggccggctcggccatgtcgaagtgggggcgcggcgggttgcaccagccgccgtcgtcgttggggagcgcgtagttcggcgggcacaggttggtggcggtgacggtgacgctgcccggcaggcaccactgcccatcgttgtcgcaccgcagctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaagaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagctaggatcgaatcgatggttgcttggttgtgaagagagcggtgctcccgggctcaggtacttataggcgactcctccttggcagttagaatcgttgatagcttttgcccaacgacagaggagagaaccggaaaaggagacaaaaggcggcgagaggaaggtgagcccaccataaccggccacgagccacgacggcggttaacacatacaaatcagggcgatcagccccgcacatgcaagtgctcgtcgcatcgcctcgtcggacccgcgcgtcacgcacaaggagacaccaactgcccgtgtgtctgcaggaacaagtccagttaatcgcagcaaaagaaaaaaaaacaataaaaatcaccgagcatttttttaaacgagaaatcggcgaactttgatacttgccacatggctcgcagaagctatatgggccacgaatttcgcaggtgtgaagggaccataccgaccatgtgatcatgtagacatatgcttcacgaattcgattacacgccggtacgttatcgtggatggccatgcttcgtggctgcgcgtcgtgggctgtctctcgtgtgattcatgcacgaagtgtacatgcatgacatgacttggcgtgcaggtttatgttttttttacgtgccaggatagacatggtcaaatgcacggactacgcgatacagtttgctcaaatgctctaaagtaaaccactttgtttatgttcttgaactgttgatcaagttgcatgcatggtagattaatgcgagaaacgaaaaagagaccgaatgacaaccaatcgttctaaagtgtgaaccatgttcgtggatgcctctcgcacctttccgacgtagcgcaagattcgaaggttgcattcttcggttaagaacctctcgttcattggataatctccgaaaaatcggagccggtcgatgttgtaagagcaggtacaatagcaggctataaactaactataatacagatctgtagccagctgcagcacggactccaagatgtaatgtgtgtatgacaggtgggaccatgtattaatagtatagtaagcaactattatatgaattagctattacgttagctatagatgatttggagttagcagtggactatactattaaacttgctctaaaaggcataaccgttctcacaattgtaaattgtaatgcgccagcagagtaggctgaagattgaagccactattgcaccatcaggcaaagtgactatccccagatttttctgtcggctatgtaaatcatgtaggactaggagtatacaagaatcaatagtaggactagccgcgagtaactttacttggtaggactaggtaatatagattagtgcagcaattaatctagtgcatacatgcttgatgccaaaattaccagtgcgaactcccaatgataagctcagatactattaggatttaggactaggatatagcctgacgcccatgggtgcttgcaagggttcacaccttcacatggcaatatggcataaacatggccacgtacgtaggcgatcaaaaaaaggtgtataaaaatcgaaatcttcagacaaactgcaggcatgtttgtccaagttcacgttttttgctctgacaaacctgaatgggcattcttcgttcatctcctctgcatatagtactgttctttttcctgtgacatgtggcagagtgacaggtggctgcaataacacgtctctcgctgactcgctccaaacctactctgatcctgattttatcgatgtaacctcgtgcctcctgtaaggatcggcctgcaggaaatgttggttagtggctcaaggaatgggactattggtgcgctcttccaccggtttgcttgggagtatattcatgatctgcacgttgcgaacttgcagtgcatttcttcagttgcttttagtgtagcaccttttctttcgacagtgtcgcgtatcgtgattcctgcttcctttgctggtacacaacagaggtcaaacacgaagttttaatggattcccccaaccaacttcataaagcccttttgaaaattttctttcggagatgcgtcattgttagtttaacagtacaaattacttctatgtcatcgtaattttagtaaattatcactaccatgcaacaggagaagttttatactagcagcacagggcagcagctgatcgctcctagcaggcggaaatgatagcgtgatgaattcggaaccatcgatgtttcaaagatcacgtattggaggacaagaaaacaaaatcgcggttagctttcccgtcataatccgttcctttcaaagagaacatgcgtgccaatctttcaaaaagaagtagtctatcaagtgactaattaaccatccatttcgtgcccccacgccatgttagctgcacatgggcatgggccgcccggacatcacgggcaatctcctactagctaccatgcgttgattcgccttattttgcaagcgtcccgagctttcagctccgagcatcataaggttcacgccacaatttcctttccctgtttacgttggttacttgggctgtaccgacggatatttgagctagccgagcattgagcaagctctgcaatctgccatcactcacgttcgataaagtatgtaggaaccgcgtagagcgtacacgagtcttaaattctaaggcacttctaatttgaaaaggggcttattttcactccagacaatagtacaacaaagactcttttatggcaacttctactgctaactgcggcaggattgtactctatccgtcccgtaataaaaaggattttgaaagaatgtgacacattatagtcttacaattttggacatactctttgtccagtttcgtagtattagaatgtctcatgtccatttaaaatcccttatattatgtaatggagggagtataatctaagtgcgtgattggtttgagaatgaggtgagataatctatattttttatgaatggaatggtttagtcatatgtttgtcatgacagatagaatcgttatattttctttacggagggtgtggctcatttgtcaataagagagaggaggtgggtaggattgattagtccgttagtttctgaggtgtaaaactgacccaaatcttatgggattacgaaccatcccatgatccgatgtcacttattcttaaatcaaacaacttgaaaaatggattcgcctcatctcaatctattccgttctttcaaccaaacacatactaaatctaattacagttgatcataagcatttcatacaatatgcgaatttaccttggttgtgtggtttttggtagaggcggattatgtgaaccacttccatcataaataagttaaaaataccatataatataaattttaaatccaatttttgctcgtcaaaatttttaccaccgacattagcatgtacagtactcccttcgtctataaatgatggtattaacatgcgaagtgtttcttttgtccgtaaatattaggggttctaggttatttaacagtagtatagtattgagctggggtgaaattgtcctataggtttaccagattagtaaagataacgccaactatgcaaataaaattgagcaacaaatgtaatggttggatgaattgg

SEQ ID NO: 768 - DNA, 3604 bp, Oryza sativa
gtctcacattgaaggcattgaactattcacgccatgcgctgaagaggccatgactgtttggaagatggagagagagcgaggagcaagcatgtggtgagtacaccaaaacggaccacaaaatcttgccgtgatggcgactgaagcccagggaactcatctgcaggtcgcacccaaacaaaaagagattcatcatgcacgaatggaacaccacgcctactcgtctgaagagaatctctcgtagcagtagggcgctgcaaaatcttcttcatccatccaaccgcctcgatcatcagagacaccatcatgcatttcgtggttgttacagcactggttaatgacggttggaaggaaggttttctttgccccggtcggtggttgtccatgattgtcgaggagaatcgtgctcttcgctcgcttaaacatctcatcaattgcgttagctagggcacgctcaatcatacgagaaaaaagcaatttgcaagcggttcgctctcatttccaaagaaagggagctagtagtacttaacggtagctaactactcctgtcttacctagacacgaaacggcaagtgcatgtcaagtgggatcctatcatggcgcggtgtgggccgcgcgcgtaacgacggtgggagaggcttgcgttcttcccagttcggaccgttccgttcattattggctcgatagcgcccggcccaaccgaaccgatggcgccgtgcacgcccccccgcctactcatccatccatcccgcgtcgctctctccggcgaaaacctgccctgcgtcgcgcggcgggtggttggatggagcccgcaccgcaccgcgcgtacgtcaccccgcacgcacgcgcgcgatcccggaggatgagacggatggccgcacgcgatgcaccagcggcgcgcgggtcgcggttgcgcgtcctgttgctgctgcctgccatgtgccatgtgcttgcgcccccgcacggcaaagcggcatttccgtcgagtctcgtcgatccgtcatccgtcggctcaggagtcgctgcccgcgggctgttctcgtggtccgtcggcctagaggcatgcaggaggccattcgatcgagcgtgcggcgaggaagctaggtcgcgatcgatcgatcgaccgctcgctgttcacggcgatggaggaacaggatccgactgtactgccgatgtgtgccgatcgacgggataagatgtttgtgtactgcgcgctacattggacgggatcttcaactcgaccggttcggcagacagggtagtacgcttgtggctggttggaccgacggctggatatccgcaaggacgcctgctcacgaggaaccaaattctatcaccggcaacgcctgcacgttgaaatgtcctccccctctctctgtaacgaaacaggatgtttggcacaagatttgacgacggcctcttttttgtgaacttccgatggcttcattaacggcagccacaagtccttcatgtgctaaagtttgttttttagtaggtgtcatggtgtaccttgtgaattcactggaacatgggactatgggagacagccggtgcctgtgtgatggtgcgagagcgaccgtccgcccatcgacaaattttccggagttagcgacgtgaaaggtcaagatggagatcgaacgagaatcatgctctggcccaacaacttatatgggcttcacgctcgtcgcgataccgttccggcctaacctatgtagcccgttcgttccagcccaacaatatgggctcacggtacacgccccttccgggccaaacttttcagcccatatgtccgtcacgaactcacgatcccgttccgacaaaactaatatgggccgttcgtcagaatccgatggaaaaagtacaccgaaggtccctcaacttgtcctcgagttacaaaatcgttccaaccgtaaaaccggatacaacgcgtccctcaactttgcaaactaggtccctcagcggttttgaccccgatttatctgacgtggcggctgagtcgtaggacacatgtgagccccgtacggcaggatgccacgtcaacaaccagcctctcccttcctctcctttcctcccttctctctctcccactcttctctctggattgggcaagccggccggtggtggggaggtcgttgccggggcgaggaggtccgacggccggtccgcgacgtggcggcggcggccgggacgaggacgttcttcttcacgggcatcctcctaaagctcccgacccagcgcaaggtccccgatttgcacgcacgccgagaacgccgcgacggcggcgacggtgtcgatgcacacgccgctatcatccgccatggccgtacaagaaacgacgtctcggccagccggcgtggaatccgtcgaagagcgcccacgcggaggcgagctcgacgcgcgcgaggtagagctcgacgagcccatcgcggacgacgaggcggtggtcgaggccgagcttggccgcgtgtgcgtgcacggccggcgcggcctcgccgtggtcggcgaccaagcccttgataagggccctgaggcaaagcggcggcagtggcgctccggcgagctcctcgccggtgcccttctgcgagctgcggtagttgtactagattaacttcttgcattttttttgcctaattgtgatttgccagtagaatgacactgattttctatggcctcttagttggatgagataagaagagatgagtatgatgagatggcatttgtagcacgagattaatttcttgcatgtttctgctggatgccaaaattgcaagctttgattcccgatttaatggctgcgatggccgtagataaatcccagctggtggatcccttgatgtgtctcgatcgagttccgggaggcagcagcagcagcagcaatgtccggcgccgccaacacgacctcgccggccgccggcgctggcacgccgcggtggacgcggcacaagacgctggtgttgctctccgtgctcccgccgccgccgccggccttcccttttgggtcgccgccgcctcatcgccggccggccgtcggacctccatgccccgacgacctcctccccaccgccggccgtccagagccccacagaggagtgagagagagagaggaggaatggagagaagaggggaaatagagaagaggctgacgtggcatgctaacatgtggggctcacataggttctacgctgattcagccgccacgtaggacaagaccgggatcaaaaccgccaagggatttattgtgaccggttttgattagttaagagacgtgtgatatatggttttgcagattggggacgtttttataactcgatgacaagttcagggaccttcgatgtactttttccgaatccggttctaaccaacttttgtgggccgcaccacgttctgaccaacccacacagctaggcctagcttcctttgctgcaagtgcaagtgcaagactgaaactctgcagggcttgggaattcaggagtggaataagttcacttatagtacctcaacttagcgtcgagttcgaattacatcctcaatatgtaataccaaatataacacatctcttaacttgtaaaaccagtacaaatatagttccaagaggacaagaaaatat

SEQ ID NO: 769 - DNA, 9980 bp, Oryza sativa
  unsure (1)..(9980): unsure at all n locations
attcagccgccacgtaggccaagaccgggatcaaaaccggcaaaggattttattgtgnccgggttttgattagttaagagacgtgtgatatatggttttgcagattgggacgttttttataactcgatgacaagttcagggaccttcgatgtactttttccgaatccggttctaaccaacttttgtgggccgcaccacgttgtgaccaacccacacagataggcctagcttcctttgctgcaagtgcaagtgcaagactgaaactctgcagggcttgggaattcaggagtggaataagttcacttatagtacctcaacttagcgtcgagttcgaattacatcctcaatatgtaataccaaatataacacatctcttaacttgtaaaaccagtacaaatatagttccaagaggacaagaaaatattgtaagcagttttaattgacatggctctgatgtggcactaaagacaaaaaaaaaaagcaaaaaacatatgggccacacatgtcagttaaagtgtgaaaccacagcttctccaatctccacttccccctatctctttccaggagcacacgatcgacgggaaaaggcgacgcggccagtggccggcagggagaagagcggcggagaggagataggcgacaagaacattggtggagaggagtagggtggcattagcaccgatggagaggagctgggcaacgagcttgagcttgctcactcatcggcggaaaggcggcagcgatgagctcagggtgaagacggttgccgtcaacgaccctgccctgctgccgatgccaagcttgtccgcccgcgccttgagctcaccgcactctgcgcggaagcacccgagtcacgtacgcattacttggtgacctcgtcgactagctggatcggcgtccgatgggtcgatctctagcggggagcgatgaatttagggcgaattcagggaagggggatttgggtttaaggtgtttggttgcttggtggaaaggtgggttgtcatggtcgccgtcagcctcatgttcaccgcctccttcttcatgtatggcgggtccagacagtcacaaacgtgtggctggtagctaggcacactggggctgtgatggcacctgggtccatcaccacggtgtaggtcatcgacgccggtagtagcagcaaggtgacgtctaatgcggccacccagtccatcgcaacaacggaacacaatagggcttgctgcttgggaggacgaggcgcttggacagcttgaggccatccaccaccgccaccctgaagtctaacacaacttgtagccttcacatgctcttcggtctctgtctcctactacctctgtttcaggttataagaagttttaactttggttaaagtcaaactgtttcaaatttgactaagtttgtagaaaaaataataacattttcaacccaaaacatttttttatgaaaatatatttaattattgatttaatgaaactaatttggtattataaatattactatatttgtctataaacttagtcaaatttgaagtagtttgactttgatcaaactcaaaacgtcttagagcgagtacaataatccaccgtggactgacgataggaatgccacatcaactgtcgtgattagctggaggagagaggggagagagagaacgtgagccgacgacaaatctatcgccgagctgcacacatctatcgagataagaagcattgatgatggatagctagccaatcaacggagaaagagagaacattacgagagaggggtagattattctaatgcaaagtgaaatagatggacccagcagtatagctagctattgtatacagaggctatactgataactttgatgagttggaaaaaaattaaagcttgctgcttactctattattgactttgctcttataacctaaaacggtggaagtattccacattcctaccttggagtccacgacatacacatgcatgctaacaatgcagagatcgcctaccgatgaagtctgtgctgcctcgatcggtggctcggcctcccgcaactcacctcccgccggcggctcgccttgttcctgtcggccgtctcctgccttccagtgacccaacctgatgagagatgggtgagacggagagagaggaggaagaaatattggcaactgacacgcggggccacactgagttagccgggtgcctaggtgggccatacgtagctaactcgttcaaccaaagccgagctttatactgccctgggatctctggtacatcggttttacgagtttagatacatattatatttggtactagtaaatatgtccgtgtgttgcaacgggatttagtaaaagaggttaaacgtttcgttgctttgttgcactctactatagtatgttttcagttttttcagtgctacaaagcgtctgcaatgggaaagaaacacacactttatagtatcgaaataaaatctttagtggaatatgtttgaattctataaataatttaatatttaaggaaataattattattttgacataaaaccatattaacgttggtcaaatacaatatcatataattaatactttctagataaacattttgttggtttcatttatctaaaaataatctactaactgattaaataattgatcataatttcccagcaattttaaatggcttgaatctgattttggccttggtttagtaagtatttgggacaactggagggaccaaaactgaacttatccatgcggagcgtacatatggcccaattgtgtggcgttagcagcccgagtgggagaagccgtagccgtcctatctgatcgacggtcccgattgatccgaacatatataaaacgtcggcagccctaaccctaatcgtaaatcatttcccctccccccctctttctcaaacgacggcgttggcagcaccactccccttccccctcccccatcggtggcgacactccccctttccccaccggcggggacgttccttctncccctctccttccagtctcgccggcatggcacatgtcagtgagtgctcgacgcagtgcagcgacggcaaagggtacgacagcgacgacgacggcggcgacgaccatccttccccttcctctctccccgtcagcctcaatggcggggctacgagcctacggcgcggagacctcggcgatggccatccacctctctttctctcctctgtctccaagcaagaggagagcgtcggagggcggggcaccgggtagagggagggggtgccagcgcgggttgggatgtgccgagtgtggccatgcccagcgggcaaggccacgacaggagcgcggtcggcggcgatggcgacgagctcggaacaaccggatttgacggcaagcttgctcatctgtgtgatttttttcctctctttttcccctttttttaggtttctcgatttgtgtaattgtccgattggatgattattttagattctccgtgaagaacaaaaaattcgcccttttttttatcacgaacggaggtttttttctccgcgtcattgatgactcagactttcctttctttttctttttatatgttttttcgcctttttatatgttttatcacgaacgatggaaaaatctttaattttttaagtagtactcatgtatgtgctaatgagtgctaatgaggtttatcgttacttgccttaaaaatctgtttttaaaactaccgatcgaacttaagcctgagtcggacttcttttgaattttttttattacggacgagaagtcctttttttcaagggagtcggaagttttttttataataggagtcagaatttttttttcgacagaagtctttttctcgctgttttttttctacgtgtttttctttacggtcatacggacgacggaaacaagttttactttttaagtagagatatatatataagtagaagtagaagtagaagtagattgtggtttaagagactcgacgtcaagttgaaggacctggagtgaacttattctttcatgagtccatggcatggatctgtgctacatcgaaattgctcacagagcccttttatagttttatctccgggctcgtctagttctttcctcaaaagttaacagctgtagcatcaacctgtgaaattgtgcatgtgaaagttcattccatttccatgtcggtaacttcatgtacatgttggtgtacatgcttttaccttcatcaccaccggtccacggcaccatggcataagttcataacagctgcttgttgctacgtttggcagttcgcatacatgtttattgaattatagggcttcttcactttactataaataaaaacctactaaactttggcaatgttaaattttgataaggtaaggtgaagatatgtagtatttagtttaataccttattaaatgttgagactagttttgtccctttttttttttgataggttggcgttgagaccctgccacgtcggcgaggggattgtcctcggctccatgtgggcaagggatcaacgccaacgtagctggcgttggtatgtacaaccttagggccagtgtccctggcgttgaactgatggtctttttttggttgaaatttttttacacggtcaagttttgaaataagttttgagaaagtctaatttgttaaaaaaatttgtagactataaagttttagaattataaaaaatggtaaggttgtgttatcgtggtggtatcatcgaaatttggaatggctgagaatggtaaggaagtgcactgattaaactgcattgatcttgtggtgaccagtcggttcgacttaccgtcggtaaccgcgcggttatcatggttatcgggcttaccgcgggggtacggtaatataaataccgcggtaacctctttaaattcaaataaatttaaaaaataatttgaatttttgataaattttacacagttttgtacggttttttgcggttaccgcgcggtaaccgtgcttaccgccggggcacggtaaccctagccccaacggtttgggaaaccctgttgaccaccggagaaatctggtgagcaaaaaaaggagaggaaaaatttacagcaggtccccgaatagccgcgcgctattctgaaatgaatgacggtgcagagacatcagtggaaaatgtagcgagtagttcgcgtgcacttaattttcacctgccaacaaacttcttctatccactgccatgaacagctaccacgtaatcaacaacagtcggcacgcaccatacaggcatgcacacactattggccattttctttcccctgttgatcgcaacaagaacttgcttcatacagcgcatgtacgagacgcgatgttgcaatgttgcatgcatacgatcgagacgtacgcagtaaataaaaggcgagagctagctagctagccggctatcgcattgacgcctcctgctgctggcctcacagaccggggcagcagcggctgtaaatgtaatcagatggctctcacatggccgctgctcgtatagcttcataaattcgtccttgccacctacacaagcagagccagcaaccccgtcgtcagaagtgttggcagatctaaatctgtaaggaagcagcatctgatgaacccgatcgaccagcatctagctcatctagctccgccatttacgctcgatcgcagaggtgcaatggctttaggcaggccacgtccggggcaagtcattaaatcagaggtactccatggctccatgcaacagtcacgcgttacggactcgctgtcgcctgtcggtgaacgaacctgtgcaattctgcgtcatattggacggtctcgaattattggccgaacaatctggagtctgcaggactatacgtcggtccatgcagaatttgttcgtcgatctgattattgtagcaaaaaaccgagctagacacacgataggattaggatatacatcgacacccatagtctcttgcaacacgtcggatctcaattagtatctgcactaaccatattgatctaacaaaacatgattatagtgtaagatcaatgtgtgttttgattcttattctgtgatgaacaattgacatatgtgattatcggttttgatatttggagattatcgtcgaagtggttttggagataatcaattttcaggagatgaatagggtttactgatttgtcgggaccggtcagaccgggcggttgttgccggtcagacaggagctatgtgagcggtcagaccggcttgcccgcggtctgaccggccgacgctgtgtcggtttcggtttcgggttgtttctttggatatccgtgattgtttcatggttatggcttatagatggatactatacgtatataatactgttgtttgctacgaatgagttaagttggagatagcttggtctcgaaatatggtttctttgtttgtttcatgtataggtgactcgatgcctcgggagagtatttgcggtgatggaccgggagtcggcttagtggtaagacgatatccgtggtggttagatatcatacgagatactaagactagagttgatgcacgtggttggtgaagattccatatggcatacgatggaggtattgtgtgcgtatgggatgcggagtcgaatttggaaggagtccaaatttggtacgattggttatgttgagtttctttcttgtactagagggtttcgtaaggtgtttaggactcttagtatgagtttggttcgtggctttaggctgcctacctcatgtataaatagagggggagcgtgaggctttccggtatcgcttttttatcgcttttcaaagcgtggagttgatagtttagttagggtttcgagtttagtcaagatttttgtaaggaatgctgttgttgcactttgtaaacacagagagaagcaataaagttgtcatctactttgagagttcttcgatttgtgtttcaccaggtttcggcggtctaaccggcatctcaccggcggtcagaccggcgacctactggcggtcagaccggctaaggcgaggcggtcagaccggcggcggcgacaggagctggcgattgatctcggcggttcgaccggtgttacaacctcggtcagaccgacgatatccaggcggtcagaccggcgctactacttcggtcagaccgcgatccatcgatttcgaggataacttttattttcgctaaattttttttgtttttgggtataccaaccattcactcctctctggttggtttagttcttgtgatttaatcttacatatagtgagttctcgcttgctgtttttgcttctcttccttttgctggagcttattggtttcttagccagcgtttctagtttctctttcttttcctgttcccgaatcccgggcgatggttgtccggctgccgtgtcgtgtaaaaacttgcttttgcttattctaatagaatgacgtgtaattccttgtcacattcataaaaaaaatgaattaatcatcgcttcaccgtcaaaagttgtatggttaatcctaccgaattgtcaaatcgagcatggcatacgttaaaaagctcaaacagcaagtgcatcttgcagactacaccatcacagagtccagaattatcagaacgatcaaacgtctggtaaaaatgcatcccccaaaaaaccctcctcctatttcagtcaaattctgaccacacacacggccatctgctaccagctcgcgttcttaactcctcccctaaatgcactcaacaaccttagtaaatccaagctaagcttcctccgctatataaacacccccaggaagccccattccatccacacgtttcagctgtctttcagtgttcacgtaggttgtagagagcacaacaacgtacgtacacagcagcaaagactgagactagctagcttagctgacatggctccaaggtgcgcgacgctggcggtggtggtggtgctggtggcggccgtggtggcgccgccgacggcggtgcgcgcggctatctcgtgctcggcggtgtacaacacgctgatgccgtgcctgccgtacgtgcaggcggggggcacggtgcccagggcgtgctgcggcggcattcagagcctgctcgccgccgccaacaacacccccgatcgccgcaccatctgcggctgcctcaagaacgtcgccaacggcgcctccgggggcccctacatcacccgcgccgccgcgctcccctccaagtgcaacgtctccctcccttacaagatcagcaccagcgtcaactgcaacgcgtacgtgcacgcataaacactctcatactctcattaaacgaagtagaaaatttttacagacaaatttaatttctttctttgtgcaggataaactagggcggccggcctgatgcgtacgtgtgtgcccgcgcctcccgtacgagaggagaataaaatgtcattagtaccatcaaattaagctagctagttaagctttacgaaaatcgatccctttcttcctctgtggtgtttagcagtttagggatcgtatgtctccacagttcctactatagtgtcgcttgggcgatggtggagctatattgtgcactttataaggtggtgttattatgtaacgcctgtgctagctttggtcctgatgttctccatgtgaactgtgtcaaccgtccattgttctgcaaatctgcagtatgtactgtgtgtgatagtatcaagctgaacttctgaacatgcatatgaaccctcttcacatgcacgggaaaagacattccgaacgccatcatttagcaataccacgctcttatcactcgatcattgttacggattatctagttgattgtaagggtgaatattataaaaaataaacttaaaaaaacagcttaacacaagttgtttaaagtaatttaagtagaataaagtccttcgagaaaatatattttcagaaaatggaacaaataatccgttcatcaataactagcctactatggtaatgagatcctattattttccatcggtgtgtgttttatagcctgtgcacatatattttatatatgtattttataatatttgtgcaaaatcattaaacctatatacagtgaaaaccattatgaaattattctaaaaacctaggcgatcatggccgcctggttggaaggaatgtgggtacatatccttgtaatgatttcttcctcaaacacgttcttttgaaacaactaaaatatagtgcaatgttttccattgatatagtaggaaaaatatcaagtctatatatagctctaaggctatagccatgaaaaaaaaatacacacataaccatacattttgagtgcatcatgaatagcttacccaaggatgaggatattatttataaacaatgtttactatagatgtatatatacatatatcgaaaaattatatgcaccaccttatctcttcccctgcttattctctaggtcttttcttttccttctgtctttctttccagtatagcaaaattatatgcaccaccttatcttttcccctgcttattctctaggtcttttcttttccttctgtctttctttccagtatagcttcatgcaattctggaatcctcttgaaatttcccatccatctaattcaatggttaagattgattgaccctcttttgtctcccagtgaatccgacggctaatatttttcagatgatgtggttaatcctcgtgtttcacttttcgttagttaaagagatatggcgaacaaattcgagagcgttttccttgtggcttttgtaggtgaactatctatatatttttcaataaattttctcataaagtggaggttggggggggggggtagaatactcccactcgtgcatgccttgtgattttttcccttagccgtttgcatgaattttgagtaaatctaactattcaaaattatatgaaagttacatacaagttacaatataattacactataattatattgtatttaattttgatttttgggagaaaatttatnnnnnnnnnnnnnnnnnnnnnnnnnnnnnnnnnnnnnnnnnnnnnnnnnnnnnnn

SEQ ID NO: 770 - DNA, 4682 bp, Oryza sativa
gtacttgctgccaggcctcctagtgttaccgtgtcagcaccggatattttcactttacccttcggtggaggtaaacagccaagatggccccggtccaccgcaaatatctttcacaccgtccgtcactctagccagccagcgagcatcagtttggcagaaatcactgatcaggtgtctagctgtcgcgctgaccaaaagaaaatgcaaagtttacagaagaagtccacggtaagtgttgtggtcatggcaaatgttcagcggaaaaactgccacgctggcatcgttagttgtcagttgtcacagccaaatggtcatatgttcctggcgttaatttatccttacgattttgttcaattaatcccatctaatatttttttcatgggaaatggccaaacaaggcctaagtaaattttgaaaaactatggttgtttagttcaaactatcactaatcactttgctacaattttaattgggtatttcacaaaattataacaataacaaatgattttattagaaaactataactacattctctatgtgtatggcgtgtaaggccaacttaaaacgatgtgagtattacatatttggatgatatgtgggctcaaatttatgagacaaataaagtcgcagctttattaaagaactcccatgttacactattgttgcggttctctgaaatgatgagttaaacttgtagcaaactacatttttgacaaattagttacaactttctaaaattaactccccttaatttccttgtatcttataaaccacttacatattttcttttacttacggccataacaacagcttgaggtagctctttttttttaaaaaaaaaaacaagaagaaatacaaccaagcagagcgagggtgtacatataattttttttatttcaaaaacactgtacacaagcagggctattcacatgcacaccctactcttataagcatcatcgagagactgaccagcatatattaagtgtcaagtctaagacttttataattacgagcataacgtgtcaagtttagaactttcgtaaatacaagcatcaacatgttaagtttatgatttaaattctggtgaacatattccattataaataacataacaagttaagctacgctaactttgaagttaaaccagtaatacgatgtagtggagtcacttataatataagccttaaggtccaattcacttaaagattcgtgcataactcagcctccgatcctatccacctccggtgcgttcttttgttatccaatgagccgttgggataagagttctaaagttagacgccatgaccaacatcatcaacggcacccctatagaaggaagccacggctgaagatgggggagaagaagatttgtcgccaaaccggcaatccatataggcactagagaggtggtgcgaatgtttgtgcagggatggacgtgggcggcaactaaagctagctactgtgatgattccatcaatgctagtactacagaaaccgacattttgtagcgtgttagtggcaagatttgattatgattacgtgaaaagaaaatttgattatggtgaatgacgctgtccatatacatcctaatcttttgtcccatacatttgccacttgaagagtactatagaggataaggagctcggatttgttctgatcccgtacagatcttaagacctgatactctgcgatcaagggaagatgcatctcaaattgatgaaattaacacgaaattggtggttggattagagttgatagatggataggaaaaaaaagctcatattgctgatgcgtgctctagcttcccgattagcttgaacgttaacataaaatcccggataatccagtgcctagctcatcgggattgtttacttgcctcttgatgacgagcaattccagctcttcaatgatctggtcaataggagtagttgttaaggattgctgatgccatgtcacaaaatccacgtaaaaccagctgcgatatgggagtaaaaaaaatgcaaatcctaaagcgatctatgcctgggtcagaggaggcaaagtggacatgtctaaccgttcgtgcaacaatgacagtagcaacaacagctggggatcgtcgaaccgtccgtgcacggatgactttttaactttgaaattttaaatccctaacaatacgacgcgtacatctggacgagccggtggtgaattagttggatttgtagttctgcatatgacaaaggttgctgatcttgccactggcttaaatattatattgcttaatgacttcgtgtcttggtgcatatgtattttgtaattaagctgggacaagaacccacgtttctgcatgaggcttttgtgatgtttaattggggtttaggtaaacgctggaacggccgaaatggatcctctgtatagcgggggtaaacggtaactttgaagttcaatttatggcccagttcaagctagcgcaacaaaagtaataacctctgtttcctttcttttcgattacactgaacacacagcacacatatatgcgcgtgtacacacacttctacacgtacttaaatggacaaagaccggcaataaatccctagcctcactaaaatattatcaagtgtgcatatgtatgtaatatctgtagtaccataattcaaacccttcgtaggtaaagtaaggagcagatcctctaacataattcaaactaaacataactgaacatgcaattaagtcactgatatgtaaatcccactttattataactcaattgtacaatagttaagtcaaaagaacccattacaggtaaagtaatacatatacaactcgctagcggtctggtggccgtcgtctagggcctgtttaccttagcatttttgtaccggcttcgactctctggttctcctagtctcttgtcagttgtggaaggagcatgacttcaaagttttcgactcggcacttttctcggtctccgtggttctagagtccatcctctcggagggtcgcatgtggtcttccgctagtgttgctacttttctagattttttggggatgtagtgtggctccgcctccaccctcccgtagctttgagtagcttttatccgtagtagtttacctttcttttacctagttgcggttcgtgttttttcgttttcttccttcccttggcataggtttgtgagcttgtctggccgattgcattgtgtaacaaaaactcttttccttctaatatattgtcatgctattcttttgtgcgcgcgaaataaaaaatatgtttaaaaacaaaattgcaattggtagtttcatggggcatataagtgttgttgttcagtccaactatttgttgtcctaattagacatagctatgataaccatctgtagctagtaccacagagaatcaagctgtaagaactgccgtttttttgcacgggtgcttttgtgttgtttatccagggattagatgagcactacaagtctacaacaagctgcatgcttaacgccttagttaacatctcattctgtattagtgctttaattcgggactgtgacagtcggatttaattaggagataaggttttgagctggccttgtccgatctctgcctgcagaaaagtgcccagcctatacacacgatctgtcaccggcatactgattttatggttaaagggggaacttttcttattagtggatctttatgggggccaaacatattagattagacgaattaatttggctgcggatctcattagtgtcatgatccgatacactgatgcatgcgcactactatctaaacctagctagcatctaaccttcgacaaaacgaacccagcgattgattgttacttcccaaaaggccaaaacgaagctagctaattaactgcggcgagcggagtcctggtaagcatgcacgttgcctctctgataagtggaatggtcgaaagaccaggctaggactctagaactcacctgttccttcttttttttttttgcatatctttcaccctcaaaatgaataaaggctaatgcacgctcgcgcagttgcaaaagtaagttgcctgagatattgatgttgttttgaaaaagaaatactagtaaactgctctttcttttgtgctgtcttgatatcgatatgatctgcttataactgaacctttaacctttttaacaaatattgaggcttttgtcggaaaaggagaacacttctagtagcttcaaagcactcatcgcagcatctgctggccttcttccctcccaaccccccaaaaaagagagagttactaagtaacaaattgaactgtactttatataagctaatcatatctggctctccctaaaacttgtcctgtccgaccgacaagaagatcatgccccatactagagaggtataaccactggaatgaatccttgggctcctgtatacatctccaagcttgcaaacgtgacagcctaccagctgcaccgcaaatgccgtgtactgctttctgcctcctctaagcctacctgctccaaggtaggcacacgccgagtctcgtttcatctccatctccatccgcgcgcgcgcgcgtggcggcgtgggccgtccatccatccatttgcaagtggcaacgcacctgccgcccacccgcacagtcagcaaccgcgtggccgtcgcgagccgctgccaactggcaaagcgccaaagcgggggcaaagatatttgtcacgcg

SEQ ID NO: 771 - DNA, 1860 bp, Oryza sativa
ccccgcttcccccagccgctgtgggcccagtgtaacatacccatgtaaaaaatctcctttcttgttttggacctatgtaaaaaaatctctccttgggccaggccatggcccatggccgtgagatattttccgacgttggtgctgtgagaggatgacgggtgggcccgctcgtctgttcagtttgtaggttactcacagtagtccaccgtccattcgatttcgatcttggctagcaagggcagttgttgtggaggttaggaggtacaggacgcttacagttacgtacaggcttgtaatattaccgtataagtagtatcattttgcgaggaaataccgtatatttgttggtacaagcgggatcatatgcacacaagtttaatttgatgcttgcaccgagcgggaactgctaatagatacacggaaacagctaaaataacataaacgctcagggaaccgacgaggctttgtcgggcagtggcttcgctcctggattttctagaatcatatcacattgcctttttatgaaagatccagcattatcggcgttatattatatgcaaaatgaaaagtgtacaagtccattgctggttgagttattcagtgatctgttcgagagttgatgtgatggtaacacatgatgttgtcatatcaaaatactagtaacagttagaagcgtattaggctgtgttcggatagaagggatgggaactaatccctcccgcacaaaaaacatagcgatccattagcacgttattaagtaagtattagtatttttttaaaaaaatggattaatttgattttttaagcaactttcgtatataaactttttttaaaaaaatacaccgtttagtagtttgaaaagcgtgcgcgtggaaaacgaggaagaggagttgggaacatggggttgcaaacttgctggtgatggaatgtgtttgtccatccgaatttaagtaatagatttaacatgtttacgataatttattttttaaatggtactagaatgatgtttccatcaacaactagacgcctatgataactctgtcaatatcaagatttaatttttagatgtgctaatagggataaggtaagtggtgagtatgctagcgtttattgtacaggtaggatgaggggtgaatgtacgagcatttatataagcacctatactatgtagacctaaaagcaaggtaactatggtaacttcaagattcgtgaatctcaactttttggatgtgtatacgagtacttgtattgtattttgaaaaaaaaaaggttgtatgcagtactatgggcttgttcattttgctaccattttcatcattaccaaattttgatacatttaccaaaaaagtgactacatttagtttgatgctaaattttagtaactatataagaaatcctaccaaaattttggcaactataccaaaattttggcaatgccaaaaatttggtaaggttgaaaatggcatcaaagggcctattcactttgataccattttcaacattaccaaattttggtaaagttaccaaaaaagtggctacatttagtttgctgtcaaattttggtgactatataagaaatcctgccaaaattttggcaagtatgccaaattttggtaaggtttttttttttatcaaagtgaacaggccccaagactggggtgagtgcagtattctcacgatatgtggaccccatagattcttggatgtacatatcagtactacacgtgtagagagttgtataaacatgatacacattcctcttatgtttacttggattttttgtttaccgctttacatttagagaaaaaaaaaacttggtagtacttcataatctctagatcatattttctctttcaggtc

SEQ ID NO: 772 - DNA, 7260 bp, Oryza sativa
ccctctcctccccgagctcctcgttacctctcccgtgttcctcgcgcgagcccgcgcttcgatgctttccggcgagctccggctgcacgccgccgttgccgtagccaccgccgcgctgcgccgcttacaccaccggcttcgccatgcctcgccgcacattcgccaccgctccatttgcacaaacctccgccgaaactccccttccaccatgcacccgagtcgcatgtcgtcgccgcctgagccgatcccgcgccctgccaccaccgcagccggcttcgccgccgcgcgggcaagcccggccaccgatccctttttcccctccaccacctgaaccacctccccgccataccaccctaccggccgcctttttccgcctccgatcgccgttcgccttcaccccggctgccgctgcgacgcatcggctgcatcgccggcttcgccgcgtcccgctcttccccatccgccgcccggtcgccgcctttcgccgctgggagcccctcctccttgtcgacctgtggagcgccgccgccttccctccgccggcttctctcgccgtcgccgtgcccctcggtgagctccaccacctccctctccctcaattggccccgtttcctctcgccgcttcccgcgctgcgcgccggcggctccttgcgacgcccggcctgtgtgccgccgtcgctttggtcccggccgccgccgccgccagctttgtgtgcgcgctggccaggccgcgccgcccgcccgtccccagccgtccgatcggccttggccgatctagaccgtcgggtgcgcgcccgcgtggccgatcgccaccgtggactcggtccacggtgggccgtgccgctgacgtgtggggcctgccccctttgtggacgtggtccgcgcctcaccccttgctgacgtcagcgatgaccatttcctttgtaaaaataaataataattgcgcaataaatcgagtttaattctagaaattcatttaaatggcttaaaacttctaaaattcatacctaattcattcgaactccgaattgagccattccacttgcaaaattcatctaaaattgagctctacatgtttgtttagtttttatgtactgttttcttggtttttattagagttttttctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcaactgaatggtgggctgtgggtgcatggttttgttggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaggctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgatcagattcaccgtgattagtctcatcttaataaatcgacccaatacactgtagtttaggtgggttggttgggcctgttcaacgtggtgtagcgttgatcaatggagatttaatgttactttaattactcaacagttttactgttttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaagacttagaccccagttgagttttgcctgtggagtggagctgaagccccgctaggatcattttttttttccgctgctactgcttttgtttcggtgtgaggactaagtgcctcttctgtaagtattttacgcttattttacgtttggaactgtatattacttgtcgttttgtgtaccctggctggttctggacagggatttaatacgcaaaatagtctgaaaatttgggttaaatttttgagcgtgacaatgcctccctcaaaaaatcgatccactacgctaaccaatgtagcaggtgtaggtgagctctagcctctcggcatggaggatgtcattcgcgccatatccctgttgtcctctacttaccaagtgcgtcgcatggactccacaccttgaggccgtcgtcgctgccatcctaaaccaatgtccgggaggatcccagaagcgatctgcttggtgggaaaagcatggagaagacatcgaacgagccattgttgagggagcccgtgcaggggtccgatggccaactacgcatccaaccttgagcttctagcgtcattgggaaagaagagggaaagagagatgatgccacctacatcatttttattttctgagagccatatagggcctatatgattttgattttttttgtttatttatttttctttgattgaagtgttatgtaagcatcacatcagatgatcaagtctccgtgtcatgtaggcgttatttacacgtcacataggacaaaaccaacgttcatatcgttcagggagataaaacgaaatgattttgtcgggaggggccaagtcagacttgaggaaaagcaaaatagacttttccacccaagaattatcacgaagcaaagcaacgagggaatacatatgggcttggcccgtcaatgtcttgcgtgccctgtaaaaactgaaacagattactccgtactcttttggcccagagaagatcgatttctctacttatgatgagcttaacagcgaggccttacgtaacttggatccagcagtccagcacaaacttgatggcccatggaaacgtatcgcagtaagaaaaccacaacacaaaagctggccgagccacaagattcgagctacattttaataaccggcgctggttttggcgaggaataagtacacttgtggtcccttaacttgtcaacgaattcgattttcgtccttcaaccagaaaaccagatacaacacgtccctcaactattaaaaccagtgcaaataaggtccctcagcggtttggatggcggttttggctgacgtggcgcctacatagctaattcgactcagtctacatctgacatggcattgagtggcgcttacgtggcaattcgatccagaaaaataataaaccccatgggatccacatgtcagtttaacacacaaataaataaataatgatggggcccacgtgggcccccacatgtcattctcacctctttttcctcctttcttcacatctcccatgtcttcgtctctctcccctctcctctctcaggcgcgacggagagggagcggcactagccggcgccgcggggagaggagggagcggagcggcgcacgccctccgccataacccgcctcaaccaccgttgtcatcctccagcacccgcacgccctccgccgcaacccgttttccatcctccccctcctcgcccattccctctccaacctccgcctcctcccttcctctggccccctcatctcgagacggggagccccgtcctcctgctcttcccttcgccggacgccatcaacctcgcttcctggtgccgatccacgcctccgcctgcgcgagccaacccgacgctgctaacctcgcttcctggtgccgatgcacgctgctagcctcccgttcctgtccttcttcgtcatcctcgttgttagagtatatggtagttagagtcatattaggataggattgatttgtgtggactccttccatatatgtaatccttccttatctcctcccatgtactcctatatataccggccccctgaggctcaatacaatgtgtccaatattcgcagtatcctctttccctatactatccaacatggtatcagagcgggcgatctagcgccgctctcacgcttccgccgacgccgctcccgggggcggccacccgtttttttcttttttcttccttgtcgctgtcgtcgtcgtcgtcttggagagatcgatcttcacgattgttcttcgtcgagtctagtcgtcgtcaagcagcagcaacagattgcatctcctctgccgacctccgtgcgcggcactcttgtatcgccgtcaggccgcccgtcgtcggcttcatctttagcgtccgttctgctccgccggcctcaccgacgggccctgccgtcgtcgtcgcctccactggccaacgatcgagccccgatggacagacggacgacgcagctcggctgctccacctccggcaccggtctccccctgcaacccccgactcctctgtctccagcaccaccgtcgactggggggacgagctcccggcgctgcttctccgccgccggtcctcgcctaccacctcgcatgtcctgctgagaccatcctccaccggctcaccggacgtccgccgctcgggaccactaggatctgaggccgccagtgccggcgccggcgctcgccggccactaggtcccctccacccggcgccaccccgtcccctcctggagggtcgcggctctcgccgtctcctcgccggctgagtcatcgtcgaccttttctgtctgcctcgccatcaatctgttgcttcatgtctcacttttctatctgtctacgcgtgtgtggatggataggattggggacagggaaaggcattggatggaccggtcaaaggattgctacttgatgactttggtccctgctgtggtgcacaaggtggtgtggacttggcctatggaccatgtgtgagaggatgagctgcacgtgtgagcttgctactgatgctgttctgctgctacatgtatccttgtttttttccccttttcaaaaaacgggtttgcgtcgcccaccgcctcgtcaacatccacgtgtctccgacatcggtgttgactctgcttcaacttcatcgttccgcctcgcgcatattcagcttgatcacccgttcaagcgcccggctacaacgacttatgcaaccgatcatcatcgagcatgcgtctacaccatcaagctttggggtgccgctgcgttcgctcccctcgggccgcagtgccgctgcctgtggtccacacctccactggttgttgcagtgctaagaggcaccctcctcagcatttctacatcaccggtggacttcttgccgctgcatcgacatggagctgcagctgtgctgtcctctcggaccgcagcttcgccgctttcgtcgtcttcatcgccgttcgcacatcaacaacctcgtcgtccgcactggtcatcgtcagccgctcagggtcttcttcctcgacttcgagcattgccaccgcatctccaagctgccactgtcgccactctaggccggtggtgcagctacctctacatggctaccaacatcgccatccaggccgttggtctcactactaggccttcgtcttcgtccagcatgattcatcgccagtgtcgccgtatctccctcgactacatttcgctcttctccggcaactgcgcgctgctccggcaattctccctctacgctgttctcgcgtcgcgaccgtcttggaggccttctctgctagtctcctgcaacattggcatatgattcatggtggtcccctgtcgcccgcgcggtattggcaacaccggcgcgcggattcgtcccgagttgtcccggggtctggcaaaccctatgtgacgtctcgtccttcacggttcgactacatcggctcttcggcgtcatcttcctcacgactgccgcgattgtgtcaccatcttcgtctccagtgcatcctcgtgcaccttggtccacgacgcccctcccgtgcgtccacgaccactctacggcgcctcatgcgctccctgcggctcggctacctcgacatcagcttcctgacttcgactacatcgaccacagctactctacgcacagcttcatcgaccacagctccctcgcacccttcgctttggctacatcgactacggcacaaagggttatcatccgtattgagtactcttgttggtttcttcttcagtccaagtgtccgcgctgctcacgcttggactgcggagggatgttagagtatatggtagttagagtcatattaggataggattgatttgtgtggactccttccatatctgtaatccttccttatctcctcccaagtactcctatatataccggcccctgaggctcaatacaagtgatccacgttacgcaatattcctctccctatactatccaacactcgtgtcgctgcctgtctactgcgacgtcatcggcggtggtggccgccgcggctggacgtggtggtctacgcctgcgcctgcagccggtggcgggacgccgcggtctccatcgtgcagccgccgcttgagtgcgagcggaccatgttcccctcatcgcttaagcaggtgaggcaccgcccgacctatcctatcatttcaccgcccgtcttgatctgggtcactttttgagggactttgctcgttcatccttgtgcagctggagatgatttttttttctttccgcgggagaaaaatctggatgctcgatttgcagctgttcattgaggaaatgtttttgatttgatttgattcagaaagtgggattttcttttttgttgctgcatctgtctggatgtattaaaagttgaatatatttgttccgctcccgacatcgtcgaatgctttgccacctcttcaacctcattgggttccctgccgtcctctgcct

SEQ ID NO: 773 - DNA, 24324 bp, Oryza sativa
  unsure (1)..(24324): unsure at all n locations
nnnnnnnnnnnnnnnnnnnnnnnnnnnnnnnnnnnnnnnnnnnnnnnnnnnnnnnaaacgactccccccaagtcccaactccacttgatattcgccgtttgcgaaatttagtggtcgtctgatcagccggtcaattcttcgattctcctatgtgcaagggaagagaatactacccgcccgtagcttcaaatgtactaggctgcttgttatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggaatcgtggaaaacttgctgtaaattactagattattagtactattagttaatgattacacgagtaggccagccatttgaacacctgtaatgcagagtgtccgagtagtgaggcgatcacctaatccgagttccagttcaaagttttcgtctgattttctttttgacagttaggttttgctgcctgctgaacccaaaggaccagggtttgaaccttggacaagtttggtcgatctgtgcgtgtttatcttacatcttatcatcaaagtactaccactattttgtttgtggctgtggtcttctgttctggttcagtatctattactgctaatttacatatgtgaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataacaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggcatataaggaatcagactaattttcaatagtatataagaaattctctcttttcgattccttggttgatacaaggccacgaccgcgaaacaatcagacacaatagaatgcaaaatggatgtaagaaaaaaaatgaacttgtggtagtggttctcctataccaagtagaaacataaatgagagcaacaagacgtgtactgtatgatagaacgagagaaagtgaccctattggaatgttactggaggtctggagcacggacgaaaacgatcgtggcaatcaaagttaccttacgggaattttccaaggcataagccacagaggtagtagtaaatactactcccccgtagaaggaatgattcaacgggggtggcgagccatgaaatcagttagcgagcactcccccttctctttagttttaactatctatattagttaatatacttaacattaatgatagtaattagacaagattctgacgatttttttgggagatttttttactaatagattaaaaaaaatttaagttagatttgaaaactttcgatttaagttttaaattttaaagtcaaatttaaaaaactttcaactcagatttgaaaactttcaacccagatttaaaaactttcaactcagatttgaaaactttcaacccgagatttgaaaactttcaacttagaatcgaaactttcaactcgagaatcgagattcgaaaactttcaagtccagatttgaaaaatttgaaaactttcaatttgagattcgaaaactttcaaatcaagattcgaaaactttcaaatcgagattcgaaaactttcaaatcaagatttgaaaaaaaataaaaaattttaaatctgaacttaaaagtttttaaatcgtcaagttcaaatttgaaaattttcaactcaaaatttaaaaactttcaaactcaaaatatgctaaaagattaaaaaaataatcagaaaaaagtgtgaaaaaaaacgaaaaaatcggaaaaaaaagaaaaaaaaaaggtaagaggacgcgcgcgcgcattagcttttccgaataggggggtggctagcacgcgcgtgcgcgccaggaaagcagttggcgagcacttccccttctctttagtcttaactacttatattagttaatatacttaacactaatggtagtaattagaaaagattctgtctatttttttgggagatttttttacttacagaataaaaaaaattaagttagatttgaaaactttcgatttaagttttaaaatttaaaaactttcaactcagatttgaaaactttcaacccagatttgaaaactttcaacttaagatttgaaaactttcaactcagaatcgaaattttcaactcaagaatcgagattcaaaaactttcaagtccatatttgaaaattttgaaaactttcaatatgagatttgaaaactttcaactcaagattcgaaaactttcaaatcgagattcgaaaacttttaaatcaagatttgaaaaaaataaaaattttcaaatctgaacttaaaagtttttaaatcaagaatttaaaaactttcaaactcaaaatatgataaaagattaaaaaaataaacagaaaaaagtgtgaacaaaaacgaaaaaattggaaaaaaaaggaaaaaaaaagtcagaggacgcgcgcgccggggctgggccctctgggccgaaacgcgcgcgcattatcttttctgtgattcaacgggcaatactgacaagaaggtagtcatgtgcaggtgctgtcagtctatcagcatcgacatctatgcctgattacgagaacaacgtgctgctaatcccgggccttggtataagattctgaaaagtccatcttgatttagctttgttcgaatagtaatatttctcaaaatactctaaaaacgagctactactatgtacgagcggcacccttcgaatctcaaaaataatactatacagtacgacattacggctcatcctactcgggtttcgacgtattagcgtcatcacgccgtaacatcgatcttttgaaattgggcatagaccatcaaccaccgtcgtctgaccacgaattccacgaaacatgtgaagcacacgctctcgcttgatcatactgcaaaaacgtgaaacgatgtatatggcgtcgcggccagggcactcgcgtaagcccgagagcgatatggatcgatggtggcgagctgatagctccactgagcgcgccggagaagaactctctcgtctcgtcccgaccgcccgaccgcccttgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaactcatggataaaattgccatccctaagcccaagattccagcgttcaggccaaaattaaacggtgggggcgcctccatccacactccagagagagtgctaactaattgcatatgcgcactgcaaaacaaagatatggtcctgagccacgcctaaaacgacagatccgtgtgtagtgatgagtgtgtgaactgtgtgtaacatgcaatggagaaaagaggaggggaaggaattgtttttttgaccttaaactaatctggcatgaaattgacgtagtaccgttttgcttgagcatgaaagaggacatgcagtgtgtactagccctactggcttttgtcttaaaaaatgcgaaacaaatttcttgttacatagattttgtagtaggggctcatacgacgaacttagcatgtatttagtttagaaacaaagtgagatgggttggactcatccctatttttaggatggaatgatcctatctatctatttggcataagggatgggatgatctacttttgaaggaatgtccacaagttagtgagagaaaaaagtaggttcgattggtccgctagttttttaagggccactaacccgtatcctaggggatatattccttgtcggggaccatcatatcccacatgtgcctaaacaaaacactgaaaaatgggttcaacccaatctaatccatcccaaccctttaaccaaacaaattcttaggctgcatttgtttgagcatttcaggtgaaacagttcgtgacttataaatttagaaaataaatttgtttttggttttttctaaacaacttctatatgatttatttccacaaaatataatattaaaagttcagggagcattgctaatgaaaaacaagaaaataccatttcaagttggcgaaaagaacttagccttggtgatattttgtagaatcactaacagaaacagaggacattaccattcaaaaagttttgtgcttttttgcgaggattaagtaattttttttagatgaaaaatccatttagagaccttgaaatgccgttccatatctttcatcccttggcataaaatttttattctacctagccatataagttaaaaccaacaacaaaacaatgttaggatccctttgatttgtaggggaaacattggagtttgggaggatttcaatcctatagggaaaaaatcctatgaaaacatttgaaacaaaagattaaatcttattttattctttaaagttcctatggaatagataatcatataaaaattttggagaaaacttagcaagaatatatctctcatccgtttcctatgttttttttccgtggtcgaattaaatgagcttttttgtgtttgtagtccattgttttatatctgcattttcctggcataatcatgtgtttttttattccttcggattttttcatacaattaaaaagggcctttactagtatagcaagtttactgtgacgaaattggagacaatatgaattctttccatgtgaaagaataaacttttacgaagtattttaatttcaaagaagaaactcaatttcttctttttgccaagatgagctccctccaaaatcgatctaccggcatgaaccatccaaaccctccagtaggattacgcaccaaacagggagcctaccccaaccacatcctagagcagccactgtacagccgtcctggctcactgttcaaccgcctcgagattcgtgcactcttcccgtgaggcgacggacgatgattgcccaatcatggcccctccctccctcgggcagctccatcaatgctcgcgtgcgtggtcctcccccggagcttattactcccgaccgaccggcgggcccggcccggcgatgtgaggcgctggaccgatccgggccgtccgatgcaccaacggacggccgagatgctgaccagtccgatcccccgcttcgtccctttcccgtttgactccacccaccttacggcccggcccaccttggaaaactggacacacacacacgcaccccctttctctcgcggatttttttttctcgtctttgaccgggctgtcagcgtcggcggtgggccccactgccaccacaatgccatatctatgaccacgcttgcttgcttgcgcttggaatttgtggatattctcccttgcttggccattctctttgactaattttaagatcaagagagccttctagttctaacaaatcttgcacatttttgcatcccacaccctctaaaaatacttttattttctctggtcgtgtttgtacttgttcctcagggactttgttctgaaatttcttctccatgagctcagggagaagaagtgaagaactcgtgctggcgtgctgcataagtttctacgggaaatcttccactattcaacatgacttgtactaaccaaatttaactctggatttgcttctgctaactctttaatatagttcagttgcaatgtatttaggttaacttctctatggctgtgtttagttcagcgcaaagtttggattttgattaaaatttaagatgatgtgactgaaaagttgtgtgtgtatgacatgttgatgtgatagaaaaggactgaagtttggatccaaactttgaatctaaacacagcctatgtttggactcccaggaagccaatccataagggcaagctgcagaattgtcatctgctagtcgtctgaatctctttcagtctcagttgttcttttcatctaagcagtctacctctacggttagttgtcataatttagcaatgcagtatgtactactagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatttcttgttcaattcaacaatgagcaaaaagccaacacagtgacttcaaaacaagagatgccacatccttttcgcagatggcgaattaatctcttgcgttccatcgtcaatacttcaaactttcttactctcttcttcgattagaacaagaattaaaaacactgaaccgcagacggcaaggcaaataaactatgatccttcattgatgttttcgtttcgtccgggatcttcagacggcaggatagcgaataagcaagcagtggcaacttgtcaaacattcgaagccatcgcggtcgcattttattcgatctttctccctctgaaaagcaaaacaagaatggtagcgagagagaaaaacaactggagaacgatatgcccttttatcatgttagaattttgcacacgcagttcgtcatccttcttttcctgtcaagttgtattggtgaacaacctcgaccacgcatgcatcaaatcaatatgagcatcagaccataatcactcgaattgccttccagtttcccaattacacttttgcttatagtgatgatcaaagctgtagaacccaggctacatggttaaagttgatttcttcccaatggacgcttccacaaaactcttcgtgcttaactttgaacagaataattttgtgggcgagaaagggttacacaataaacatttttaaaagaaaaaccataaccagtggctataattaaccgtacaagcaatgtgttacccctatcaacacacagttgcgtcatcttgacacacgcactattcagaagaaaaaggaaaacctgaaacctgtttctgaaaatactggagcactgcagctgaatgttcatgagcaaaccacctttgtcggcttgtgaaggcaaaaaaaaaaaaaacaccatttgattttcaccgctttagaaaatcaccctgtgatgggtggtaccattaccaacacactctcatgtgcatcctgccccaccctcccattaccctacctttgcaaacgcatcgttagagcaagtttattagtatagccaactgtcgacttcaaattaactatagttaattttagagccaattcatataataagttacctataaacatatactatataattaatatattggctcgaaagctagcttatactagcctgctattgtacctgctcctaaaagtagttaattactgctaattacatggattagttgggtaaaagcggggttagcggggggcggaatataaaaatgccgcctgcctcggagcccctccaccggctttgaccagtgccgcgccctctcctctctgtcgcctcgccaccaccatagctaatcctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacaggtgcggtctctttgcttcccctctgctgctgttgttgtgtgcggtttgcttggttataggtggattttttggggttatttcatgggtggttactgatgtttttttttccgttgctgcctggatctttctcatttggattatcatctgctgctttcccaaagcgcgctgctgtttttttttgtttttttaaatatttttgtttgtgtttgcgctcttgcatttataaattttcgccgaatggcaggctaggactttggatataaggtcgggggtttgaaaaccctcgaatttcataatttccccccaccaccgtttcagaagttcgtttggattctgtgaatgctcacaatgctgtatattagtaagaggtgagataatgccgggaaggttttgggaattctgctttcacggccatggaagctgcaaccgcgggttcatttatgatcgcggagcggtgaaaatttccagtaaatgttttgggggtggtgcagtgcttggttgttggggtcaatgacttagctgcaatagattgcttatttaagttggacttttgacccggaattgttaatttggtttggtttggtgagaattcgactactagattccgtctttggatatggaagtagttgcagacgcgcgcaatttctgtgaagttgcattggaaaccaaactaaatggagtggtgtgtttgaacgtccattgttgcgtctgcggaccaatgcatcacaccacctggctcctataagccttcgtctcagcttgtctcttgatagatcagtgaactgattgtgggaatgaggcagttttagtagtttagctgtctcttcttctccagtaatggtttggaagttcagaatacattgagaggtgttgtacttaaggagagatatcataggtatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacaatctgctcctcctagttttaggaacaaggctaaaatccaccaatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggccaccgtttctctaatccactgccccttcctctcccatcaccagaaggaaaatcattgaggaactttggcagcttcaaagccatcaatgcaagtggaccactcgatgcttcaggccctctgccacttcctccaaagaagtgtgatgggcttaagaatttctcctatgaggaactttcatcagcttgccaatggttttctggtgaccagtgtgtttccgaaagtttgacatcaacatcatacaaggcgtcctttagggatgattttaccgacccaaagaccattgaagcaatagtatctcggttgctctcctccactcaggtactgttctccgtaatattgaattatgtgtttcatcttctttgttttcccctggaaggaagttgtattggatgtaaagcggtagctttgccattttgctttgttggtcagcttgtcaaacagatggttggcatgttatggcttacttttatttctctcttgctagtgagtagtgacttggcaaaatgcttgtacactgtaaggattatactcttttagggctttaaccattttgcagcatttcttctattaagaagctgaccttaggctagaggcacggactggttttgtaggcatgtgatctatgctcttaatgttacagctatgctgtctccagcagaaataactctttctatttttgtgaatgcaaaccaggaccacaccattggtggggttaggtaacatgctctggactttgaaggcagaccatgtgtttgatcttctttcttcactttactcctagatgctttctccactccttcctaatcatatccagtgactagcgagattttcttttgacgtttgtttgatactttgatatatgatatctcatgctttccactttatgtggtttattggcatggttctgatcttccctcacttgtattcagtattgaaggaatctaaaaaatcactgtagtgttattgtgtagttctgggaattcagtggttcactagactttgtattgtgtgtgtgtgtctaaatctgataccccctttggtgttacctaatgttgcagcaccgtttattggaccatcctgatctattatttacaatttaactggttatggtactgatgcaacacacattttattaatatgcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggttactgcttctaaactttttctttttgacattaccaataagtgaatatttattttacctagttatatagtacattggttgatggtttttgaccttgtggtttaaactcttattcatatgttattttttttacaggccatgtacaatgacttctcaacctcaaacatccaaattgacaaagatttcactgcaaagctatcaggatatggatgtgttggattcaataccgaggaggaaatatcaaatgcatctgtggtaagttatgttttgaaaatattttagaagatatagttatcagagcccaactcatttgcctgatctctttctgtaaattcaagtagtgtgttttggcatggttaatactctgttcgtttgtatggattctgtgttgcacgccattgatattatttagtcccaaacatcctaatattttgatgtgtttttactttacttgtttgcattatatccatagtggtcaatgccattgtttaccgtggatgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttcagctatttcggttgggtgccaactgccaaagtgccaagtggtgttgttgcttgtcggcacatagattgtccaatgttctaatccacgtgatgagatcatgtcgctgaagttgcaaggatccattgatgtaatatttgctgctgcctgtggcagttagagatgttgaatgactttgaatccctgcctgtggaaagttcatcccatcgttgcagttgttgactgcgacccagcctgcttttgcttctttgaccaaagtttgtcgatcgccggtcaaacttatctcaagcttaattagagtacgtaacaaacgttttataaacatgtgttttcaattggaacgtcagtgacgtctagttatgatgatgtaatggttggtggcatgaaactctactgcaacagtgcaacagcaaaagaaaattttgttgcatcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctgcacagtttgttttgtccttggacactgtcacttttccctctctttttgctcgccatggctgtaaaggtatctatctgggcatgccaaggtccccgtccttagattgccatgattggatcggatggatccagcctaacctgatcggatattatcgatcaggaagatcagatcaagtaatacggatgattaagattttctaacttctctatgataaagttacaaatgttaagttagagaatttgttttcgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccgggggcgccctccgcccacgcgccggcgatgccgagccagcagagcagccgcttcaacgcctccagcagccaggacctccgcgccggcgcacgtcccgctcccggtttctcctcctccttggcacgtcggccggcagcgcccggcggggcttcctgcttgtcctgcggcgcgacgacggcgagacgggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtatatgttgtataaatcaatctctgcagtataaattgaagttcacacgctatttcgcacactgcttgtttggcaacgcaaggaaaaagattgggagtttaaaattgatggtgagaataaaataggattgggagtttacacgagggaattgatggtgagattaaaatgagaatttgatttttaatcccagtatcttgtttggtagaggtagtggaaattgatagagagtttagttggagattagttcattaatgaaaatgaatggctgagatttgtttaggcaaagtaaaggaggaattccgtcccaattaccaccactacccaggtattgaaaaggagggagttcctccctcaattctctatccctatcccacaaaaattctcatgtatcccaactaaacaaaacaattaatagatgggactctaccaagaccatgacgatgacattgggctacattactagtccatgagaaagcccatgtaaagtaatgcatcctttcggaccaaattatgaagtccgggcctaacaagtgttacccaaagaaatttccccaaacacaaagaaatacggccccatcgtttcacatatgtgtgaataagccaaacggtatatttacaaataaaaaataatttgtgaataaaactttttatacatgttcatgttcttaatgatctaaaagcaaagtctgaaaaataaacctcaatgaaaaaaccccaaaaccaactccaaattaagagttgaaaattcaaaatttgtttgataagtaaaagcataaacgaaaagatgaggccaaataatcccaatccaaataacgccgccatcatctaaactttggggcctcatcttttcccttatgcttatgcttatacttatcagctaaaatttaaattttcaactttaaatttagaactgatttaatggttttttcatcgaagtttatttttcagccttacttttagatcactaagaacacatatacaaaattttattcataaattatttttcgtttgcaaatacgtcctttcatttattccggggcttttctctcccaatttccccgccgcccgaatcggccgatcggcaaggagttgagcgattctctacgcccccaacgattttctctcccccaaatcgatggcttctcgcaagtcgctacgacgatcggcgctgctccaactcccttgcggctgcttcgcggagacgagggttgtgctcgatgagaagacggagcacctccagctccctcccacgaggttggtccggatcacgtttttcgcagtctcgattggattcggcttgtctctgtcactagggtttaagggaagctttagggttttgatttttagtttcgatctcttcaggaaactgtattccgaaatacggcggagggcatggggaggagtggaggacacggctctccgccgccgtggcggccgtcgtccgcctatgcagctgaggcctgagggagatccccggctctgacatatcggtgcaggtgcgcgacaagccgcggggaagagttgttcgcctgatcgcctacggctaaccagaacgacggtaattgttcggaaaatcctaattgtctatgcaattgcttagttttgagtcgaatttgttaaggattgtgatgcagtcatagtatcagttatctgactctgttaccaaaattgccccggtttttaatttgtttttgctatacatttatcacacgcctgatttttttttctttcatatatactgatgctggccacactatgtattgaaaagaacagtggtccagaggtttatattttatagggagcgacaaatatattgactgataatctggatttatgctggtaacgaattggtttcatgagtctggaaaggtttgttttgctgttgagctacagttggatgagctttttttttccttccgtgcagaactaggtgccatgatgaaaattcggtttatgccaacttattatctaacataggcttcaacacaggactagaagtttgcaaggctgtaagaaggcatgcaaattagatcttactgagtttttttttcctgtcatttattcccttcttggagtgatgatgagaattttatcatgcccataaatctactcaagcaccatcattccatctatttcctcggtgtcttgtactcttgttacacacaagagctatactgtgagtttagcttatggaggtgcattgaagtcagactttgccatctgtggtatctggtttttgaaaatcaaatgtaagcttgaataaaatgatagtaccatggacaataggacctgtgttcgtaaaaaaaatgcacaataggattttgtcatatattggtgttagagggctatatctttcaaacagaacacgcaaccgaaattcactagtttgttcaatttgttaatccttttttgtgggtttgggcttgggctgtgaagcatgatccgattccaatgtctctgatcactgaatccaatatatgcatcacacatctttgttttcgtcatggttttgatgggaaatgtgcaagcctgtttcagtttttagagaagggatgatgcggtagtccaatatgcagctagagatgggagctcatgaccatatcgatggactgctaagatggcttggagggcataccggaacaggacaatatgtggtgataacagtgtgctgatcatcagacgtaacctgcccagggttttttagcaaatattctttctacatcgaactggctattactacatttcattttaggttggccagtcctacaattcactccagaattctgtacctatgtccaacaaggtctcttgcgaaatcctttaacattgatggtattataccagtcattatagcattgagctcattattgttatagttggtgttatatacatgttccccgagtcctatgtgctagataaggcttgagtctgcacatgatactgtcacttgagacttgagaggtgccgccctgctggccctcccactctataggtcaccacaggtccacatattccttttccctttttcttcctttatgtccttttcccctttgcatgattcctctcctcttgcttttggcctttttgttcacttaatgatataagcttgttagcatgacaaagatttatgcgatgccaaggttatttttaccttcaccaccttatgtccttgctttttgcacaagtcacaattttttttgatgcattatatgtatgtactcctaatattttctgagagagactttcacactttttgtcaaattttctgttttctgttgaatatttaagaactaagaactatttattgtcgctgagttctttcgtgtactattttgaagttttcctgtttgcattttcctagccatgctgccatttggaacactgtattaggcatgatcattgcgtgggtcggggacaaacaacaactgtaccgcaataatattttgggcatcaatttctccaggacgagctatatgcataatgcatctctgttgttatatttcccatgggcattttcgcatcgtcagtggtactgttgttgtgtcatttatggacaacttgagcatgcagagaatttgagagatgatttgattacgggcatatgatcccctttgtattgcatatagtgggtagtcttcttgttgttagcatgttcttctccagttaaagaaaagtgagttgtacggttatcaatgctctacatgctcatatggttgcctggcttgtagttcctgcattggcctgcttggtgttgattcacgacagcgaaaaatactccctagtccctacattagttcttcacagtgtgacttggaaaggtgataggatgtactccctccgtttcatattgtaagactttctagcatttcccatattcatatagatgctaatgaatctagacacatatatatacctagattcattaacatctatatgaatgtgggcaacgctagaaagtcttacattgtgaaacggagggagtatcaaacatttcagacgtttctgttacatgttttctgcaggacaagtacgagacctcttggcagaggcttggttaaaattcttgctttgctgaaggaagaagatgccaatggtccaacctgtgactgtcacgatgacaaaacgcattgccaggtggacttatactgtgatttgcttttattccttatctaatcatggtaacattggcaggaatggataatttttctatctaagctaccagaaatcattgtgttctacttttgtgtgtcatgtggaggaactttggggcaggtaaaccatgtgaccagaaagggaattcaacacttagttctagtggtaggaatgcagtcatatgttgatatttgccctggaactggaagcaaaatcataattaaatattttctgaggaacatcagatctttttttatttaattcatcctgattccttttctttgcagaactgccttcagatatatgcaattatccatatactttttgtttctattgcttctgctctcttctgcttactctctcttatactgtatagaaacatatactagctgaattccgcaacacaatacctttattttgtagcaaagcgcaaccttttcagagctttgcatagctgtggttgaattctttgtgaaaagaaagcaaaagatgataactgttccctttagaaacacatttcctgaaacatttgttgactgggtctaccacattcgagcagacgctatcagttcaatcaacaaactgcccaaacatatttgtatacaacatctcatatcctcacagaaagcagctacagtgagtgatctgtaaagtcaattggtagaaaatctgctgggtggcattaagaataacattcattgtttatgcaagggtgcagattatactaatgcaaaatatgattgtttggagcaaagctacaggcatctgcatgtggacgtggatctcagaaggtaacttgtgcagaaagactaattgagattgcattatgaaagacagcagtaacactagcagcctgtgggggacaccatcagcaagacagcaaaagcctgcatgattcatttcttcccccaccacaaagcattgaggtttgctctcctgcctcacttattaaatctcacttttccgcttaaactgttatagcgcagcaccctcgtcgctgtgtctgggatccacggcagtaaaataacattggcacatgcttactatacactggctgtctgttaattaagtgtcattggcttaagcaacactgcatttagaaaatgtttactactgggaattcacaatgacagtgacgtgaatgagctgacaaggaatctggggtggtctgatctcacttgcgtatttttaaaccgcgattaaaaaaagtcaatttgattggatctttaggttttgtacattctctcgcctaactctatctgtccttttatctttaacttccctcttattgttcacaatgtaatcttgtactgaatatacaaaatagtagagctggctctacatttttccgtaaaaaagagaagaaaaactttaggtgcttaatgaggtagataacgagccaaaccttggtaattaaccttaatgagttataaaagtcaggctcggcttgactcttgaaatggctcgttagaacatgtacaataacaaactataaatcagctataagcacatgtgaatagtgagtagagaaaagagaagcggacaatagtttgtagccagctgcagcacggactttaagatgatatgtgtatgataggtaagacgctgtgtgtatgataggtatgaccaaatattaatgatgtactgtatatttgtagttgattattatataaattagctattagattgactatgtatgatttggagctagtagttggctatactattaaacttgctcttaagatatattctatttaacgagcttcatcttatttatatcacctttataatatcaaaacattctatcacatattaatataataacaaacgctaactaataaagagttcatcaaatataaagagactagtcactacttcctccgtttcacattgtaagactttctagcattgcttacattcatatagatgctaatgaatctaaacattatctaaacattatatatatatatgagcaatgctagaaaatcttacattatgaaatggagggagtactatagatgagaaagaagtcttattctaagtttgttttaagtcggaacattttaatctgtgatcattaattcttataaattcatatagtttatcattataggttttatattttcaatccatcatgaaacatactttcctactaacatataattaacattgttgtcaaacctcacatattgtaaataaaatctatagtaaaaaaatagttatgtttaacttaggataaacttagaacaacaaactaattcaaaacagagtagagtagagtgctagagagctaaaaacttataagctcggtttgactcattatgactataaggctcagttcctttgtctgggttcccaacccctccttctcgttttccgcgcgtacgcttttgaaactgctaaacggtgtgtgtttttgcaaaaagtttatatacaaaagttgtttaaaaaaatcatattgtttcatttttgaaaaaaaatagctaatacttattaatcacacgttaatgaactgctctgtttttcgtgccgagggaaccgttcccaaccactagtgttgaacacagccttaagtcagagttgatccaacccatataagtttggagttttttttaaccccagtgattgctacttcctccgtcgcaccatataattattcttaagatagccacgagtattaagaaaatatgtgtaaatgattagagaaagattatgattggttgaaaagagaaagtatgtgaaaaattaattaaaaataattataattgcttaagaagaggtgatatatgaagaaatgattttattttagaacaatacactgcacattttactttgtagtactacgaacaagtttaatagtatagtcaactactagctcaaaatcatatataatcaatttaatagctaattcatataatagttacctataaacatatactacactattaatatatggttccacctgtcatacacaaattgtgtattagagttccgtgttacagctgggcgctggctacaaatctgtagcacactgctattttctctcattttttttcttgatatgtaggccgagtttagatccaaattttttcttcaaacttccaacttttccatcacatcaaaattttcatacacacacaaatttccaacttttccatcacatcgtttcaatttcaaccaaacttctaattttaatgtgaactaaacacacacgtatttagttgtttatagttctattattgtacgtgctctactagcaaaaactgtataggattctactttaccagcattgtcctcggtgcctcctgactcctgagcaagcaaggcggtaaattttaaattttcaaataagttgcactgaacaatgctcaccaaccggaccgtgagggtgtcccagttgctgtgctgcggcgctactcttgccctggttgctccggatcgcaataagttcccccataaatgctgccattcggagtggccgctgtaaatgaaggttgttgcgacgcattgaatacaagcaaccttcagacactgcagacagccgtaggccaggaaccaggagcttttaaaacctctgaccctcttttcctttgtggtgaatttccagagggtttggaaaattgggggtataaaacaaactccgttttgttacactagaacgaaacttctaaaaaattgtgctctactcctactcatcaaaatacttctactagtaagctcaactcctttaaaattcctgcaaaattcctcgaaactaaataggccctaattaaagaggaagatatatacttactatatcatatcatatcttcaatagcgaagccaatgatgtcgtttagtttaaggaaacaaatagcatttttggacgattaactagtttctgtgaacgtcaaaggtagtaattcattgtggagtaatcaacaacagagcctgaagtcgtcctgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggag

SEQ ID NO: 774 - DNA, 981 bp, Oryza sativa
atgatgtcgtttagtttaaggaaacaaatagcatttttggaggattaactagttcctgtgaacgtcaaaggtagtaattcattgtggagtaatcaacaacagagcctgaagtcgtcttgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggagtcgacaacatgagctaagccaagattaaagctgtaccaccattttttctctgcaagataaaaccatagaaatccagaaagccaagagaaatcattttgtcgattcctatttgttctactcgtagcacattaatagcagcacaaggccccccatctcctctcctctgtgcttccctcactgcgccaccactccaccaccttcacctgctctccaaaaacttgccttgccgccgcaaatggacaaggcgccgctgtgatccctcctccccattgcgttctcccgcttcctcctcctccgcgcgcgagatggccgccgcctcgccgctcgcgcggttcctcgcggcgctgctcgccgtggcggccgcggcgacggccgccaccgcgctcaccgacgacgtgctcgcgctggtggtcttcaagacgggggtcgccgacccgatgggcaggctcgccgcgtggacggaggacgacgaccgcccttgctcctggcccggggtcgggtgcgacgcgcgggcggggcgggtgacgtcgctgtccctcccgggggcgtcgttatccggccgacttccgcgcgcgctgttccgcctagacgcgctc

SEQ ID NO: 775 - DNA, 3215 bp, Oryza sativa
  unsure (1)..(3215): unsure at all n locations
nnnnnnnnnnnnnnnnnnnnnnnnnnnnnnnnnnnnnnnnnnnnnnnnnnnnnnnnnnnnnattgcagttcccttgttgcattgtgagttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgggccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccttaccagtggagctatctaatctgcccagcttgcgcatctttgatgtctcccacaacttactatcaggggacctcccaaatagtcgtttcttcgacaacatccctgaaaccttcttgtctgacaatcagggcctctgcagctcgcggaagaacaactcctgcattgctatcatgccaaagcccatagtgctcaatcccaactcctcgacaaacccattgtcgcaggccacaccgactgcccctagcagcatgcaccacaagaagatcatattaagtgtttccaccctcattgccattgcaggtggtggtaccattattatcggggtgatcatcatatctgttctcaaccgtcgtgcccgtgccaccacctctcggtcagctcctgctactgcattatctgatgactatcttagccaatccccagagaatgatgctagctcagggaagcttgttatgtttggaaaaggcagcccagagttcagcgctggtgggcatgccttgttgaataaggattgtgagcttggtcgaggaggttttggtgcagtctacaagacagtgctgagagatggccaaccggtggccatcaagaagctcaccgtttctagcttggtcaagtcgaaggatgactttgagagacaggtgaagttgctcagcaaagtgcgacaccacaatgtcgtcgcactaagaggcttctactggacttcgtcgctgcagctcctcatctatgattacctgcccggaggaaatttgcacaaacacctccatgagtgcacggaggacaactcgctctcttggatggaaaggtttgacattatccttggagttgctaggggtctgacacatctgcaccagcgtgggatcatccattacaatctcaagtccagcaatgttctgctggacagcaatggtgaacccagggtaggtgactatggtcttgccaagctgttgccgatgctggaccggtatgtgctgagcagtaagatccagagtgcactggggtacatggcaccagaatttgcttgcaagactgtgaagattaccgagaagtgcgacgtgtatggctttggagtgctcgtgctggaggtcttgacgggcaggaggccggttgagtacttggaagatgatgtagttgtgctatgtgatttggtgagaagcgcactggaggaaggtaggctggaggactgcatggatcccaggttatgtggtgaattccccatggaagaggccttgccaatcatcaagctgggccttgtttgcacctcgcgggttccatcgaaccggccagacatgggcgaagtggtgaacattcttgagctggtgaggagtcctcaggatagtctagaggacgagctggtttaatgtctcttgccaactctgttctgaacggttctaggcgtttttttttcctttttgttttaatgagatgcatatagtgtaatgctaggtgggaagaaatcagagaaagcaaagagtggtatggatcgtgaaatgcttgtagtttgcttgaagttttagggaggttgcaaggctattttgttgcttctcggcaattctttgatccatttcttggaagagttgttttgccatgtgggcattgcctcggtgccgcatatgacgtctcacaccgtgacacagtcatacaactgaatgaatgatgatgttcttagggtgtgtttaaggataagaggattgaggagattgggaagatacgcaaaacgaggtgagccattaactcgtgattaattgagtattaactattttaaattttaaaaatagattaatatgatttttttaagcaactttcatatagaaaatttttacaaaaaacacaccgtttagtagtttgggaagcgtgtgcgcggaaaacgatgtgcattcttactctctatcacccaaacaaggctgtgtttgctgggggaggttgggaacaaatcttcttcgcacggaaaacggagcggtctattaacgcatgattaattagaaattagctaatttttttcaaaaatgaatcaatatgatttttttaagcaatttttgtatagaaactttttgtaaaaaacacatcgtttagcagtttgaaaagcgtgcacgcggaaaacgatggagaggtgttgggaacccttgggtccgaacacacccttagtagtgttgctctaacatttttgctttcaaatgtgtggtagatttgactccactgtactggtgagtgtcaataccaacagcccaagccacagcagggtgtttgtacttgaattaggggtactgtattttacttcaccagtgactaaagtaaatcacaaaagatgtacagaaaataatcaagagatgctaatgttgtacagtagtactactagtactgaaccatcacttgaagcttggcattgtttcatgattggtagagttttggcagccgttgaccctgtggaatagggaacagtatccctctgccttccctccagcaggggtgcccccatttgcgcgaggatccatggactcacctgtcctttgaagcttccaaaaacatgggcaatgagaccctgtttataatcacatcggg

SEQ ID NO: 776 - DNA, 1497 bp, Oryza sativa
actgtggatggagtgcgtggcaagcgggctgcatttactactcgctctacctttcctcctccctgatctgcaggagtggagtagcttcatagcttcgcagtaaacgtagaagagggcaggggctttcatggcatcggccgcagcaacagtgctgtggtgcggtggtgttggtgtgaggacgccgtttcgatttgtgctaaggcctggtttagttcgcaacattttcgttaaacgtccaatttttccatcacatcgttctaatttcaatcaagctttcatttttagcgtgaactaaaacacaccctaagctaggagctcaggaaatattcaaagattaagctgggagctcgggaaatattcaaagattttgggtttgggaatctttatattcagattctgtaggatacatgtttcaatttgctcctctttttttttcatgctcaggataaaacaggagtaaggttgaaggatgcttgtattgcaggagcaactcaattacacctttgcctggagtggagtgctcgactgctcctactttgtttcgttgccggcaaaaaaaaaaagaatgaaagaaagacagccacgtaaaaagaaaaaggaccgacagaatgaatccatgcaatgaacaaattattgagggtgtgatgatgaagattcaaatcagaacagtgctataatataccgagtgtccgcaccaaaattggaagtttaaagaaaaaagttggaagttgatgtgagtacgaaagttttaggcctagttcctaactttttcttcaaactttcaacttttctatcacatcgaaacttttgtacacacataaacttccaacttttctcttcaaacttccaattttagcgtagaactaaacacatccttgatgtgatggaaaagttgaaagtttaaagaaaaagttgggaactaaacaaggcctcaatagacggtagaaatccatcactctctccgtttcagtttagatatgtaaaaaatgcaacaaatgtcattggcaaacgtcctattctaaaaatactatcgacgaacgcaatttcaacaaatattgttgtacaaaccaacttaccattaaaaataccattatcgttagggtttcactaatttctctccgctaaaatgtgatgaggttaacaaagagatgcaagttgatttgtacaacaaatattgttatccaaaccaacttatcatgaaaaataccattatcgttagggtttcactaattactccatcgttttagtatagcagtactaccatgttcttagagtggattattgcaagtgtgattcattatctggagtaggacttttgcttttgattcactcagaaggaacatccatagcaaaatatgatatcgattgtcgtcaagatgtaatgagcactactcattactcaagagtgcattgcttaaaaggccacgtcacgaggcctcgaataaacgattttttttagataatgaaatataacattccagcctttgttaaaaaaag

SEQ ID NO: 777 - DNA, 11292 bp, Oryza sativa
gtttcactaatttctctccgctaaaatgtgatgaggttaacaaagagatgcaagttgatttgtacaacaaatattgttatccaaaccaacttatcatgaaaaataccattatcgttagggtttcactaattactccatcgttttagtatagcagtactaccatgttcttagagtggattattgcaagtgtgattcattatctggagtaggacttttgcttttgattcactcagaaggaacatccatagcaaaatatgatatcgattgtcgtcaagatgtaatgagcactactcattactcaagagtgcattgcttaaagggccacgtcacgaggcctcgaataaacgattttttttagataatgaaatataacatcccagcctttgctaaaaaaaagctacaaccaattattataaagtagcacttcaaaaaaaagtgtagttcagataaaaagaacacactaaacaaaaacaatggtgaccaagccaaaataaggagaacacatttattgaagtctatttgtgaacctccacccataattggcaaatagttgcataaccatcgactccaacctgcggcatgcagcctttaggaattccccatcatcctcacacctttgtagctgtgccaaaaaccggagccagtgcattgccctaaaaattacctgtatatatgtaatagatagtgatttgtcaaaaccaaatcatttctactcaactgatggaacgagcagtgtcaaagaggctagcctagcctgtgataacggcaatcaactgatggtaaaatcgtcacggccgccgcgggggtcgctggggcgggtttgtcgcgttgctgttgcgaagattcggagaggaaagttctaaaaaaaaaaatcggagatcgatgaaatcggctcgcactcggaccaatgccaattgacgacacatggtttgaccacgacaaaaaaagaaacgctactcatgttgtcctactgtcctacgggcttctcctacgaagaaaaaccgtatcccgagatgttccgtggacgacgcgcgcgcgctgtcccgtgccgtgccgtgaacggtcgtctgccctagtactcctaccgtgctgtgagcccgtgatttttgcccgtttcgcaggagaggcgcccgcgcacctgggcgccgcggtcgcggatgcggatgcggatgcggcgtggtgggacggtgtgtgcgatggcgaacggcgaaggcaggggcttggggcttcgggggcgctcatttatggtgggcggcagggtggtggtgtgtgtgggtgtgagcctgggtcctgtttggtttcatgggccaatgtttagctctcaccttttagtcttaaattagtcctcaaggatctaaacatgtggtctaattttaagctaatgtgaattagcccccctcaaaacattagcccctccaaggggtgctgatggggctaattttatgtggggactatcaaaaagcagctttttctctccttctctctcctctctttctactctctccccaccttttagccttgaattagcccatagatccaaatataccaccataggctaatgtttagcctaacaatttatgactaaatattagctgtcaaaattagctctggactaatcttccaaatagagccctgtgagcgtcgtggccgtggaaacaaaatgtgtcccattagattgtgtgggtgcttcgccccacacagctcgcccattagattgtgtccgcaatcgatcgtgtcagccgtcaaccagacagcaacaacagtgctgtgctgctacggggaggggagggtgtgggggctgcatgtgtcgtccactcttgcatgctgtttgactagtacgtgatgcacatactagtagtctagtgttacgtggtagttgggcacgttgtgggcgtctcggagtcgccacgagcacacgagccgaacaaaatcccagtccattggacccatttggcctcgtatatattcgttataattaaaaaggagaaaaaaacatatccagagattaaaattagaaaatcggctaataagactcggagttttaacctccgatccccttgacctcgatgctttggtagtcatcatgtaattttccctgttctttctgcaacaaaagttggataaaattttagatactcgtggcacgctttttaaatcgttaaacgatgtgtttcgtgtgaaaactttatatatgaaagttgctttagaatatcatattaatctttttttcaagtttataacaattaaaactcaattaatcatacgttaatattacctcgttttgcgtaaaaaacttaatctttatctttaggagaaaagaacaccgcctttattgttggccgatctttgtgctgattcatgcatgcttcatccgctagattgtttctgtcctcggcagtagccatggatgatatatgaatacgctagactccgactcatggtcgagagtctagtcaatctaggtgattagatgatatactgtataatacttctgtcagggttatgggtaccacatacctaatagtagtcgactaaatctcggcatgacccaccatataccatgtcttatacgaaaactgacctcggatatggagggagttccgaataaggaaagagaaccagagttctacatggaaacgacaagaactctcagattgtatccatattggttttcctagttctgcttggacaaggggacacctatgggtataactacaaggccccttaggaggagaggggacacacccaccatagaagacacggaacaatagatcaagacagaagatcaacatacaagccaacatacgccaagacaagacgccagatatcaacttcagagataggcatgactagtcccctacggtgcctatggctaccgtcaggagagacataacgctatctctgatctcgccggatgcggattcgaggaggaagtctaccctggtgtcgactatgagttagaacttcagaccgccaagtcgacaacagttagataggctaccccaagtattgtattggtgtgattatggtgaataagagcaatgaccggcttcggccaacaggatgtagggttattacctgacaattcaggggcccgaacctgtataaaaatcctcgtctctgtctcttttactacaatctcgcgtatatcctagtaccaacgatccccatactatgcaaatactgaaatcgcgacatcaaatgtcgacaacttcctccatccacaaaagttgcacatattacttttgtcaccaagatcaaggagaaattaaatcatcttggatgttacaaaatcaacgagtaaatgtaaacaagcaatcaatgaatatttagattactcattgggttctcacaaacatttaatttatctcttcatttaagtcttagatgtataaagaatacaaataagaacaacttatttgaaaaactcaaatgtgaaacatgtctaacttttatggatggagatagagtatatcatcggcttttttagcacgcgtataaattcacttaacatgtttggagtactagtggcacaataatagccaggtgcagccactcacgtacaacccctttagagcaggtacaatagcaggctataagccagctgcaaacatattttaagaagataaataaggagaaagaagagcagcgggctacagatttgtagtcagctgtagcacggactccaagacgcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggttcggaatttttatctccgaacccccttgaccttgctttcactcgtgctttggtataagacagtgaaagagagaggagatttcatctccatgtacatagcgacatgttatgtgaatttgcggtgatcagattctgcggctaaagttgtgtgcttatgttgttcctgcatgtttcggttgctagattgtttccttgggcggaagcggccatggatgatactgtggtactacatgacgattcattctttaagaaacaaagggagcgcagtggaaaatggtgaatgaagattacgagatggctgcgttcgttccatccaacactacagaaatttttagcgcacgataaaactcattagcatgtatttaataaaatattaactattataaatttaaaaaatgattttctttaatttttttaaacaacttctatattttattttaaaaaacgtatcatttaatagttagaaaaatatattgacgaaaaataagtaagatgaagtttggagtttaagaaaagaacttgttctccccctaagccgagctcgataccagccacgagctctcgggcgcaactagcacaggaagtgaagttcgtaaattaatcagaaaagaagcccgtgggctcaaaacgctccaaatattgcctcagtacggcccaattcactccgaaggccagcatccattgggccattggcccattggccgctccaactgcaacttgaccctaaccatctctgccctcttctccacttcccccatctcacccccaagctcggcgcaacctctctcgacgtgctaatggcggcggcggcggcggacttcgcggcgagcaagcgggccatggcctacgcgctctgcaagcacctcagcctcgatccggtgattccccgactctctagccataaaaccgtggatttctgttctggtcgcttcgaagcaaaagctttctcctgctattgttgttgtttagtgctgtcgttgtgcaggctaaaggccgattttcttatatttccgtgttgaggtcttggttgttgaagttcttcggggggattagttcactcgtagtagtagtatttagtatttgatagactcgtgaggtgaatctcataatgcgattgtattgtgctgtcggatttagggtatggttacttcaagcgtatagtacgtagttggggagtcgaaagatatgcagttatctgctgtacaattgttcgatttgtggcaggccgtgaattgatgggagcagtagtggattttttgcatcatatactatatccactatgcaaaccatgagtccaggattgaacaggatcgtccttgctgttgattagcttcgtgcttctctagttctcttaattactctaagcagtgcaattagatgattaatctagttagcttccaatgtttttggctgctgcctgccacatagtactatgtcacagtctataccttgtaaattgtaacagttactctaatactccaatagaatcaatgtgcaaacgcttttaccaaatgcaacatatgcccttgtagtcagctcttaattaagtagcttgctaccttagttcacatagtgcctactctatttctttaactggtgcctggtcatggacttgatactcctgaaatctgacttgaatatttgactggtgtacaaggcacaacgtttgttgtattgctacactgttggcccacttatatgcacttcacagttcaccgttcattactagttcatttggacaaactttgcctggctcactcttataaatctccaattgcacaattgagttctacctgggctggaagcttctactaatttctgcgctgaatattacagaatacaatatccagtacaagtattgaagagagtgatattgccaccctgttctcacatattgtgaaatcgagtgaagatgaggtaactgtttttccacgcatgtacactaataacacgtagtactacttatatattgacagatttcttcactgataggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtggtaagtatgatgtgattactcatttgtatgaccaccatcaatggtcattcataaaagcagaagttctgagattttaaccttttactgcttgtttcagagtcatcttggtgaaaacgagttgcagaaatatccacatgtattgcggtggatggactatatccaggttcgaaataaaactttatttattttgtactatcatactttgttagtatcttttttcatactacctccgtgccataatataagcacatctagcatttgaaatttgttccaaaatataagcacgtctagagtactaattcactcaccaaccaccctaatttatgaggggcatcatagtcttttctgcttaaccttagtctttgctagaaaacctagatttgcttatattttggaatggaagtagtagtttgttgctatatgttgtcaacatgaagtacatgtgcccttcattctggataaaataaccaaacgcatatagtttttttaccgtttctcttgacagtcccctatgttgctttctgtggtataccagcactgaggtgaatgcacataccatgttttttttccttgtttgttgcctggtcttattaccagtttgttcatactttataccttaataatcagacccatattaccattttatttttacatcttatgtgagtacttactgattgacgcagaacatcgttgattttggcacaacagtacaaaaggttaacttgaccaaatctgtcttcgatccaccttctgtaagtaaagatcctttcccaatgtgggctagaagtattacattttgggggtacacatattcttgaattcctttgttgtatactttcagatgttataagagacagagttgaagaaaattaactctgtcaacttaatgcaacctactgtgtttaaatacaattttgtgcttggtctgaaaatacctgtacatgttcatatcagtttatgtttaggatctggttgatataaaacctttgtaagaactactgacataatctgtggaagtgccatagtgctgggaagaaatataaatatcaacaatttttgtaaaataatcatacagtatttcctgttcagtatgctatttgaataaacaaatttgttgaggagtaattgtacaatttcctatttctgtgtgacagcatccaaagaaggcagataaaggtgacactgatccaagttcaaagaaagttgtttcaggacagaagaatgtgggcaaatcggatgcaaatgttgattccaagaaagctgcaccagaggtagttcattatgcaattatgccaattatcactagtactttgcagttctggattagtatgatattatctcagagaggtattggtaattcatgttactttgaagatttggctggaattgatattattgcattttcaactcttctctagctgcaattcatgtagggtctcatgtgcaaatgcagaacaaaactctgtggactttatgtccaataaagctctttaatcagcacataaagtattaaaatgctttatgatgtacagatatctgttgtggaagctatttttttcccctttcaagttagttgattagttcctttgttggttgaatcagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacaggtacccataacttttctgcttatgcaacaattcaaaatggttcaacagttgtattgtgctctttgaacaaatattctaactggtctctcttttcagcctcttggttgaggagatagatttgggagatggcaatgtgcatcaagttgttagtgggcttgccaagttcttcagcccagaggaacttgttgtgagtatttaacagcaacaatggacttgaattattcctgttcatttttcttgccatgaaattgtttcatccaagattctgttttctgtaataaacaactgccttttccttcacagaatcggcatgttgtattaatcacgaatgtgaagcctgggaagctgcgagacgtaatgtctgccggattggtatgttctattccataaattatatttatgctcgtgtacaggcaaagcatcttgatatgtgtcaagcagttgatttataaactacatccaacatgtgacaaaagatccatgagcctatgatggaatactagctttaaataggcattgctgtagaccccaaatcattaggtcatgtgtatgctcttgaagtctactgtagtacatctaaaataggcaatgtaacacttctcactgatgaaacaatgaactattttagaagtgaagcctcaccatgtgcttggtatcacttatttagtcatttgtgttctttctccagtcttagaaatggtaggaatataaactttaagttaggaagtcctaatttccaaatgttgttttcacattgaacatattgccaggtcttgtgtgcttcaaatcaagatcatacagttgtagagccattgattcctccagaaggagctaagcctggagagcgtatttcatttgcagggtaagaattatgttgtatagatgtgatatctgcattaaaattttaaaaaacgtgtttgtgcagttctggggagcatgttctgttcaatttgacctatttgcattcatggctttaaagtcagcttgcacaagcttatatgcaattactgtcttttagattgttatacaagttgtcccctaatatgttggtcgtaagggaagtccaaacaggatggacccatgttgtgtgatgatctttctgtcgtctttcaaggaaaataatattttagcgtagttagcatttcggttgttattagtagtgtcttgtgctgtagaaattatttgattgtgtttggtgtcctgcaccgtttgtgaagaaaaaaaatgtttataactgtccacctttcagttcagttaaattacttatccttcacatataggtttgatgggaagccagaagatgttcttaatccgaagaagaaacagctcgacaagatcacaccggtatgcttttaccaatgcgctatttttgcatgatgctctaagttatttttcccttttagcaatcacatgattagtctgcccttccagcacaatctgggtgaattaaatcagttgtcatttcttttgcacatctgggtgtcattttttacattgccttaacaaattcaataattaaatacagacaattcacaaatcgtgtttgctatgcgctgagtgctcttgaaggctgttgtgtatccatttgtatatatactgcatgaatcaaccaataattaaattttatcatgcacccaggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtcaatttctctttaccatttagacatttaattcaaattaatcaatgcaattctaatcggcaaaatcaaagtaattgctggtagctgttctcaggagcaataccttgcttctttcgagggttagcatgaggccatgagtatcgatttctttcttgtggagttctttttgcctgccttccgtcttatgtctcacatgcaacagcttggcataagcaatgtatgtcatttgagtctttttctttgtatccatcgtgctgacattgctccatgaggagggcaaatgcccctcctggagaagctttgattgcggtaatcaataaaggaatcgattgaaatctgtgtggttgaaatgaaactgggtatgtatctgaaaaagaaagttcaggctgggctcatagttgagattcaatcggttaggtattctagtgtttcagattcagggaaaaaaaacagctataacatccacagggcttcttacggttttgttttggtctgcccccacacgtcagtgcctgccactgcatcagcagtacacagtcgacaatctctactgtaggagacgtgtgctagcttatgcttatgtgatcttttaacttgttgaagcaatcagcattgggcatggtcaccttaaagtatacctttgtcctttgagcaaagagatggagtgcatataattatgagcaaaagagatacatctaattgtgatctttgggtgttttcaagcaaccatccatttgcccccacgttaattctcgctttggccctcgtgccctgcgcttatatgcatatcacctggactatttactgatataaattgaacggccaaaaaaaaatatactgtagcttcactgcatttttcttgctcgatgtagaggatccgattcgagagtgaaatactgttactacaccaatggacggcgcatattttcttgccgcgagcacaaggccaaaggtttgattgacagaacgtccactttaaaaaacctggttgaaacagctgaaaacgaaacgaattccagcccaccaaacacaattacacaaacacctccgagagctcagaaaccgaaagccccctcacacgaaaaccccaccaaactcttcttcttcttcttcccccattttcctcgcgttcccctcgtgcccgccggcttcgccgtcgggttcccgccggcgatcgcccgctttcccgaggggcgcagccgcggagcggcccacccccccc

SEQ ID NO: 778 - DNA, 1649 bp, Oryza sativa
tattcctcttgttactgtcaatccgatctgtgtggttttatttggttgactagttttttttcccctcccattttctgtgcgtgatgcgcggatgacataatctcggtgtgcttttacaattttttgctgcgtcaagtgatttttgtctgactatttcgaagcgtaaatacgtaatgcataccaaacagttttgcctaatgttaatgcgctttttgagatgccaaatgtcttgatcagttcattgcgctaaataaatcccatgtttgactaatgtcggtgcgtttcgtcagggttttgaactgagttcttgtggcaaattccttgtttattctgttgctaaattgtggtgcttaaaacatttgtctagagttcacaacttatgtggttgagtttgcctgaattcaggtgggctcagaatcgggtgatgacaaggaaaaagggaagggtgagatgaagcctgaggaagctcaagaagtgtggaaggagatgcttaagcagttcaaggatgaggcgcagcgaatgcacggcctgacattgcaggcgtatggtgtctactcccagagggcaagggaggtgctattagaggcctcagagaagctgaagatccacgcagacaaagcacagaaggatctcagcgtgattgccacagaggttggtgaggagggacaggagtatctaaaactcgcggctcaaaactcgccagactcaattaaggatattatcgagacattcaattctcttggcaagttgaagatatcagagtatgaggattatcacgtgggcattccctttggtaactaaaatgcattacatatttttctttgtagaatttccgttgataattaatttgatactggggaattgacaaacacgtaataaaccgagaaagtgtgtcattcgttgtgtaggcactttaatgctgccttgttatgtaggttctcaactttagttcatggacctgccctgttttttgtaggtacctttcttaccgtaggaggtttcctgaacttcatgcttactgggaggacatctgcaattcgttttggtattattcttggctttgcgctgttagctatgggcatctcaagtttgagatctcaaagagcaggtggccgtcgtcctcgtcttctgctgaaaggacaagctggttagttcatttcttctgtcttttcttctcttcagtttgtatgcccttttcataatttaagtggcataagagtagcatagctggtctcttgtgttgatccttgatactcatgttctctgtttttatgtgacatgtctagttactggatatatccatattagttcaagttaaatcaaacagggatgacaagtatgaatatttcagacttctagctattatctaattggaaattaagaattcatcatcattttacattgaaaaatgaacccatgatttagcttgctgaaccaagtcattggattgttgtccttttacattgcaaatttattgacatatttgactttcatgcagcaattgcaagtgtcatcttcttcagggaattattaattttcttccacgtatgatttctttctttgccttcaattgcattgctaaattctaatattcatacttgttctcaccaccataatttagaattaacctttttttatttgttatatgg

SEQ ID NO: 779 - DNA, 4472 bp, Oryza sativa
  unsure (1)..(4472): unsure at all n locations
nnnnnnnnnnnnnnnnnnnnnnnnnnnnnnnnnnnnnnnnnnnnnnnnnnnnnnnnnncagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttatgcgggaggaggcgctcgagggggtcgaaagatccgcgacttccccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcaaggcggagggcgcggcgagcggcggccgttgcccgccgttcgtccgccattccctcgtcaatgcctccgacccaagaaaatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagccccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaagccatgaagcgagagcttctggccgcggcccctacccatgagncnatncggcgtgcgtggtggtcgaaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgcttcgcgcatccccaccctgtgtcgactcgacccgggagagagcagggaggagaggcccccgagccgaacggtggcccaaggcccccgacggccggagctggccctccggccgcttgtcgaaggtgccaggcgcccccgacccccggga

SEQ ID NO: 780 - DNA, 2433 bp, Oryza sativa
taaagtgcattcctcgggaacaaggtgtttagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagcgggcccaggccctacagacaatacctttttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcgaaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccgcccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctc

SEQ ID NO: 781 - DNA, 5156 bp, Oryza sativa
cccggacggcctcctgggcagcctcctcggcttcccgaaggcgatccgcggcttctcgccggtcagtttcccgtctccgggcctccgcggtcgccgtattctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcatgacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgcccgccccctcggggaggagatggggagggggtaccctcttgctttctcttccctcgggcgtcggcagggcggctgccccccgggcccctgtcacggggcccaaaagcacgaccccctcctggggtagattgttctcccctgcggcttccgcccgcgccatcgtggcctcgaggagcccggtcctccgacgccccgaccgccatcatgatggtcaggatgttggcacgatctggatcgctgcaaagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcacaatccggcgaaaaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttttgccgcgccaccaaccatccatcgctgacgcttccaacccaactgaattcaaacgaagcgaacaacacgacccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacacacttatagattcttttgagcagccaggcgaattaattgatcgccacatgtttgaaaccatccataaagttaagccttatcagttggagaaaccaaagttaagctg

SEQ ID NO: 782 - DNA, 1021 bp, Oryza sativa
atgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattccttgggaacaaggcgtcgagcttcttgccg

SEQ ID NO: 783 - DNA, 249 bp, Oryza sativa
atattttaaattagtgtctaaatatagagaataaagttaagtccctggatccaaacaccacctgaatggcccgtgctgccctaccacgtgcccgcgtgttggcatcgtgccagaggctctgaccgcctgtggcggcagcagcagcagccgcagcgacggacggacggatgggatcgtcgtcgaggctcgtttcgtgcagctctcgcgtgaccgtcagttgggagcccggttctcgtcgacgttttttag

SEQ ID NO: 784 - DNA, 1166 bp, Oryza sativa
agggtgtggctcatttgtcaataagagaaaggaggtgggtaggattgattagtccgttagtttctgaggtgtaaaactgacccaaatcttatgggattacgaaccatcccatgatccgatgtcacttattcttaaatcaaacaacttgaaaaatggattcgcctcatctcaatctattccgttctttcaaccaaacacatactaaatctaattacagttgatcataagcatttcatacaatatgcgaatttaccttggttgtgtggtttttggtagaggcggattatgtgaaccacttccatcataaataagttaaaaataccatataatataaattttaaatccaatttttgctcgtcaaaatttttaccaccgacattagcatgtacagtactcccttcgtctataaatgatggtattaacatgcgaagtgtttcttttgtccgtaaatattaggggttctaggttatttaacagtagtatagtattgagctggggtgaaattgtcctataggtttaccagattagtaaagataacgccaactatgcaaataaaattgagcaacaaatgtaatggttggatgaattggaaaagtaataatgtaggatccgttatattataggcaaaatttaaacatcaaataatttaattatttgtagatagagggagtataatagaaccaggtctcacattgaaggcattgaactattcacgccatgcgctgaagaggccatgactgtttggaagatggagagagagcgaggagcaagcatgtggtgagtacaccaaaacggaccacaaaatcttgccgtgatggcgactgaagcccagggaactcatctgcaggtcgcacccaaacaaaaagagattcatcatgcacgaatggaacaccacgcctactcgtctgaagagaatctctcgtagcagtagggcgctgcaaaatcttcttcatccatccaaccgcctcgatcatcagagacaccatcatgcatttcgtggttgttacagcactggttaatgacggttggaaggaaggttttctttgccccggtcggtggttgtccatgattgtcgaggagaatcgtgctcttcgctcgcttaaacatctcatcaattgcgttagctagggcacgctcaatcatacgagaaaaaagcaatttgcaag

SEQ ID NO: 785 - DNA, 1460 bp, Oryza sativa
ggaaggaagaaaaggggcttgccccttgcctctttgggaaaagaaagagggagagagggcgatgaggcagatgaaggaggagctctgcctccattccttggaagcatgcacgcggagtggcggggccaggtcgatgacgacggcgatgacggcggggcggtttggaagggcgcggctacagggcggcagacgcgggctcaggcgcggcaggtgctgacggcgtcggcgattggccggtcggccaccacggtgcgcacgcgcgtgcgggaagcaacggcacggcgatttgggcggcgtcggcaggagagacaacgagagggagcgagagcagagagagatggaggaaaaaaagatagagcgagctctctctctcgctcagtgcccgagcggcgcacgtgcctcgcacgtgcgggcgaggatggaggggagagaaaagatgggctgagaggaaatgggccggggagaagagatcggcccacaaactcgagggaggcaaaatagacttttcgagaggatttgatttgggacagatttgagattagggtttggattcgacgatggattggggatttgagatctggaatggcgcggacactggacaacaaataaagaaacaatttttgcatttaggatttttaagagatagttttcccactaggcgccacgacggaacgggcgctacggtgtgtatggttccttagtaaagataacaatttcaagtgttttaggggctgcattcttcatttcaagttcctaacccccaatctctcgtttactacatacttcctaaactgcaaaacggtgtgtgatttgtaaaaattttctatagaaaagttactttaaaaatcatattaatctatttttaaatttttaaactaataattaattaatcatgtactaatctccttttctgtgttagacgtgccaatgtttggctgcgaaccacacacccgatgtgtccccactgcctttctccctcttcacccacccaaggtgagtctgacgaaggaaatctgaccgttggattgccctgatcaggtggctgagatttcagaaaatcacctgtagcaaatctgatcagtccattgattacagaaaccatatggaatctgaccctagtcgcgaccgttgatctcccgcttccttctccgcttccgcccgcatctctctccacgacgtctttataaccccacccccaccccgcgtcccacccaggctttccattcctctccttccttcatcttccctctcgccgtgccatgcaagcagcgccgccgccgccgccgccaatggacgtactcgaccacgccccgccgtccccgctctccttcgacattttgccccacttcccttcctccctcgccgacgccggcgccggcgcgctggacctgtcctttacctccaccgccttcgcctccaccttcttcttcaccaccggcaccaccttcagcgcgcggagc

SEQ ID NO: 786 - DNA, 29987 bp, Oryza sativa
  unsure (1)..(29987): unsure at all n locations
cttcgtgtaccgcgacctcaagccggagaacgtcctgctccgcggcgacggccacgtcgtgctctctgacttcgacctcgcgctcccggcgtccgtggagcccgccgtccgccgccgccaggttcggaaactgagccggcgcaagaatagaatcgtgccgtcctgcttctccgccaatggcggcagcggcgacgacggcgacgaggttaacgcgaaggaacagttcgagttcgtcgccgagccgacgacggcgaactcaaaggactgtgtgggcacgcacgagtacctcgcgccggagctcgtgagcgggagcggccacggcaacggcgtcgactggtgggccttcggcgtcttcctctacgagctcgtgtacggtcgcacgccgttcaaggggcacgccaaggacgccacgctcaagaacatcctcgccaagcaggtcacgtacccgcagctcgacggcgaggccgacgccgcgcagctgcgcgacctcatcggcaggctgctcgagagggacccgcggcggcgcatgggctccgcgcgcggcgccgccgagatcaagaggcacccgttcttcgccggcgtggactgggcgctcatacggtgcgtggcgccgccggtggtgcccgacaaggactcggcggccgccggcgccggcgacaagaaggcgaagctggggagctggaacagcatgggaggcaagaagcgcagcagcttcgggaggaaatcgaattacgaggaaaggcagggggttttccgcaaactgatgagctggagtcaagacagccgatccaagaaggcaaagacgaacaaagtcaagctataaatttgcaccctttttgtgagatttgcttcccttttgggtttcgtttgcaaggtttttgtttaattagctaggattaatttgttacttttgtatagtgtgtggtgtggattatgagttgtgaggaggcgctttgtacaaagatcgaggcgatgtatgtcactgcgttgacatggtttgatccatgttcatatatggagaaacttcatcccttgtttcagtcaactactcgattccttctaatggtctcaattagcttatttgtaatgaactctgctgaatgagtggttgagcttgatttcgtttcagatttttatcggagacttcagaaaacaggggcacacaatgctttgccctttcatcttataaacataagattctatgtggaaattaaattagagtactagttccagttctgacagattagctctgtgcgttgttacgttcctttagaatcttatgattcttttctcttttgtttttgattttgaaagagaattattattttctcttgaacaatgcaatgaacagaaacgtgggattcaaccattaatttctttctccaacatttcccaatcgaacatttggtcttgcttagctggctaggctacattatcacctcaattgaaagagttctgcattaattatgttcaaattatattattaactcctaagtaaatcccttcttgcactcagaagtctaaacataaatttacaaacacagtagatcattggccagaatttcacaaattaatagcaggacttctgatatgtagcatgttgcccatctcctgtcacctgctcacaatggccgtagcagggagcattcgaggcagaaaacgccggagccagtaactctgaagctactcattctaaaatataacaatatggtatggaataatacgcatgttagtgctataaatctagatagatcttatgtttaattcgtcatattaaaatcgatgcatcacatctcatactatatattgttatattttgagacgaatgtagcaatatttacgtgtgtgacaactgacaactgacaaatcctcacctcgaccgatcgagatgaaacaacaccccatactgatgaataccgatgctggtccgaacccagaagctacatataatacacacacttcatcaaactcctccaatcgctggctcctctcctgttacatgatgtgcatgcatgatgcatcgatcttacatattcttatccaatcattggggacggcaactgctcgtgcatgaacgtatgcctgcatccacaagtcccgcatttatatccgccatatcccacagcgccatgctcgtgccgcgcccttttaattttcagcctctcgaggtgatcagattttttccacgtaaaataattgcacgtcaatatactaaaagaaagctgtgagttcttagacaacacaattgaccaaacgatcattgtctggcgacagggaagaaaagaaagaaacgaaaaaactgcaaaagtaaaaaacgaatacatagcagcgagatccaccgatcatcagagagatccaccgatcgatcgagctttgccattgcgagtcggtagcaggtagatcgaacacgtagcgtgcgccccggacgcacacggatcgcggagccaggccgcgcgccacgccgccgtgagatttgagagatgccgctgtgtgcatcagcgcacagtgcgctcgtttggcatgcagcgccgccgtgccacttgccatgccgatttgcttgctgctgtgtgctgggtgcgatgcgagtgcgagagcaagcaatactagtgagctttttgcaaaggcagctgcatatgtactgattttagccaaagcaattaagtggagaggcagatagtaacaaagggagggttcagaaaaggcagaggaaaaggctcaaaaggggattgtttactgcaggggaggcgcgcgcctttgcagcagctgggcgttgttccgtccgctgatgcgctttcccgcacttccatgcgacgatgcactcctcctctttccttttcgctcgcctcgcctgaagagaggcatgccatgctcggctagctgaagaaggttcatgcgagtcagttgagctcgatcgcaatggtcagtggaaacgtcgtcaggctgagtgcatcgtcgtatcagaggaggcgacgagttgtcaacttggcatcgcaaattattcgcaatccctgaagagaaagggattttgcactcgtactactgttaaccgatccggcggggaaaagaaaaacaagtagtagtactgtttaacagtacgttgttgaagggctgtgaatcgtcctgttggtctgttggagccgggactgacaagaactgcgccagatgcgccacggctgaccatgttcagagaacagtcgtcgtcggtgcaccaatgtgaacaaggggaagatgtaataacaaaccaatcacaactgttcacacttgtttggaaatctctgctcattggaacacttaaaatacagcctgcagcctgcaggtatatacctcccatgcatatgtagcacgaatacatgcaaactctgaagaattgctggtgcatgcatgcatgcatgcatacgcctacacttcaacaggtacatccattcacacacacatcgaattccaccaatgcaggaggatgctgcagcctgcctgccgagcacgatgcatcacccacaccctcaaacgcaataatcgagagcggggcagattcaaccgccgtgccggccaggccagcttcgggcagcggatcgatcgctagctcccatggatggatcgatggatcggcaggcacgagacacggccggcgacgcgtcacatgcgccgatgcgaaacccctcacaccacaccacctccccggttttcgttagtactatttttctcaagtcttccctacggcgtgctgctaatcatacgaccctctcattgacgtcgccttaattaatcaaatatttattttgtaattaattaatcaaataattcttttttttctatagcatcgagcagagaaagatggagcaacacagactattattatttgtttctttaccagagactaatcaatgtatgatcattcattgatttatctctcacctaatatatatatatataggttattgcgagaacgtatgccctcgtcctcctcgtggtatctcagcttggacgaggcagatcagcagtcagctagcagctagctcaccatctgcaggtgcgtggtgaattaatgcgtgcgtaagctagccacggatgcattgcatgagtgaatggatggcaatggcatgggagagagaacgatcgatcgatcgatcgagatgctccaaaacgtgaccatgttggcgatccggggaatagttagggccagcctagatctgatcatcagtagttcagtactccgagatcactgtgcattgttcggcaagggagagataaggaattaaaagactttgaatttaaaggcgaatttgggtgatcaaaaagaggaacacactaagctttattccgggctcaagaagggactggcctgctcggcgtgacgacgtgcactttgtttcagcaacaaaaaacgcacaggatgaacattctcattctgccccttttttccctcttacttttcttgcatcccctttctctgaaccccaaaaatgtctttgccggcagcagcagcatattcgcttggccttttttagcctgatgccgatgcttgatacataccctcccttctagcttaaaaaccacatgacttaattataactttattaaatcgtcttaaccacatgagatatcacgattcacatggataagaagtaacagaactgactgcatatatgaatactcttttggttctctgaaattactgtattatgcagtacatactttttgggaaatggcaaaatattgtttcagagggtcactggaattcagtgctggagccgccgtccatgtatatgctggttgttcaagagcacagtaatacaaagcattaatcagttaaactaattctgaaccgttaggcacgaggccggccggggcgctaccgtataattcagagtgcattatgatattgtagtttatcggctcccctctcagggaagcgctacatgcaggttaactaacgctgctgttgtcattaagcatgaggacactatgatctgagaagagattcccctaattgacattggactaatcatttctcatgggactgttgcaagttggtataaagaaaacggggcttgtctttgcatagaacagcagcaggacgtgctgcgttgtgtgggttggttggatgttctatctagctcgctgggctgttaattaatttactgcagtttggtaaatcagctatatatatatgactgaattgcatttcttatacaattatagcacttgcattatatgtatttggttgatatccactgttgtaatttgaacacacatggagcaatcaaatattatgtagtttttgttttcaacaacagacagggtaattttgtatagcctgagtgcaaatacaatgaaatgtgcaatgaacctatgactagctatcatcagtttggtcatacagaaactatacgcatcaatttttaatactgtagttgtgggaggctttggctcttactgaaacttgtatgagctgaagttttcagttgcagctggtttgcttgtccctcattaacaaccagcagtttggccctctcagaattggacgattagttgataatcagcaagtgcatgctaactgatcgccaacattattagttttcactcaagtatatttatatttatataagtgcgttgagtgagctatagcaaaatgattagtctgcatgctgcaacccaaccacaagtgtactattatgctgcacagatagaatcgacgttgacatctatcgattccctgataaaaaaataaattgtatttttggacgccaggatcgtacgtacatttaactggctctctaggaaacgattccttgaaacgctctaaaaaattggaagtagtaataaatcagtggaaaatacgtactaggagctaatgcgcaatgcagcggcaacggtttcagcccaggctaagatatgggccacaggccggtccggtccggcatatggaaacgcgaagcactgaacgggtcgcgcctcttgccgtccgcgactccaccggcgacgagccgcgcgcgtacgggagaatccttgtgtttcgcgtgacgaagcgcgggtgcgacggcggacggcccgcggggagagcggacgccgccacgcgccacgcgagaccgggggcagggggcagcgtgtagccgtgcgacggccagcgccggcgcggcgctgggagagagatctcgagccacggcttctcctcccccaacactggcagtggctgcagtgcagtgccggatggatggctactcccctcgatgtgtaatgccgtgatgatgagggcgctgacctgtggggtaagtaccgcgcgatgcggcgatagcaacttagcaagcacacctcaggcaaggtcgtgcgcgcaccggcctaagtttgggaagagggcaccgctcgctagccaaggtcgtggaggaaccgatgatggactaattaggcttaataaattcgtctcgcggtttccaggcgagttaagaaattagttttttcattcgtgtccgaaaactccttctaacatccggtcaaacatccgatgtgacacaaaaaaattttcttttttaaactaaacacaccctaagtttcaagtttaggaagatgttgactgttgagcaaagatgtaatcgtattcatgggtacagtacaggggccggatttctatcagataatgccaatactacggctgtgttctcccccctcctttcccaacccactctgttttttcgcgtgcacgttttccaaattgttaaataatgtgtttgttgcaaaaactttctatattaaagttgttataaaaaatcatattaatccattttttaaaaaaatagtaatacttaattaattatgcgctaatgaatcgcttttttttttacggttagcgggattagttcccaaccctatgaaaagaccacagctacatatatataagtaaacccataatcaatgtggaatcaagaccccgtttgacatagctgcagctcccaattccaatttacctagagctagagttatgccaaacggtatatattgttcattttttgagcgaagttagtagagctgctccacagatttgtactacagggacggagctgggtttttgttgctccatagctccactccaccctaaaagaccgactaccctttaactttttagtatatttacaccaaaatgccactgaactatcccttcctaccccatctcctcacgttctctctcctccatcttcctcggtagacaccggcgaccgacggcgagcgggtggctacaaaggacgtggtggctacggggcgggcggcggcgacgcgcaggctgagtagcgccggcgacaacaccaagtgttcgacaaaatgccaacaaaggacgtggtggcgtggagctaaccaatctagccaaacattttcatgcccacttctttctcattggattcagagtttagagttgagaattaaagtttggagccctaccaaacggggcttactaggtctgtacattacattttcccattaaggctatcttcgtcagcttgagttgtggttacgatagtcaacgacaacagatccagatcctccgactttaggcgttaaagccagagacacaataaaatgagtctaacgccacagtgcaaaaacagtgatgttgtagttgtttcctgtgacaatagtttgaaacagtaaattatggtatgttcactttgatgctaaaagaaaaaccttaccaaattttagcaattttggcataaaattttggtaacttgccaaaattttgacaggatttcttatatagttaccaaaatttggcggcaaattaaatatagccactttttttgcaactttaccaaaatttagtaaggttgaaaatagcattaataccatactactgtttttcagtactgtagcgattgatctttcgttcgctataaatcaaacagctgaaaatactagtcaggggatctcaatccaacggcaacagtgccataggcattctaaaaggctgtgtggccacagccttggtcttacgaacaccacctacaccccctaattatccatctcgacacatgcgtatgaacaatttcacatcatcgtacatcaatcaaacatgcagctgacattccaaaataaaatatgcagtcaattagataacgttctacatgttaaaataaaggtggcgcacgttagatcaaaataaataaaatatggctcacaaacacaaggaataaaatagaatattcattcaattagataacgttctacatgttaaaataaagatggcgcacgttagatcaaaatagaagtgctacgacagttttacggtaaggcattagcagatcaaacacgtacctctccttgctcgacctccaacacattagacctccaacctctccttgctcgacctccaacgtattagcagatcaaacacgcacctctccttgcgcgacctccgtggaattttatctcgtcaagggggcatgtgcattaactgtatcgttccattgtcatacggaattacgaaactggaaaatagcacgatttgtatgtctccgtgtgttgtttagtacaatgtagaaaatagtaatatttctgcacaggaaattatctcacagtatattagcagaaagtaatcagcctgatcggaagtgctggctgcagcagcgcagctgtagtcagtcagccccaatccaaaccaaagagtatttgctgcagcagccagcacaaccgatcaagcccaatgccaacaagagaattgcggaaccacaaccgcacaactgccacctgcatatatcatgcacaagcagtgagtttgtggaacgaagaagagctacaaattagaaatgaagacatgattgaggcaattcagagaacttcgtaactgtcatctgcaaaatctagagacggttttgagtttttccattgatatgcgaatcagagaaagggcatcatacttcaaatacataaaatccagttgattgtcaataaacccatgggacagaatggtacatgtgtcatctgaaagcatgtcagttttcaccgctttgcgtaggctatgatgttaagttcacttctactttcagcttcacctgcatatgcatcatgggtttaaagattggataggtaagttcaccatgaacataatagattacgagagactgaagcaaaaatgttgcacagacaagacgtttaaagattaaactgatggttaatgatcacaatgagataatggtataagttcccacgaaatgaaaactatatttgatgcaacaaacatacaaacaagtagatagatataacatcacaagcaggacaaataatataaattcaccaattacaagagattagagcagctggaattaaaagaaacaaggtctaaagagaactgagcactagaagtaaaataaaatacacaacaccaccaatattaatatatagatctacgcactcagtccttgcaaatatgacaaccacaacattattatgataaatttgttctcatcatttggcaaaataatcatagagaattcccatggagcaaaccctacaagcaacattacagggagagccaagccaagggtgcacactaacaaccagatagaaattatggttttgctaaaacatggacacgcatggcattatccttcaatattttgttcctcctctcaccagaccttttggtcccaactcactacaatcactctgcaggagaagcatcaattgccctccatcccttgctgctattgcctcccgcagaagcttattctgatctgtggaagcttgtagatgctctttcaactctctttcttcacgttctagttcacggatttccacatccctcccgctttgggttgagctactcacactggtgttgtttggagcattggcgaggaagcgatttgccacagagctgacagatgggtagccaaatgagaaaatcccgccattggcattgggagagacaaaaacaacagcaaccatcacgccacagaggatagcgagctcattggccttgttgaagatggtagtgtggcgcttggaaaagcatgcatctcgtaccttcttgtccccgcgcttgatctcaatctttttcctagtcgtgcgtgccctacacttcaccatctcctagctggtaactagcacagcttgcctatgtatcagcgaaagaatggtgtgcagcgattgtacatgatgagcagtgagctgaggttacatggaaggttatatagagagaaagtgaagcatggggttcaattggtacatattaatgagcctttgtgatagataacattgaaaaaatgaattgttataaggttttaatccatgaatttacaatatacttagttttggatatataacagtgaaaacacagttagaaggttttaatccgtgaatttgcaaggtacttagttttggatagataacagtgaaaacatggactattagaaggttttaattcgtgaatttacgagatacttagttttagatagataaaggtgaagacatgaattattagaagattttaatccgaggatttatgagatacttaggccctctttgtttaggcttaggcttattggcctagacttttaagtcagcttattggcttatatgatttataagccagtggatttaatgtcctaagtttaatggtagagtcatacatctatctcatataagccaaaaaaaagcttctccaacctagcttttggcttaatagtgttagagtggcttatggcttaaaaaagccaaatgaaaaagctgcttgtttgttttggcttagacttttcgacttataagttggcttataagcctaaacaaagagggccttagttttgtatagataatggttggactgttgaaaggtttaatctgtgcatttatgagatacttaacaaattcaagatttgatggtattaccaaaacaaaaaaaattttatgaaattgttgctatttgtggtaaggaattttggatagatctgtatgagttcaggatgataacaatggaaaccaaatttgaactattagttcctcacccaaaaaaaaaaagaaaaaaaaagaagagaacttcctctgtttcatattataagtcattttgacttttttttcctagtcaaactttttaagtttgaccgagtgtatagaaaaatatggcaacattttcaccacaaaacaaacatattatcaaaatatattcaatgttataataaaactaatttggtcttgtagatgttgctattttttttctataaacttggtcaaacctaaaaaagtttgactagaaaaaaaaaggcaaaacgacttataatatgaaacagagggagtattagttaggaggtttaactgcatgcatttacgagatagttcgcaaaaatcaagattgatattattgccaaagaaaaaaagattaagtttgatggagctgttgctgattatggttaagcagaagttactgatgccaaaagaagagaaaaacaggcggacatcatcacatgttaaatgcaagatgaaacatacatgtggagtaagacttgccttttttgcaacatccataagcaattggcttctctgttttcaggtttatgtaaccctcattaacaccttaaagttacaatccatcaaggacatcttcggggaaatgtgcattcctccattttaaaaacataaattaggcccaccaattatattctatattactagagcagtaatacagtaaaatccaggcatttatgcatcagtgaataagaaataatgggcttaaaccaatttgcactatggagtaatatgtgccaacataactggaagctgctgaccgaaagggtgcattcaagatattccaaaggaacttagtcaaaagtttatgcatatttgtcatgggcattgggccggaaggcagaggcccataggcagcccagatcaattaagttagagatattattattagttagttagagataagataaattaagtccttacttaggggtcaagttggtaccatctatataaggatggggttgtgtttattatgaattaagcaatgaatatcaattagtctaatctatccctcccaacaatgttcttctccctagacaaaatctgtatcccttctacaggagccgacaccgcccgactatcttcccaacggtgtttatctagtcatggcctcgggtcatgacatatttgatggaaggttattgaccttctcattgttgattctacaaataaccccattacttgtcagcatgcaaatgaagaaccagaaggtgtaagaagtgttaatggattagtgaggaaaatcacaggacaatgtttttttagattgtttgatgggcgcaaaataaaaagagggaactgtatgatgagcaccacaaatgggaactgtatgatgggtgcaacaaaatgcactgtatcatcagaaatgataaacataatccacatttaccagtttaatgttgtgttgcaataattagatcccgttgatgtggttatgggattatggcatcacagggtaatgtctgtggatgtttatcatcatcaaatcgatacaagcaaccattgttcataatatgcacacatgatagaagctcattttaaaataagtgtaaagagagtcagcctaataggcaggtgagtataatactgtggcccaactattgtggtcatgcgtgtccttgaagtgaaattagtaccataatggtatggctgtgaagcactccacatgtgtatgcgaccgacatggggtattatgatctacaaagtttggatcccacggtgttccaatggcaatcaatagctaacatacaagataatcacaaaataagagcaagtttttatattaactcatataagtgctgcaatacctattaataatcagatttgccacttgtcaccctatgacaatgacatttgggaccctctgagttcatgacatgtgggtcaagatggtaaatcatcaaatctccaatctaaagagtggcaaatcatcaaaaaccccttaatgaaaactccacaaattttagtatgctccataaaggctctacaaatatttgaaagaagaattcccttccaaggatttacacattatgatgtccaggaaaatcaacaacagaacattatactttagtcccaagcgagttgtgtatgctgatattcaacaaaattcctaattataaatgtacagtaaatgtataatataatgtgatgcatacaaaaatgtttttcacaagcttagtttgcagatattgaagtttaacagtgagatcaggccatgcctacagcctatgcaactcagtaataaccataaggattgtcctcacacgcatagcaatgtaaaagatttaaagaagctaggatgttcaggaagcttccaacattgatatataacccttcattgcagggctatcagaatcatcaattattgcaagttgctaattactagaatgccaatgacagtttacttaaggctttagaaagaaacaaacgcaaaggagacatgaaaacaagatgacccattactcggggtctcagagagacttcaatcactatgtagcagacttacataaatatgttactgcaaagcaaaactataaatttgttcaaaacttcacgtccaagcagcaactttatagtttaccattaagaagaaattggaattacctagcacgtagaagaactcttggtagacaatgctggctcctcaagaataagaagaactagtactcaagagactctgggtctccaatatattctgcgatctggtcgtatttcactcgtatcatgtcctttgtattggacagctccaccactccggtctcctcctctgaattcttctcaacaaggtgcccacataatcctttgtgctccccagcaagcaaaagcaccagcccattcatccgtggcaggactgtttcgagcatatcctgctctaccccttgcaccagctcagactgatcatccataattatgtcacatgttgtaggtcccacaacatcgagaactctccccttcttcaagtacagcttcttgctcaacctctcactaaccaccctaaccttgatatcgctgtgtaaccaccgcatcttgtcacctccaccaccaccaatcttaacttgtttagtatgtcgagaatttctatccttttcttggacctctctctctgccctccgctcaccggatctcttctggcgggagcttgagtctctatcctctgttctacctctactgtcacggtctctcttcttcgcatttccattctgggtctccttgttcccaccaacaacccattcgccagcgcgagtcttcttagggtcggcctcagagggattgtagcctaacccttgtgtaccggcacggcggtcatattcaacaaccttggtatcccccttattgttcctgccaatacctttaccttccgaccagccgtatccagcaagcagcgcagcaccaaatccctcgacgggcacatcgcggaactcatctaggccgcggtgatcggggagactggccatgtcctccttgtacctccgcagcataaggtcgccgctgggggcaccagctgcaggaggaggcgggggcgtcttttccggctccgccgccttctccaactccgccgcggcgttgcgaacggtgaggccataggcgatgtgggaggaggggttgtcggggcggtgnnacgtgtcgagcacgaaggaggggccgccggcggcgnacgcgncgaggcgngcctcctcctccggggtggggagcgagaagggcttgcgggagcggtggttaaggaagtggccggagttctgtagcggcgcgatgacggacggcgcggccccggtggctagggtttgggtggggtcgaactcggtgacgaactgcggggccggggcgcgcgcggagtactcgccgtcgtcgaatgcgccggcggcgccgtcggtgtcggcggggcggaaggccggcctggccggccgggccttggaggggatggagaaggacagcttcttctcctccatggcggctgcgcgatttggggaaagcaaagcgagggggagatcgagagagagaagggacacgaggaaatcgagcgcgtgtgcacgacggcgaagagaagtctcccgtggacttgttgtcttattcggagtcggtggccgcagcccgcatcggatcaagttgggccgggcccattaacctcttgggcgggcttattctttttttggaaaaagtacaccgaaggtccctcaacttgtcatcgagttacaaaatcgtactctaaccgcaaaaccggatatatgacatcccttaactcacaaaatcgttcactttaggtcctttggtggttttgaacccaggtttgtccgacatggcgactgagtcagcgtgggacccacatgtctatcatcaccatctctctttcccctcctctcccttcatcccctctcttttgtcactttgcttctctctgcacggctgctggcgggtggggaggaggtcgtcgtgccaaggcaggagaggagagccggtagtgggcgacgcggtgcctggcgacgaggcggcggcggcggtggctgcaaggcgggagaggagatccgaggcccagcgacgcggtggcggctgcaaatcgggagaggacatccggcacccagcgaagcggcagtgggcgacaaggcggcggcggcggctacgaggcgagagaggacatctggtgcccgacgatgcagcggcgggcgaggaggcggtggcagcggcgccctcatcttccttgagctccgccacccagcgctcgcccacgacggccgatgcatgcctgtcgggcccatctttggcagcagcagagctccgtcgggccgccgccatgcttgtgcgatgccatgaggtcgttcacctcgccgccgccggggtctccatcctcgaccttgcccacgcggcaatgccctacccttctcccgcgtcgctgccgccatcgacaccaacgccctcccttctcccccgtcatcgcccccctcccccccggcatcatccactgccgcggcgccgccctcctcccgcctcgcagccaccaccgccatggagaagagtgagaaagaggaggaaccgaggaagggagagatgaggagaaagaaagaggagagagggcgatgatgtggccttcctgacatgtgggatccacgctgacttagccgccacgtcggacaaccctggggtcaaaaccaccgaaggacctaaactgaacggtttcgtgagttaagtgatgccatatatccagttttgtggttgggggatgattttgtagcttgatgacaagttaagggacctctggtgtatttttttccttcttttttctctttatcagctatccggatttaagagaattttttgtacacgacctaaaggtcgctacaacggatattatatctctatctcttctatgcttattataaaaattaaaaatgtttttactagtactttcgtaagtcatctgcgtttgagtcgggttttaagtttattcgcttttggaattacatagttttatttgagtaagttgttaaatccatttgcttttagaaatatagaaggagtcatataagaaatctcttaaagaaaactcgcatgctaacttgaaacgatcggactcctaattatagattatgatcttgtaaaaacagtatccaatcaaatttctacagtgaatgtcacattaactaaacagtataataataataaaattaagatagccttcacccgttgcaatgcacgggtatttttttctaggaaaagatacaattaaaagcaaaaagtacaagttcacatcatagttagttgattaagcatataatgtcatatgcaaagaaaaaaaattcacgtgagaccttatggtcctacatatcagtttgtggcgttagaaacaaactcagatattaccactagcatcatttaaagcagtatagatattaagatatagatagtttgacacataatttgcatattgtacttcgcagtttgaaaactattcgctgagtgaaaatgtgtgacttagacaaaaattgttatgattttcattttttggaaaaatgtgagttatctgctggtttgagataatcaggaaatggattgtgggcttgtagaattgtacgggtttctctggaccgcatgaattctgcagacattttaaaaattttagttcagttatgtaaaaatctttccaaattgcccggggggaaaagttgttttgaaattcctgcattccatattccaaaggagactactagtcggcattgaatcaaactttaataattcaaattcaaattgcttatgatgaactgacggcaaacgttcgtagcagtgacaaggaaggcagccatcgacatatggtcattggtagtaaagaggcagtcaaagcgtgtgcttaattagccttcccccaaaacaattgtaaatcaatactcatgtcatgtgtacgcaatcagacgccgctacaggagccgagatcgctacatgatttttcataaactaaactatagcgtacactcaagtcagaacagtgaccacctaataaaactgccacaacagcgaccaggtccacacttagataatcttgcctcaacacgcaatggaaagtagctgaatcatactgaaataataaactctagtttaaactttaattaaaccacatgattcagcccaatggtaactactacccaaagttgtcaaaatctcgactctctcttacgattttacgactttacaattctaattaaggtgcttgattctacgattctatataggtagaatctacgattttacgatttttttatgtatgattccaagattgtgatactactaagaacttctgattccgattcaggatcgcgattttagtaaccttgctattaccatgtcccaagagaggatgaaagataatgtttcacaccagtgaatgaaatcattttgtattagtatcattgaaaaattttggaggaatttttgcaagaatgaactatttttttaaaaaaaaaatcctacagaattgttgtgtttcaaaggagccccaaaagttggagtttgattagtgtacatccgatgcaccttcagttactcccaaagcgcatggcaccatcagaactttatatgcacatggttgtaaagccaagggaaagagttggaagacaaggatgctacaagcatgagccgtcctgctcctgcacaattgtagccacagccactagcttctgaaagtgacaagatgctagtgtcaatcaactatatccttaagcttgcttccaatgcacgatgaactcattgattttgtacaataatcttgaccagagacccattccagttcgttggcctgatcaccggtacctaatcatgctcgaggggaagtctgaaggcgttatgcagatgactctttccttcagacctttcttataaaaagcaacgaccttttctttcgaaattcagacaatgcacgaggctaaaaaagctgggattccatatagccaagtcaaacactttgttcattgcagatcgaattgtagggccaaatactatgcgacaaaagtacatttactatcacttctaaaactcattgtcgccacccttcaatttcatttcatcagaatcagattctctgcagtccttgcatcagtttactgcagtgagtatgtacttatgtgctgttcttgcattggctcaaatcgcaaccaggtgagacatcaggtgaaagctccaaccacgctccaaccacttcggctcaaactggtgaaggattgattgatgacaagctgacaacgagaaagagcataaggaaacaattctcagagaggaagcctccaagaactggctcgcagaagccatcagttgtgatgtccttgcttgatcaaacttgacatgtcctgaaccaccacattgtcactgcatcattgccggttgtcccattcacttctcatggcaccattctcatctgccaaaatggtggcactctgacctaacctaagggtactaacccggacatgcttatgccaaatcggaggttcaaactaattataccccaaaagtgtagtacacgtgcctaattcgaagctgaatatctaatgtgtgctataatcaggaagctgctctcaaacaccctatcgaaaaatggaaaagaaactctgaagattcatcagaaaaagttcagaatggcttcagaaaacttgtccaagaattgacaaatttgtttcagagaacttatatataagcatgaaaaaaaaatacaactgtggtttctcattgtgtgaatcattgtacaaatgaacaaaaggtgagctaagaaatggtttcctttttctttttacagattttttttttctgacgagtagtagtatcatacagcgctatggcagaggcttgatttccattgagattgtctcgtctccaaccatgccaagaatctgtagaccttgccgaagacgctgaggaagacgaggccggcgacgaggctgtacgccagcacggcgacggcgccgccctcgatggcgacccagccgacgaggtagacggcgtcggccgccacgaacacccagccgggggcctccagcgccgaccgcgtccacgcgctgagccgctcctcgccgtaaatccggcacaccatccgcgagcacagcgcgaagatgatcgccagcgccgtcttggagaggccgcggtaccgcaccgccgtgccgccgacgacgaggggctccatgcggcagaggcaggtcgcgcactcgccggaaaactgcgaccaccggagcgcctccagccccgtgtagtaggggagcacgacggcgtcgaggtacaggctggcgtgcagcacgccggagacggtggacgcctccagcaccgcgtaccggatgtcgccgtcggcctcgttccggaacgccagcgccgacgcctgcagcagcagcagcaatgccgggccgagctgcgcgagcgggaacacggcgttgatccgctgccccttggcgagcacgagcagcaccagcggcagcaggaacggccccgacgggagcaggtacttcctcctgatccccctcaccccgcccgcgccgccgccgccgccgccgctcctcgccaggtcgagcaccgtgaacgcgagcgtcgagaggaagcagtacgcggcgaaggcggcgacgagcacgccgacggcggcgtggtagtcgcccgggtacgagctgtcgcagtagtagtggtacgggcaggtgacgaagtccgtcgtctcctccagctgccacctcgtgcacttgagtatctgcctcaccacggcttctccgccgccgccgccgccgtcgtgcgccgtccacgccgaccggccggcgccaagaagcggcgcgagcatctggtcatacgacgacatggcagcagctgtctcctcctcctcctcctcctcctcttcttcttcctctgattcttgtcctgtcagctatatgatgcatgcctgcatttggtggctaatgatggcttgtctctctctaccttccaactcctctcctctcctcttcttgctcttcttgttcttggatgttggtgtgctgctcttgttgcttgtgtagggagggagggagttggaattggatagggaaggtttaactggagctctcaactcaagctgatattgccatgattgcccttgctctgaatcttctgaaactctgataaactctgaaacagtgtgcattaccacccttggaagaagattcagtggtggtgcttagtctcttaatggatgattagcctggttaattaatttggggtggtgcaggggtgttttggtcagattgtgtttcatggtttgctgtcatggtggttggaggtgaagagaagactgaaggattgtttgactttgtttgtagtactggattagattggtaggccagcagggaagtagaggagagaagggaacatttgtgttgcagtactagtaccaagctgttagttaaagtttgttgaggatttggtgaggaggaactaattaatccatttcctttgttttgttattcatgttgattggacctgcatgattaacatctagctaagctatatgttcatcttctgattatttcatcttcccaaaaaggtccacactgacagagaatgatggtgctatcatttggattctgaggcatcatctaggtaagtcttttattcaccatgagtgattgagtggtagtactaattaagggttcccttttgttatgacttggtctctagggaattatttggtaggtggctgattagctgaaagccaggtaggccatgatcctggaggtaggaggaaggaggggagtttatggtatcccagtccctgatgtgttgtgctgttcatgtctcttatgagatgctgttgctagtagcacaaaaccacacctctgtgtttttacataaactagccaaattttgtatggtcctagggatttccttgatatttgcataggtgaccccagctgcccacttggaagaagctgtaatatgatttgatatcatatgaaatggatatgggcatgcatcatgtggggagagtagtattacttctttaatgtcaccccctaagctgtgatgttgttctgcttgtcttctctgctgaacatgtgatgacagacacagaggaaatggataggaaataatagtggagaattggcaactgatcaagatattgggcatgctttagggagacattttggtgagaaacacaagcaaccgatctgtttcaggtacttcctggccctctggattgatttgagaaaacttcaagcaactttaataacattttgatgttgaaattagtggcatgtggcaagctaaataagaagaaacatgtcatcgaaaatgaccgtataaaattattgtgaagcatatgctttgcttgcgaagaccgtgaagaatgtttcaacatccgaagcgtcggccaagaacgtagtacgaaggttagtttcttctagttctatcattaatttgagcaggccttgcctgcatcatgcagcagtgactgccaattattccaagctaatatgcatacgtcagtgtgtttactatgcagttgaaaccttcataagtcaatatcaaaacacctttccagaccaatgctgagagatattattaacccatcagaagtcactggtacgcgccaaacttcttcgttaggagtactaactactaacagattacgatgtgtgcctcatcaacagccgtaggtcgtcaccgtctagaagaaacaatgggcctatgagattaaaaagagtgacataattgcttgtgtcaattggtcgtttagagttcagcaaaagaaaaaagaatgatataactattcactggattgttgatgggttttatctacttagttatagggatgaattaaaatattttgaaaaaaaaaacttaacgaataacatacagcaaagtgctcgtagtagaataaagtcttttgagaaaaatgtatttttgaaaacgtgaaagaaataacaccgtagtagttcggtgaataatctgaaaagaatgtgagtagctgtagtctatggacagtaaccctctgtctctctgtgcgtgtttgttacgttgacctgctgattcgacagagatcacaaatcaactatctttttgattcgacgaatcacctaatcctgagatcatttggtcctgacaacgaacataagctttcatgttcttagccccataccatacaattttctttgcgagccatgaccgcttcaccgatagaaatcgagagtgaatgagatctttggacaaaatggaatcgacaacacgatgcatccacaggaaagaattgagccccctgaaagatacacccactccttgcattgtgggagcaggtagattaaaatctaaaagctaagctataccagtagtcgtagcttggctccaatcaggcatgctgatctaacagatgaaagcaaccctggtaaaggctgaaccaaatagaggcttgatagtgatcagatggatggattagtagtagtagccatgctaagctctgaacctggctcttgcaattgcagatgagagacaaaagggcaaaaaaagaagaatatgtgtccagcatatacaggtactacggaggagtatgtgcaatgtgagaatggctctggtctatgaatgataaagtaatgaggtgaccgaacctctgaatttgcacgacctttgcaaagcaagtgagaatctgcactgggatttctgatctcattgtggataaaagatgaccaggggtccggaagtggcctgatcattggggacgagttacaaacatgatcatgcaaaagttgacattttacctgcaaactgcgaagtgtcgtttcacttttgaaatgttggtggggcgacgtgtttgaagaaattgaagtacatcttatcggtacagagaacatattgcaatttttttctaatattattattttaattgaaaattgtaaaaatggtggccgcctgttttttttttttttgccaaaatagggccgccctattttagaaaaaaaaaatccgcgcgaccaccattcatacgatgtaccattaaaataataataatcccaaaagaaattcacagattactcttaattctgaaatataggtaacggtagagttgttcaataaacggagcccaagcttttatatatatagagaacgtatttaaaaatccgtacgggccgctatcattaagcttatttttcatcataaaatggtcaggttcttccgaataaaatttccacagaaaaagaacttagcaaacgaagaaactgcacataaatttaggaacacgccttgaaactttttaaaaattaaattaaacctacaactaacccgctaacccaatagttgcaagtgcacatacgtcaactgtatgatttttaaatatgcatgatatatttaacaggtaatacgtaattagagagaactaccaaatctccctaaatttgccaaactcaccttttctgggacgttaacttctaaaaatatttgagtggttaagatgaatgcatctaaaccacggtaaaacacaaatcgctggtcaggggaatgaatggtcaactaaaaattgtactacttgtttttcaagaacttggagattgcttcccgtcagcccgtgtatggcctttttacctctggctctggcttgaaataagtaaaagaattatgaaaggttatcgaatacattttttcaagatatccagagaacatcggacgatccatataaaagaagatttcaaataaaacaggaaccgaactctggtaatcttgctcttgtttctaccattgtttaagcagtgttataaaaattgtgatgtatgcatgtatcttaatggccttcagctgaacaaagtaacattaggtccttccatgctacaccatatttaagataccagaaatgatcagactcagatagttgtgctactggggaagatcaaaactcaaaacttctgtaatcaaaggatgatttctaaatatgagagatgtacacattggataggtaagtgtggaggcatgaaccttacaacaattctgccactgctaactgcttgtttcttgcatccttatgctggtacgtaagattctaacattagttgtacacgatgcggagacacaatctcaacaataaggtatgtgaacttccaactcctgtcattgttatctttgaacatctctgaatacacctttccagctccatgtggtcctcggatatagaagtttacctaaataagatgagtgtgtttcgagtgatcaatcaaattcaaccgtgtgcataaccatgcaaactatatgtcttaatatcaaaacccgtcctaatgccccctttcccaataaacaaagaattgtatcttcacagaatacatgggacaactgagaacatgtttgcattaagcaaggatagaccataaagattacacccgacgatctagttgtaaccaaacaacagtcaagtgcaagagcatacgaagactattacacaaagagcaaagtatcatcgagaaggccattacacgatgatatctacttctaagtattattattggcattgactcaaacagtctttctagtcaagaagcttgtgtgctcatttctcatttcctcttgctatgttatcattcacaatctcccctcagttaaatgaagccattagcccatgccatataaatataataaaatgtcaaggagcatgtgtccatgtcacgcccagaaaaacatttaattctcccattattccacttgattaaattgatttatcttttatttaatttctagaaaatgcattattaaatgttttttttttaatcccgaacgaaaatcggggcgttacagtccacactaaacttgagtggcaaataaatcaacatacttaaaagagacagaacaacagaggcaagaatatatgctacctccacatgttcaacaccgtcctcatctgtccaaaccttgttaggaatgcgctgccgagctgcacgatttctactttcattgccatatccagtaacaggatacccaatttttgctgtaacctgacaaaacgtgtgaaaacatgaagttgtaccaaggggaaaatatgatatgtatgaaggaagtggaatagcactaatgtccacaaacctgactgtcattctgtactcttgctagcgcttttccaaaaatcttgtacctgtagaatggtaacagcagtgcaagctctttcaaattgcatataataatatatgcatttaacataagaaaaagattcgaagcacaaaaagaactttcactaggaagtaacaagaacacccatgccaacttgctaagtgacttgcataggatcaaatcagaaatgtgccatggcactctgctgcagcatacaagaaaaaaaatccatagcttactgattgtttctttaaagtttggcaccgtaagtggctacatgtgagggtcataaacaaacctagaaacatctggattaataaatgtgtgtgtgatattagttttttaaaaaataaataaaaaggaactatttccatattatacaaaatattaacgctacaatgtgaagaaagaccattgcacagtgcatatttgtaggacttaccaaattatcataactggttagacttgaatgtattttactgtcataagccatacaattatgcgagcaactatattattaaagtacctttgatttcattcaaaatggaggcttcctgaggaactggttcatcgtggaatcttaagccatgtgaaaaataggagaggcaggggttggataaaaactgaaatggaagaaagtggtaaaaagaccactgaaggcatggagtgcatccaaagatttgggtttggataggagtacgaggaagttggcgatccaacatccaagtgccagaactacataagaatttacataattctttcaccggtatcattcctagtagtattaggaatatgtggaagttagagatccaacattttggttctcctggctatacttgggtttcacctctagtccacccagcttcctgggactaaagattgtagtacttgttgttgagctaagtgcctaagtcaaaagaattaacaattaatgcagaaaacttactcttttggttcaaatataagttctttgaaaacagcatatccagccactgctgcaattccaagtcccgcaactattacaagactgtaggaagccccttcagcaaatgtcactggcttctcaggtatgttgtaggtaggggaatcaaatggatcttcaacagttttcaggtcttttgtaccctgaggatgaagacatcagtcttttataagcaataaaataagaaatagaaaacaacaaatcaggggggaatgtctgataaaaattacagttcggagcaatgtatatgttgagattacaaggcgacaaatatgtgtcaggtgattagtttgttgatgggaattatgatttaattattctccagcaatacgttgccaactgaaaacctaagaccatagacaagactgccctgccagtaaggaggtatggggcatagagcaaacctgtctcttctacctctattcccttcctctctgcctgggagctgcccttcctctctcttataactccagccagcaaagattgaggaccacattcagtagccaatgccaggagggtggaggtgagaggagcagtgaacgtcttgccatccagttggttgcccagcctaacaagaagcctacccagactgccatgccttgctctgacttggactgcctttggctaattatgcagcctcccagcttagattgctgagcatgggccgctcagggtgactaggtgctactgagtttcttaggtgacacctaggctttgtggtcatcttctttggaattccctttttgtatgaggtagtactatagtctactcttctggcttaagtaaaattacggagcatatttgggtagactgagattatgaacaccagagcacctagcagttaactatgttgatataacgaaaaaacattatatttccgacatatacggaatcacccctatctcatagcaattgaataactcttaacttttttttctaacaagattattcaccaccacattactgagatgatgcccatacattagtcaacaattgatccagcagttccctgaggcaagattcctgacagttttgattgtatgacatgaaaagaagcctactcaagattacacatgtatgcatacaaatgctcactgaggtggcatgcttaatagtgtcatgtattgtacttgataatccgcagtaacatggccaacaacattgatgaaaattgtactcacagaggataaaaaaaagcaggaacaaaatattgaacaatttaaatagcaaaacagacaagctgttgcttacctcttttgggttctgctctgaagcttgtgtggagtaggatgcagaaggcctaactaaatgagtagatactttgtggctttcacgctgtgttgtgagaggacttgaagggtttgacttgatcatgtaccaccttgatttttttaaagatgaggctgcaaagtttcccaaaagaaaattcactcagcactaaataaatatagataagatgttgcaacttgcaaagcattgttggtcaagatccaacaaaaaagaacatgaacgtgagactattaaatgtctgaaaattaataaagttatgatgacttgatgagaccatacagatgagaaacaattttctgtaaatatgaacttcattgaatgtctattgagtattgatctgaggtttaatgcctattgagtattcagcacaatttcgttagagaagccaacaacacaagattcactaatgtctttcatttttgagtaaatagcatactatcattttgcaacaacttaaatcatttcagtctagtaggtttgatgtatgaagagtatgcttgacttagtattacaagggcagtgcattcagtaatgctctctaaaccagtatatgaaagagtacgtacaatatttgaaattagaatatgcaactctctgtcatactatgcttaaaacattaaaaaaacaaaaaataaaatctttgatcagcagataatatatgtttcataaagaaagcatattatatgtcagcaactagcaattcttttgatgtagctgaaaaaatattgcaagaatttgaataaaaaattgtgacaagcagcaggtaggcagataaaataattatatgtagattgtccctaaaagtatgatcaggaaggaaccaaaattgaggtagcagatgaaatttatagggatgcgagtacatttgccaccacactgtgagtttagtgagcattcagatacatctaacatgttattcttatttgcactatcaatttagcttctatgcttatttgcagttaaattaaagcaaagtaagtaacaacatttataacatgtagtgtaggagatgttgtgccactcagcacaagaaacagcggtcatttcttagatgcaataatacccagaacatctttagaaacatggatgcaaccatataagaaaatttgaaacttgcataaatagacacttgatgaacaaagtagagagcttcaggattgaagatgagcttagaccttcagcctttgcaacttcatgctgaaaaaaaaaagacgaaaggtaaaaaaagacatatatgtcacctagagcagaaaacacacaaaaaaaactattagtttatcacacaatgaacagattcaacaatcttcttaaggatctattcagtctcggattaggaacagttaaaagttgaaacaaggtcaggataatggtgtatctatatagaaaataaaaaggtcggagataatggtgtgtctatatagaaaaataaaaaggcactattcattaccactattagagtaacaaatcaagcattgctttaggctctaagtatatagattcaacaggaaccacatgctacaatggcgataagactccagatgagctcaccgcataacccattgccctaagcaacaattaatacttcagtgaaacctgcgcctggcatgcgttaggtccggctcagggacctaactagggcatcacattaccggaaagctcacttaaacacgaagctatcaatgaaacagcgacagaggcatgcgagccggtgtcggcattccgccgaacacctcggaggcgcgcaggggtttaagcgggtttagggttacaacctccccggttgccgcggggttaccttggggatggcgccgctgaggggagcgcgcggcggacggcgggaggaggcctccgcggcggtggagaggaggcggcggttctggtgctgtagcagcctcgcgatccgggacgccattgagggggggagtctctcgcttgttttacttgcaggaggggaaggggggaaggagaagagaggggagagccgatcgaaaggaggttgcggtgcggttgggtgctcgcctttatttttgcggcgattcgaggtgtccgacgattacgaatccaacggcgatggtggattggcggagggaagctggaggctgcaggaagggtgtgtatagcaattcccttttcaatccttactctttgtttt

SEQ ID NO: 787 - DNA, 20029 bp, Oryza sativa
  unsure (1)..(20029): unsure at all n locations
cgcgcgcgcgtgtgtgtgtgtgtgtgtgtgtgtgtgtatatatatatatatatatatatatatatatatatatatatacacacacacacacacacacacacggtgacgctacgtagcgcccgtacgcgccaccgagtttcgtaacgccagtaccagtcgcccccctccctctcctcctccgcttttcccgtttttaactcccttcgcagtaccgctattcttttcttttttttcctcccacctccttccgacttatccgttccgcatgcagcactccagatgctagcctgtgttaagtaaaatatttactgcagttggtccattctcactaataaaattattttgttaatctttttcccacttacatccggtagtattaattccagtaaaaaattccatagcaaaatcagacctgtatatctacctagttaaaattttactcccctctatttaaacttagttaaaattttactccccacaaattaggggctcgatattactccccgtatatttttcacaccagtttccgtgtgttaacaataatatttttgttacatcctttttgcattattatagttaataactcattaattgttgaataaatattttattactcacttaatgacggcactgtgtttaatacgatcgtatacacatttaacttcctgagttaaaaaaaattacaaatgggagttgagaccaacttagggtaaaaaaatatcattggataaaaacaactaaataacgctggattacaggacacgggcattcgtcaggcggagtcgccgaggacatggtggtcctggagcctggaggagacgtcctcctctgtcctccacagcaatgttctgcaactagcgcggtatgaacctctaaaggtagcgacgacctcctcatccctgaccgtcggatccatgctcccctacgtcgagcgcaaaatgtacttccaccaccagcgagggagcagcttccaccaccggtatccatggaaccactgcagcaggcaacgaggccacgcggcccgcgggggcaccgtcgatgtcatggaggatggccggcatggcaccaaggctgacgctcttcatcgatcctcctgctcatggaagttccatggcacgctcctagggagcgacatccagtgatggtaggggctgcgcagatcgattgtcgactgcaccgttcgctagttgcttcgcaaaaaacaagccatatccggccgtagagcccggcctactcacagacaacgccagcgctcgccgccacgcccctcagcaccgggatccatgcatggcaccctcaacatccccgaccatgcatgtacgcgcaactgctgtgtagatccaagatgaaggatgaggcacatctattctcccgagtcctgaaccgcctccatccctgtggccgccgccgtaggcccgccatcgaggcaagcgcttgggaaagcattgttgccggcgccacaccaattcaatttgacatcggcgatgccgacgggtagagccggataccgatccgccaccaagtctcgcaacttatcaccactcacggcttggatctcgttgcacgttgcctactgcggatcccgccgcgaacacgacgatcacgatggcgtggcggtgaggtgccggtagggcattctacggctgggtgctgggatggatccaaaaatttcgggaattggaggtttgaatggttacgggcttattgctggatacaaatacatatataggcggtgcaaaatgcaagtaaaaaaaattactactacggctaggggtggattggagattggtcgtcgatgagttaaattttaactgcttattatggacctggtggggctggaggctgtatcaggtgttgtttaatacgtagcaccctaaggtgctgtatagtagttctgtatatatatacatatgtatatgtatatatacatatatgtatatgtatatatatacatatgtatatgttacttttaaaaaatatcatctatttttaaagtttttagttactccctccattccaaaatacaagacacaacccaaagaccaataaataattattatcacctcatagtttgggctaggggtggattggagattggtcgtcgatgagttaaattttaactgcttattatggacctggtggggctggaggctgtatcaggtattgtttaatacgtagcaccctaaggtgccgtatagtagttctatatatatatatatatatatatatatatatatatgttacttttaaaaaatatcatctatttttaaagtttttagttactccctccattccaaaatacaagacacaacccaaagaccaataaataattattatcacctcatagtttggattaatctaataaatacaatgcatgcacccaataaaattagagattttgatagtggaaaatttaaatagtaatattttagtgaagaagatgtgttagttaatagcatgtatgcatgtatgccttatattatagaacaaatctaaaaagtacttgtgccttgtattatggaatggagggagtaatgattaattaatcatacgctaataaattatcttgttttccatgctagaacaaacggatctgaaccaacctaaaggcttgttttgccaaaacctggtaaatttttgtgctagtatataatttgaactagtgaggcgtacgtgacacggttaaatttgccatgattttggttggacaaaatttagcttcaatccaaacaagcccttgctttactccttgtttcatttgtggtttgtttttaaccactcatcgtctcttgaatctgaattgaatcgagtgaaaacaattatcacatatattcaataaaaattggcattataggtttgtttgcttcgctaccatgttaagatattggcaatgtcaaaatataggtaaattttgattgagtccaatggcacattttaatagcaaaccaaacactagccaaagtactattaagaatttgatatgccatattttggcttcaaatgaaaatgatcatgtatttctacaattatgttcatgtcaacatatttacctgattacttatataatacactcgtactaaagtatcctatgatttagcaagcggcgttttggatgctttctccttgcaccagtaaatgtttatttagatccacatctcaacatctctgttcttcttcctctcctctccttagttgagtacagacaatatctacatcacaccccttccttttatggcaacatattctatacatacaggccctcacgtgtacacacgtgcacaccaactaaaaaatgtcaccaaaaaatctagaaaaaatcatacacatactttcaattgtattacacatagggttaaaatcttaacatcaaattcattatattttagccgtaacaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagagcctgtgtgcataggatacgctccttcttttatacatctttgtttgtccagtcaaagctggtaatgaattcatcatggtgtgcaatagatcttttaaaagctttccacgtgacaaaagctggaaaacatccaaacaggtcgtagatttcatacataacagatctcatactttgagaaaggaacgaactgagtttagctttattctcacaagaaaaaaaagatataacgagataaaaaaaaagaaaactctaatcagccctttttagtgactgcttaggtaattaaccgatccatttagctgcaatgtccaggtgcagcccaaaccatggcccatagccaacccagcctgctactccccaggccggaagggccccccagtaaacatcagcatgtcctacgtattagggtgtgtttagttcacaccaaaattaaaagtttgattgaaattggaacgatgtgacggaaaagttggaaatttgtatgggcgtgtttagttcacgtcaaaattgaaaatttgattaaaattaaaatgatgcgacagaaaagttagtagtttatgtgtgcaggaaagttttgatgtgatagaaaagttgaaagtttgaagaaaaagttgaaatctaaaccaggcttatgtgtagaaaagttttgatgtgataaaaaagttgaaagttcgatgaaaaagttggaaactaaaccaggcctatatatagaaaagttttgatgtgatggaaaagttaaaagtttgaagaaaaagtttggaactaaactcagccttataatcacgtcaggaattcagccttataatcacgtcgggaattcgagcacaaaactagtatgaacatatcagatattcaagtttgcttgtttgtagcataggatatagtttgagcaaaacaaagaaagaagtgcaatgttcagcggttgagttttccttttggcaacgaaacacaagatgttcaaaagaaaccgtcccaaatttaaaggaaaatgaaaaataatccaaattaacagtcaccaaatttcccccgacgttccttccctaacagatcagcacgtcttcaaaacttcaacctctgcatcggaaaatcggatgcacgcacgcgcggcacggcgcggcgagattgcagcgacgacgacgttgttttgttcagatcagcacgggcgcgaagtaggacttgacgtcgtcgctcgcccactgcagcgcgccccaccagtgcttgtcgcactccaccctcaccttgcactggccgctcgccgccggccgcatcgggatgcgcctcagccgcgggcaacccctcgtctgcacgcgccggagctccgggaacgcgcactccccgccgtcgccgcggatgggcttcagcttgggcagacccagcagcgccagcagacgcagccgcgggaacgtcaccagctcacccgccgcgctgccaccgtccgcggcgccgcccagcagcgtcgtcatgccgttgcacccgctgaggttgagcgactccaggtgcgggaggtgctgcacccacgtcaggtgcgccacggcgtggcacgcgccgatggccaccctcccggaggttggacgccgccccgtgggaccacgccacggtgcggagcttcgtcaggaacccgaacttgatcacctccagcctcggcgcgcgtgcgtcggcgacgatctcctcgacgtcggaggagtagatggtcatctccctgatgctctcctgcacgccgccgaactccgccgcgtgctgcgcggacagcagcggcagggaccgcgtgccgtcctgcagcttgcggaggtggagcgaccgggcgcgcacgccaggcgccagcctcgcgagcctcgccacgtccctggtgctgtccagccacaggcccagcgccgtcagctgcgcgccgctgctctcaagatcatcaattaccggcgcgatgtagtcgtccgcgatggagacgatgctcgcggtgaacagttcgagcacctgcagcttcccgagccgtgagatcagcccggccggtatggtgatctggatgtagtagttgtcgcgcaggtagaggtacttgagctggctcaggttgctcagctccatcggcagcgacaggatcctgttcttggagaggttgaggtactccaggttgaccaagcagcagatctccatcgggaacgcgtcgacgatgccggtctcctccatgtcaaggtaggtcagccttgtgaagtgctggatcgcctggatcatcctcttcggcagggcacggttgcactggagcatcagcgtctccggctgcgcgtccgcgagggcgccccccgtcttcgccggcacgtcctcgatgccgttgtgcatcagggacacccgccgcgcgtcgcgccacagcgcctcctcccgcggcggctccctcagcccggcgccggcgcggaccagccacttgccaggcgcgaaccggagcgccgcgtcgcggacgacgtcgtggagcctgacgtgcgtgtcggacgggaacatgttgtaccggtggttgtccccgcgctccaccagccgcgacgcctccagcacggagatcaccgagtgcgcgagccggtgcgcctcgtcgacgtcggcgagctccgggagcaggccgagccctgtccagcactggacgagctcgtccttggagatgttgtgatcctccggccagagcgcgcaggccaggaagcactccctcgccatgtcgttctccagattgtcgtagcagaatttcactagagggtgagcgatcttgtccgggccgggcgcgctcgagagcttcgtcttcttcagggcgtcgagcgcgtcgccccactccttcggtgtgcgcttgctcgacatggcgcggccgacggtgacgagggacaaaggcaagcccttgcactctgaagcaacctgtttagttgtagaacgaatttattagcagttgtcaatgatggaacagatcaaatgtaaatgaaatacatcaactaaacttgatggcacataagtacataacacgttgataagtcgtgcaacaagccagtgcaaaaggattgaagaaacagaaagattatcatggaaaatagagaaacagaattgttcgattgcctttgtgtaaaacggaacacattttaaaatcttctgcaagaccattctgcaaagggtagtattgtaccataaccattgggtgataataatctgatagcattcaatttgtgatttgcaatttggtagtagctggaaagaacaggaaatcacagagatgatcctgatttaaaaaggtagctaatgtttatcggaaaatccatttataaaaaaatatacaaggaaattcagttagcggagacatgagaatttgaccatctcatttctcaatcgaaataaatccttacagttagcatcaaacctagactgaaacttaagcatgtaccattgtatgatctaacggatggaagatatctattttttgaaggaaaactgaaaatgctaaacgtagcgcttgttttgaaccaatctgatttcaaacaaagacagatcaagtgattacctgtcttgaaagtgcaggaatccgagggtggcgatggatcgtctcctcgcgagcgttggcctcgaacaggttccacgcatcctcctcgctcaagcactccatcttgatcttcttgcggcatcccatgtcggcgcacaccgcctcgctcctcgacgccaccaccaccttcctcacccggccggccaccatgccgagcggctgcgggatgccgaccctctccaggtcaagtcgctcccacacgccgtcgaggagcagcaggaagctcttgtccctgaggaagctcaggatgccggcggcctgcgcctgctccgtcggcgcgtcgcggaggccgagcacgcccacgacctccctctgcagcttcgccaccgtgcagtccctggaggtcgccacgagcaggacgtggtcgaacggcgcgacgaggccgcacgcgtcgcggacgtgcgtgagcaccgtggtcttgcccacgccccccgcgccccagacgccgagcgcggcgtcgcagtcgccgaggaagcggagcgcctcgttgaggtagggcctcgtgagactggtccccggcgggagctccagctcctccggctggcggagcagcggcggcggcgcctgcggcgtggacagcgcggcctcgagcagcgcctcgccctgctcacggagcgcgcggacggccttgagctgcttctcggccgacccggcgacgggtgccgtggagacgaagtactgcacgaggcggagcacgtagagctggccaccatcgtgccgcgccttgagcgacgcgacctcgtcctgcgcctcctgcacgcgccgcagccacgcgcgcgccagctggtccgactccggcggcgcgggctccaccttgagcagctcggaccgcagctgcagcagcgcctccacggcgtcggcgagctccttgacgcgcctgtcggcgtcggccagcggctgccaccacttgccgaagacgagcacgagcagcgcgccgccgagggcgagcgaggcgaggacggcggcgagctgcatctccatggcgcgcacaacttgcgcggggggaacccacggagaggagcgataggcgtggacggaagagtgggcggcgcttccgaggacggaaaggcgggcgggggggcgcgcgcgtttaagtggaggggggagtgggtagttggggtagtgaggaggagagccgagagcgccgagtgttaaatggcgcaatgaaggcgagagcagaattagttggacgcctcatcactcgctcggcctgtgggctgagaggaaagcctgcgaatcgccggaacggggttggagaggacgacagcataggtggagagcccacgttgccgaggcaacctgcacctgccacattcaaggcgctcaccaatggatccatctcggagaagatagactgcagttgaggcgtaggctgtttggttcaatgcttcaacttaccacaatacattttagactgttataccgttttagccttgtgtttgtttcattgtcttatggcaatccatactttcttatcatcttaccccacacgtcgtagactcaatcttttacctaactttgccataagtgtggcttataatttgtaggccacaaaaagtgtggctgcctaacattgtctaaagtgagttatgtcaatgttagttaagaaccaaacagccccgtactctcttcgtctaaaaaaaagacaacctatgaggggatgtggcatctcctagtataacgaatctggacacttcgctccagcccaagcctccgacgacgggcctccgcttcactccgtccgaagttagcctttatacgtgtgcaaataaatttggatcacaacccaatagttcgtaaccctatgtagtcctggttgtatccgagactatagcgtgaaataatcgggattaaagatcgttaccaaccgggattaaagatgaagagaccaggtctcgattggtagttttttttagtttttttattgtttttaactccttgcatattgatttaactccattcccaaatcatcaccaaatcgtgaaatccccaaatcatctccaaaccacagagcatacatcacaaattctcaaagatggttacatcacaaattctaaaaataacatcacatattcacgtcacggttaaatacatcacaaattctcaagaagaaattcaccacaaatcgtaaacaaacaaattcttcctcccagcctccccagcccggccgccgccgaccacgcccggttgctgccccgtctcctcgtgcgcccggccgccgcccaatctcctcgtcgtgcgctcggctcgctcccagccgctccccgcgctgagataaggaaagaaaggaaaaacaggtacaggaaagagagataaggagatggaggaaaaaatatagaggagacgaggagtttttgaggatgggagaagaggataagtcataaaaattatatatagtgttttgatttttatttccggttggtaataccaatcggaattaaagttagtatatttagtaaaaatcttgggcgtcctaacacagcctgacatggaatcagtctggactaaagatgatctttggtgccaaccgggactaaagatcacctagtcctattgtgcttttaaatcgggactaaaaatattttttaagtcccggatagatttttaagtaacagggactatttttcaggcaataaggaaccatttttgctgtccatgtctcacttacacgtgagacaactgatccaatgcttaacatttggcagcgatcacttttcaaagtgaaaaaaaatgcttcaaggggtagtctaagggcatcaacaatatgagccacttctagggtgtcctcactatctgagggatnttagggtacttaccttataatgcaggtcacatctggatagccaatgagtatcccacccaaaaaagactctctctctctctctcctcttcctctcttttctattttacccctctcttctctctctctctctctttctccatcatccacgcgagagcaccgagagaagcccaggccgccgccgctctctccccccctctctctctctcccgtggaaggtggtggcggcgaccccggaggtggcagatccggcgccgcgcgggtcgcggcggcggacagtggcggatggcgagcgcatggtggacaaggcggcggacggtggcgagcgccgtgctgatcgcggcagtcgaggcggcggatggcgagcacgaggtggatgaggtgcctactccgccgcggatttgtcgttgccgccgctctctatctctcttgtgggtccgcctcggtcggcggatactccagctctaccaaggggtgaaataggaaaactcgttggggaaccgatgtccacaggagcccatccccctcccaatgcatccctcggctgcatcgctcggctgaaaagtggcgagagacgcgtccctgggccgggggatgcgctccatcgtagggagctgacgcggacggaaaagcggatgtccgtcggcgagggaacgacccagagacgcatcggtgatggcctaagggtgttttcatttgcacaagattgtgagtagatttgactttttcatgcgtacacttcccaagtactaaatgatgtgttttatggaaaaaaattatatgtaaagttactttaagaaaatcatagtgatatatttttcaaatttataataattaatacttaattaatcatgcgctaatgaatcatcccgtttacctatttctcaaccttctcttttaccccctattaaattaacactcctaaaaatatttggcaagaatatacagcacgaacagtaatctattatattattaaaggaatagaaaaaggaccctccgcattcgctctcatggcctagaaattctcacattaatcggagaaaaagaaaaagcagagtccatatagaaatacaatttagaaatagctgaaatttggaattaaaaaaaaataagaaatatttaaaaataaggaatattagaagaggagactagagtccatatagaaatataattaggaaataactgaaattcggaattaaaaataaggaatattagaagtagagtatacagtccatatagaaatacagttaggaaataactgaaattcggaattaaaaataaagaatattagaagtagagtatagaggcaatatagaaatacaattaggaaataatagacatttggaattaaaaataagaaatatcagaagtaaagtatagagtccatatagaaatacaattaagaaaaaaatagaaattcggaattaaaaataagaaatattagaagtagattatagagtgcatataggaatttaaaactaactatattttggaataaacataataaaattaaaagtagagtttagagtccgtataaaaatacaatttacaaataactaaaattcaatattaagaaaaacacgggaagaagagtttaaggtcaatataggaatacaaatataggaatacaatttagaagtaactgaaattaaaaattaaaaattaaagaatattgaaaaatgagtttagagtccacatggaaatacaattagaaataataaaatttcagaaataaaaataaataatattggaagaagtgcatagagtctatatagaaatacaatttacagaaaattcggaattaaaagacgagtctagagtccatataggaatatatataatttacaaataactaaaatttgatattaaaaataattaataactaacacgtatataaaatataatataaaaattcagaaataaaaaaaataatattggaagaagagcatagagtctatacataaatacaatttacagaaaattcggaattttaaaaaagaaatattaaaagacgagtctagagtccatataagaatatatataatttgcaaataactaaattttgattttaaaaataattaataactaacaagtatataaaatataatatgaatattacacattagtagttttgtaaagttgttacaaaatttaaaattatgttgtcattttaatatatttgaataatataataaaaaaacatatatgttattatatgagagaaaatataatgatgctagccgcgcaatctgcgcggactggaccaccatgctagtttactctattttcgaagtttatttttcacatattgtcagccacaaaccactgatggagatgtatagctccaaacaaaatcagccttcatggtccagagtctcacggcaaccgtgtccgtccgcgcgcgctcctgctccacaactgcaaaagattccgcttccaccgcccaccaccggagctcaagattccacatgatcgtgtggtcgacactcgacaacgcactccgtcactcctacgatgaatataccgccatggggattccctccagtccgcagctctagctcacaaacacccaagaaacctccccgatgcaaggcgccatcacgcgcgcccgcttgcagcaccgcccagctagattccaccgcgccccgtaccggtgcatcccagtgacgaccacgacatgcttgccggaaaggagagtccatcgcggcggcggcgtccagtggtgcggcagtagtgcagccaccggcgagagggcccgggccgtctccgaggtgagagcggcgggagcgcgcggcggcgacgcgcggccgccgcctcagggggagggagatgtggcggcgggcgtggcagaggcgccgtcttcgggcggtggcgcgaagcgggggagcgtggttggcgccgccgcgctcgtggtcgggaccagcatcggctccggcatcctcgccgtgccacagcgcacggcgcccgcggtgagtcgccgtactaccctacacctgacgagcctattgctagcatcatcacaatcagaatccctaaaacgaacgatcgcctgcgccgatttcgacatgtgatcaacacggtgcatgattttagaggaagacaacgcgaaaaaatcgatggaatcaatcaccctctcatcgtagtactccctccatttcacaatgtaagtcattctaacatttctcgcatttatattgatgttaatgaatctagattaatgaatctaaacatatatatttatctagattcattaacatccatataaatatagataatgctagaatgacttacattgtgaaacggaggaagtatattcatatctcggaccggtgacaggtccctctcttgccttgacctttccacatgacaccgaaagattatactactaatactagtctacaacgtacggtgaagtaattagtgatggcccatctatcaggattcaggaccatgaatttggcacggaactgacaggatatctgatcgccaaaaatgaaagtagtagcagcagttctagtagtactatcatgagacagatctgaagtagccgtccacatgtaccccccacaaacagctgaatttctctgtctttgttgtgaggagtagttacgagcattcaaggttcacttggttaattgtcgacccaccaacctcaagcattcttgatctggcaaattcgtaaaaaaaaaaaaaaatctcccgaacagaaatggaacaagaagaaaaatctgaacttgaacttttcctttgtatggtggatgtttaagttcttgtcgattactcatattctccaataaatcaaaacagtttattataaaataaaaattagtttataggtaaaatttttatatacatgtttttagagatttaaaagttaatacttgaaaaaaatgcattgaaaatatcttaaaatcatcttaaaaattaagttttaagaaaataaactttggctttaacttattaaggtccgccgatgtgactcttactagggtcgctggcattgctgatggtcgtgcaattggcaggggttcgttccgagcgcggcgtgcatggtcacctgctgggcgttcctggtgatcgaggcgctcctcctggtcgagatcaacgtccacctgcggcggaagaaggggaaggacgccggcggcgacggcgatggcggcggcggcgggcagctggaggtcatatcgctgaagagcatggcgcaggagaccctgggcgagtggggagggaacctggccgccgcggcctacctgttcctgtcctacacctccatggtcgcctacacgtccaagtctggcgaggtgctctccagcgtggtcgccggcgttcccgagcccgtctccggctgcgccttcaccgccgcccttgcgctcctcatcgccgccggtggcacgggcgtcaccgacaaagtgaaccagctgctcactttcgtcatgataggttggtaagctatcgttgtgatcaacacttggaacagccaacggtactaaataccacattgtttagatctgcattaatacgcttaaatgacaaattttggcatctgcagccgtcttctttcagaagaaattctgctgtctgaacatctccaagctaattaagcaagaaaaagaaaatgtgactttaaagatggtagcagcatatggaacagtaactcgtttctgaaattgtgaaaacagagatgaacaaacactggttcgcccaactggaattcaaagatggcatgtagtggagtagtaactcatttctgaaagtgtagagacaatgacgaacaaacacccactctccccactgggagctccatactacttgcaacacaatgcactgtgctgaagtaagagcaaacctactgtagctgataaccatattacatccatacacctcatgttcttgctgtcatcaacgtgatctgtcttgcgcactagtactaagtactaactaccatcgtgatctgtctactgatgcaggattactgctgacgatcgaggtgtctgcagtagcattcggtgccggcctgaccctgccagctaacaccaactgggagcaggtccctgcaacgcttccggtgatcatcttcacgctggtcttccatgatatcgcaccaggtacatgcaatgcaacttatgtaatcatcccacggatgaaatttgcaacttgcaagaggtacaagtactgaagattcagtgtgcaattgtcgcagtgatatgcgcgtaccttggaggggacctcgtgaggattcggctctcgatactcgtcgggagcatcgtgccattgctgtccttgctcgtgtgggacgacatcgcgctcagcatctccacggatcttgatgggtttgacatcctggatatgcttaatacagagtgagcgtctccgctgtagcactactgcactagcaagaacacgttgtgtacagcttcacctgcaatctgcttctctgtatgaagctggaggcgttgaatcctaacaggacaaaattttctttcttttgtagatggagttatactgttgtggagacgttctcactccttgctgtcgggacgtcgctgatcggaacactgctgggagcttcacagttcttcattgagcagatgaccaatcttgtctcttcttcagcccaaggacatgtatgcttcatcagccagaggacttgcattaatttatatctaagaacaatctgttcagttttatgaacaaacaatcgatgagtgcaggaagaagaagcattaaggcatcgtggagcgaaaacggctgtggacaacaacaggctcagctacatcgctgcaggggctgtggttgccccaaccgtgctaattgcagctaccgttccgaattcattctccattgctactgacattgcagtgagtgtacaccaatacatgtgaaatccttcagttcttgccatcctagctagcatggttccgacacttacagaagattaattacttggtgggttgatttcctaacgttcagggcggttactgcatgaccatcttgtatggcgttcttcctccattgatggcgtgggctatcgcctccaggatgtcagattcgagagctggatctgtcgaagcggaatcatctgtcgccggtggcagtggcaatgtggacttgactagtgcaaagccagttttagtagggatgggggtgttctctgtgctcatggtctttgagcaaatgtcccaagatttcgttagttttcagtcctatctccttgcatggacaggctagattgcagtatagaaagaagtagctgctagcaagtgtacacgaactaatgattcagagaataatcgttaggtttaaacatgtaatttgtcagtgtagcttgcatatctcctgaaaaattagtatagattgtacatacgattgtacgtatgtaaataaatcgcttttgttcgctattgagttgtaaatagcaatgactccggactgagactgagactgaccagtacagtttcgaccgtcgcgtgcgtgtcccctttgacgcggcccacgaggaccaaccacaacgtctttgctcccgttgatcttggccacgcgagcgagcgcggcgcggcgcggcggcgacggccgccgctcgctcgctgggcccgtagattaggcacgccgcacgccctcgtcggatgacgtgggaatgcacgccacggcgtggcatcgttgaggcacgcgcggcgaagggtggagccgtggaggtgcccggcgcgccgtgccgccaacgcgggcggcgttgggtcacgcacgactcgcgacgccgagatcggcgagggagacggttggcggttcacgtgggctcacggctggccggaccggggcactagatatattgtgggcctcaactggatgcatgcgcgactgaagttttaatgggccttctggtgcggtgcatctcttctcgggcataagactagatggcccaaatcggatggtcgcgatctagattggaataagatcactttgattcccttaactgaccaccgaatctaaatggtactcctcaaccgtaatactagaaatcttgacccccgaacttataaaactggggtcatttgactncttttgggggtttgaagagcggtttccctgacgtggcgcacacggagcagagttgaccatattctttgccccccgtggatttacgtagcgcttatgtgtgcatcaaaataaaaaaatatatgcagggcccatttgtcattcaccaaaaaaaaatttatgggttccactgacttgtaagtcccacatgtcagtatctcttatgccttcttgctgctccctctcttccctcctgcatctcgccgactgtatctcctcgcgggctccgtcctcatgggcctcacccccaacttcgctgcactcctcgccggccgctgcgtcgccggcgtcagcgttggctccctcggcgttcctgcacccgacgccgccggtgcagcgcatcgtcatcaatgccctggggatccacttcttccagcacctcaccggcatcgaggccgtggtgttgtatggcccgagcatcttcaaggcagccggcatagctagccgcaactcggtgctcgcggcgacgatcggcgtgggcgtcaccaagacggcgttcatcatgcgcctcaggctggcgtccccggccgccgtcgccaccggctccgcctactctagcagcgccattaatgacaccctcccgtcgtcgccggagccatgcatggagcagcgaccgtccttgtcgacgtcagaagcggtgtcctttgagggcgccggagccatgtcgctgggaaaggagtttcctcaagtccgtgctggtcagcctcggcgcggccaggggtacaagccgacggtttaggccttcaccgtcgacgcttcccgatgacctcccactaattccaaccaatcgtttaacgatttgaacaagtaaacctctagtactcttagttccttccttgtgcatcctcgtcgacgcgtgaaatttggacaatttgccgtggcttattttgttttgttttttcaatttacaatttcttgtttcgagatgttgaactgatgtagtggttttggttttgagcattgtaggatctgtcgtttgtctagctcgtgtatagatgtgccccagtactcctttgcttttggctactgcccagcgggcaatatttgtcctcttccctatccccctccaaagcaagccaccctctccgccatagctggagcgcccgcaccgccgccgagggacctgagctcccgcgtcctcctagtagccggccagctctaccttgggcccaggcggccagccctggtgagatttgtgaatgtttagtctcgtccatggctagctccccggcgacggtcggcagcgcagcggcgacggccatggcgcagtctatcgggaggaggaatgaagcgaggggcagatccggcctccggatccgcaactccaatggccgcccgcccgccgctgttgattcgtccatcgcccgccgtcgccgccgccgatccgaacgccgctgtaaaagcgaaagagggaaatatagaggagggaggatgacatgtgggacctacatgtttgtgggtcccacaattatttttgggtgaatgactgggccctgcatatatttttttattttaatgccacataagcgccacgtcaatgccacgtgggacaaagaccggatcaacgctgccacgtgtgcaccacgtcagcgaaatcaccctccaaaaccaccaagggagtcaaattacaccggttttgtaagttcgggggttaagatttctggtattgtggttgaggaatacgatttagatttagtggtcagttgagggagtcaaagtgatcttattccatctagatttactagattcgggtgggctaatacgatgcagtaatgttgcgccctgaggtgcccgtccgaggcggtattgtactgtatacttcctccgtttcatcattctaatattttacacattcatattaatattaatgaatataaatagatatatatatgtctgaattcattaacattaatttaaatataaaaaatattaaaatgacttatattgtgaaacggagggactaagaattcgggccgtaagtttagaggacgcggagtaggcacagagtgcacagtatttccgacgcgtcgcgctcgcacggttttggagacgatggacgcgtcttgcattgccatcgatcggcatctcgccatcgagttaacagagaatctcttgcacaactttaaaaacggcctctcgcacgtacacaattctgtcgcggttaacagcgagcaaataagtaatcaggagcagcaattaacgggaacgctcttccggtgtccgttctcttcccatccacctgacctgatcgatacacgccaacaacaccgttttttcgacaaattggccctttataaaaacttattttgaaaatagtccctgccaaaaacttcaaccaaaactaggccgtcggttcagcgccattgaggttggcgctgaggtctaacgtctcagcgccaaaaacattggcgccgagatttttgttgagctggcattgaattttcacgtggcacggggttagcgtcaaatacctcggcgctgaccccatatacttgctaattaacaatttgatttgttctgtgtaccaaggtagtggtgccatggtttggttgcttgccttgtgtacacatggtcctacgttcgaatctcaccgatcgctagaaaagtcattttttttccctgttcttttttattctcttacttgtttgtattcttttttattctctcatttgtttgtattctttcaaaaataaatatgacactgattcaaatagaaagataagtatggcactgagtcaaatagaaagagggagcatacaccaagggaaattaaagacaaaatttgcatggcaagggaatcgaacccaggatgccatgcatgcaaaagctcaccaccaaccatcaggggcggatccagaaacaaaaagttggggggactcaacataccgagtacaccgatataaacatataatctcattattaaactatgctaaaatgctattataagacctttagcacctcctatcttatcaactatgatgaaaaaattgaaggggggc

SEQ ID NO: 788 - DNA, 2972 bp, Oryza sativa
tgcacccacgttggatctgcccctgccaaccaccgattgtgattgttcattgttagtttgtttttaacacgtataggcgctcagcgccaaatacccgccacgtcaaatccactgccacctcagctaggatctcggcgctgacacgttatacctcagcgcaaacctcgatgacgctgagcgaacggcttatttctgcaataagttattggcaagatctaattttaaaataagttttcttaaagggtcaatttgtcaaaattacagccaacaccacccaggaagacaaatactcctactcctactataaaatatatactacgcgcgtgcacgcactgggcgaatgaacgagtgaacagtcacccctgtcccctactaaccagcaccagctctcacaggttttggcccctgctgcatcatcacccatagatgcctacaaaatccatgaggctttattaggttaatccccccaaaaaagatagtattgaggaagaataattttacatacaatagacatgaaataaatcctcttaattcttttatgagagaaattaaccgaacaagatgcgacggggcggtcacatgtgtccttgccccttcacgatcctgttactccgtgtgtataggataaaaacactaatgtcaaactagctacaattggccatcagtttatcacagtgctttaagtcgagctggatgcttttttaacgtttttatcgagcgcgacagtgcaaacatatcgtcgtcgtcggttggttgattatactcacaaacttgtcgttaagagaaaggagaagcgacatggctagacgtgaccggcccatcatcgatctgatcgatcagatggttggttagctttacgtcgttgttttctagtctctccctctgatcgatccatgtatcgtcggtgcaaacggccatatggaggagtacctatggtaacgggtggcttatcatgtatataatgtggctcttatcctgtaaaatggctagtggcactgtgttagaaatagattgagatccaatgcagttgctattgccactgcacacaatttgagccttttatttcttgatccaatggttcaaattgcttgccacagtgaattctgaaatatatatatttttttcagaaaagcgctacagtacttgctacagtattgcggtgcatctggatcattcatttcaaatccagtggtgcttgtgtgactgcttaatttatagtcacagtagcaactgcacctgaaccaaatccgttagaaatccaacggggttgacatgtagtacaccctaaagcctagatccggggaacatctgtacgactgtacttacgtaccttaccagccaggggagctgtaagcctggagaaaatcatgacttcaactgcgagctggttgacttgttgtctcgccgacggccaatacggccaggattcatgtccgttcttctacgcataagcgtaggatatgcaactgtttgggtttgtttctaacagtaacatgatcatttcccgtataaattacaatacagaaaaaaatactaagaaaaagatcaaagaaaccacttaccactctctaccggctttatagataaagttcttttaccatattactcgctccgtcttatagtttactataagagattttgattatgcaattatgggatggaggtagtattagttatgctagtatatagttgaaatctaacgctctttattttgtaacaataaaataatttaaaattgcgcaccatgctattgagaataatttagtccataaacgatattttcttttcctatatgagtctctcgtcgattaatacaggaatgaaaaaggaacaattccggtaggcagtgatttctgtgactgaatggtttcgcaaatcatgattccggatacatgtcctagtaattagtccaagaccgctagcccgttcccactaaacctcgattcttcttttaatgtatatattaccattcagctggttccagacttgcaattatcttatacccgtagcactatctactctatcttgttgttggtgatttcagtcaattattcagctatgcgtttgtctaatgccctgcccatttgttttactccatggttagattgataagtcagtggacagtgggtcaccgaacatcaatcttaaaggaagatgttactagtactatatatacttgcaacggcaacatagacagagcgtctcaggatattaatctcatgctatttcaggcaccaaagacaatcagtctgcgcttgcaagttgctactaaataactagcttatcattccataaaaaggcagggaccaatatcctgatggatcgatgtattgtcacctgtataaggattaggatgtacagcctaccgtaagtggacttagacacgcaagatattagattgaagtgtattgatgaattgatctagcgcatactgacggcgactcgtcaccattatggaagatacaaggagaactgttcttttatgccaaatcacgacttcatgagcacccgtctgcttatcattcctactgctgccccgtgctaaaatataaaaaataatctaggttgaacataatattaaaaaagtattatgtatacatatttttagaaacgcagtataaacgcagaaacttttaacacgcacacactcacccctataaaagcacacacgtacatcccacccgtacgagcacatatgaaagactgggctggcatattatgagattcacgaagtcaccacggagcatctcgctgtctgtcggtgacatgggaccaggagtatcatgactagaggcttgaggcagacacaatcgcccacgtggcctggcaccctcggggggcgtcgggcccgagggtgatgtgttcgccctcctctttgtctccccgagggggtcgggccgcacccgcctcggccccgagggccgaggcgccccgacccctcgtgggtctttgctctgcgtgtatgggttagg

SEQ ID NO: 789 - DNA, 8482 bp, Oryza sativa
  unsure (1)..(8482): unsure at all n locations
atccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaagggggggcctgcgcggtctcccggtgaggagccccacgctccgtcatctggcgcgccaggtagggggctctgcgagtgatcttctgagctctcgcactcttgcgtgtgcgccaagcttttcctgttcagcccaatggccgaacaagcaaaggcgcacaacctctctccgagcggtagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggacggcgagacggggagcgtcgcctcctcgtctacggcgacggcagcacgccccagggtgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgatagggtcatggcgaatttctttcccatggccctgaagggacaggtacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctacacatgcggtgatctacgcgttcagggggggtgtgcggcacaaccgcatgctcgaaaagatcgcctccaaagagccccagactaccgcggagctttttcagctcgtggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgataactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcagctaaaatcgccaaacggggcccagaaccgagccgtgccccgggacgtggtgaactccgggggggagggaatcggcaaaaacccacaatcgggtcacccataaccctcggtcaccacgctcccggcttggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgtgtcgccagcctcgtcgccactgtcggttttcccttgctgatgcgcgcgatttgcgaccgccgggattctgcccgaagagagagagagagcagggaggagaggcccccgagccgaacggcggcccaaggcccccgacggccggaactggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggacatgtggcccctgacgaagaagatcggccccaccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgttgttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcgggccgcacccgcctcggccccgagggccgaggcgccccgacccctcgtgggtctttgctctgcgtgtatgggttaggtgagcacagtggggctcacctaaccacatttattgcggtttggctgagcgtgtcacgccgcatgtaacgcagtgcagtgcactagtttatccagtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccgtcactgtcatacgcacattcacccatatgaaaatacgtgtgtataacctacccttattagcatctcccaaagactgggccggcgtatcttcatatttacgaagtcaacattagatgcatcaatgtcgatgggtacgtcaactaccattaaaagaactagcaaggtggcccgcacagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaattatatatattcttatatggactctagactcgtcttttaatattcctttcttttttaattccgaattttctgtaaattgtatttctatatagacactatgctcttcttccaatattatttatttttatttctgaattttcatattatattttatatacgtgttagttattaattatttttaatatcaaattttagttatttgtaaattatatatattcctttatggactttagactcgtcttttaatatttcttttttttaattccgaattttctgtaaactgtatttctatatagactctatgctcttcttctaatattatttatttttatttctaaatttttattatttctaattttatttctatgtggactctaaacttatttttcaatattctttaatttttaatttcgaatttcagttacttctaaattgtattcctatatttgtattcatatattgaccttaaactcttcttcccatgtttttcttaatttataattttagttatttgtaaattgtatttttatacggactctaaactctacttttaattttattatgtttattatttcaaattttagttagttttaaattcctatatggactctatactatacttctaatattccttatttttaattccaaatttttattatttcctaattgtatttctatatggactctatactccaattctaatattccttatttttaatttcgaatttcagttatttcctaattgcatttctatatggactctagtctcctcttctaatattctttatttttaatttagaatttcagttatttcctaattgcatttctatatggactctattctcctcttctaatattccttattttttaattccgaattttagttatttcctaattgtatttctatatggactctattctcctcttctaatattccttatttttaattccgaatttcagttatttcctaattgtatttctatatggactctagtctcctcttctaatattccttattttttaattccgaatttcaactatttctaaattgtatttatatatggactctagtctcctcttctaatattccttattttttaattccgaattttagctatttctaaattgtatttctatatggactctgctttttctttttctctgattaatgtgagaatttctaggccatgagagcgaacatagaggctcctttttctattcatttaataatataatagataataatttagccgtaaatatgagtacccaactacccatgttaagtctagcacctgagtccaggtgggatggttacaccataggaacataatcagttgagctacgcttacttctacgtagctatattctacaacgaagataatacatgaaattaattcaaagaatgttacaaatggttacgaagataaaatatatagatcgcaaaattaaataggagaatattttgtttggttaagaagagaatattgatagagaaaatgcctgatttttaaacaaattttgattacttctatattttagatcaaattaatgtggtactttttcatatgtggtcggctcatctcataagcatatggtacgcactatttatatatgttccctttgtggcaaaataaattaacttatagagtttaaactttatttcaaaataaaaggttagctaccatgtgattctagacgatgctccagttgctatccgtgcgtctgctttcttaaatattttgaaatagagatgttgtgtaaatatctgtattaaacctcaaatttgacgtccaaaataaaaaaggaaacacggctaaagtttgaaaaagattcagggtgtgttgcgtgagtgaagctgatctaacagtcggcttaggaccggttcgaccgacggcagatggctggtcgaaccaataacatttgaccggtagagtcgactctgagtttaatttgccggttctcatactttcttgcttgggtttgagttctctcgagtcataattggtttattgtcctagtaagacatggagatggatcaatgaaaggcaagaccaacccttttataacgttcatggctagtttaattaagagataagctgcactcaacgcattagctaattgagaatcattcaatcagttttgtatatactttttatgtaattcgttcatcttcacctgtttgcgttgtaagacatccatcctccatgtgagagtgcgaatcctctttaaacatttgtcttgtgaatcttccgttacatctataagacgggagtttgtctcaatttatgtaaatgagctccgctacctgaatttgatcttctaaacttgacttgaggatttttctcaagattaggattgttagtgactcgccgtaaatttttgggtaatttggaaccatgtcattataattttgcaaagtttgagatatgtcatcggtatctcaatgacttgtaaggatgtcatatatcaaattttgtaaaattataatggcatggtttcaatttttcctaaattttttaggtgaatccgaatcgtgttggcgacatgatcaaaattagacgcgaattgagcaatatgcatgctggagaactcctcttatagtcttattcccttttttttttgtcgccaagatgattagaggtgtagttaattacttaattatctttgttggttgctctacttttatcaccgtctactcccatcattccttcgccatataataggatgcaatcacttggcaagcttgtcaggtaggacaatgttcttataccagattccatatgaaccgggaaatcgggaacttccgtttggctctgttcagcaataacaggaagaaattagtactagcagcagtggtgtctcttgcaggtgcagtgtatcgataaggttttttttttttttttgttaatgtgatctggcccttgatactgtagttgtttatgtaaagttggtctcgtgttgttctctaacttctatgtgctgaggagcagctgttccttttcttgtctgcttatcttgtttcttaatttaaagacgcacaggttctttttttttaattccaatgatagttaaacgaaattgagttaatctatacgtaaacgtgcgtggatcaacaccttaacacgtttggtgatacataaccatacaaaaactgcacgagctgcagtattttccaatagggccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 790 - DNA, 4196 bp, Oryza sativa
ccctcctattaaaccaaggcaccctcccttcctttccctctcccattcgccctcgctccaccgcgccattgctgtcccctctgtctctctaccaccgaccaccgccgtcgcgtgtgccggaggagccggtgcgcgctaggacgcggaaggggactccgggcgctcgtcttcttcctcttccccggcccgaggccggagagatcacttccgtgccgtcggcctctcgtcacagcaccccgcctcgtctcggtagggcatccctccgttctccctcctcgctccatctcttccccttagctttgagtagcagctcgagtagtaccccagtagctagttggcgccgccccaagccacgccgccgctcgcagtaggctcgccgccgtcgccgcccgcgctcggtagtagccgcccgtcgccggccttcctcggcgatgacccgtccaatccgacgctagaaacggattcctggagtcgcgtagatgctctagctcgctcgaatcgaactcccgtcgcgccgtcgccgttaccctctttcctcgccgccggttgccgccgccgcaatccgccgccgtcgggctccttccggcgaatccaatccattggctcgtctcccctcgtcccgtgcaacctcccggtgtgctcgctttcgcctgtatcgccgtggttcgccccgctgctcgccgccgccgtccgccatccgttccggccggcgtcgtcgtcttcctcccgccggcccgcgtggctgccacaaaggcgccacgtcggcgccagctcggccacgggccaggtcggtttgacctcagtcaaccgctcctccgatccgttctcctgtacgcgcgtggtccacggagagccagccggctgcgcttgggcccgccgtctcccagtccacctggtgcaccatctgtgagccgcgtccgcaaacactagctcccccgcgccgcgtaaaccctctctcccgtgcaccgagtcactgactcgtgggctcgtccaggaccccgcacgatggatccggctcacccggatctctctctctctccacgcctccttttgttgggccgccttctgagcccgcgccagcccaattggttggccgagccgcgccaactcctctcgggccgcgctcaagccgcccgcaaagtctacatctcttccctatctcgtttctaatccaaaaaggaggttaataaatccttttcttttagtccagtaaatcctttagtcttagagactccatatcttctcaaccgtacatccgtttgactccgtttaacttccaaaattcctcaaatatcgagatctatctaatggcacgcttagaggtcaataatagagctttatttttaccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctcttccgcaaatattgcatgattaggtttaacacaagtaatttggccgcggcttgcgagaaagcctaccggccccaatcctaattgctgcaattaccctccttgaattattgaacaattaaaactcccttgtcgactgttgtgcttcgatgcacgggccttcaggcacgtgcatgggaacacctcccctcaaacttaaaatatccaacgatgggtaaaacttgaggttttacaaaagacttggaaaacccgacgcctgggtcggtgcttgcgaaccaaatgaatttccaaaaatcgcagaccgggggacgtgccgggagcacggtttcccactcttgcacttaaggaccgatttcctttggaatttcatccgtacatataacaagtacgaccacatgggtggaatgggacacccctggctgagtaattagctaatcaggggagccttgatgcctggagacaagtggattcaccagggtggtgtctgagaggacccctgggcttcctggcacagtatggtctgggacctaacctgttgttggtctgggacccctctcgtcggcatatggtaaacctgtgtcggctctcgaaatgccttgttatgaaagcctcaaggtcaccagacgtggctgttctgcacgggctgggtgatctgggttagtaatgtcgtgtgggtaagtgtgccccctctgcagaggttattaaactgttcgaacagccgtgttcacggtcatgggcggatgtaaagtgattccttagcgtagttttgtttgactaccgctttgtgaaattgctgttgtggacttggggttcgatgtttggaacatctgtggctgacgggatcagctaggcccgggtggccattttaaagttgtggccgggtgccaatctcaaatctatcaaagactgatacattgcacatactccgaccggacgagatgcactgtctcatccgtgtcgtttgagaagcactcacttagttgttttaaaaaggagtttaactaaaaatcaattgtaaaaacaacagcctttcctttgaagccttcattaaacacataattcccatgacttgctgagtactcctgtactcacccttgctctatataaataatcccccccagttgctgaagaagatgagatggatcccgctgacgaggagttcttctaggagcaagtcggctatgatgagttttagggttttgatctagttcccaagttgcgcctgtgatgaatggtccaagtcttggcttccgctttcctcttttgtaatgcagttgtgagctcggggtctgttcgcagcccaacatgactgtaatcctactctataataaagagacctctgttgctgtgatattctgtcttcctatgataccagcactgtttcctgggactggtatcggataacaggttaatttggggcgcctcgggctggttccgttcggggctagttcggggtgtgacacacaccccctaaaacactttattttgtagttgtggtgtagtattgcaccatatttaaagtttttttttcaggacatatttatatttatacaagttgttgaataaatgtaaaactacagtcgccatttggctgtttacaaaatcaactcaagtttagaccaaagatggcatcaactatcatatataagggtgcaatataatgtttacaacttgtatataaaagaaatccaatttttcagcgccgaaataccgaacattagttgcatcgaatgagagaaacacatataacatcatctaaatactagatgaaaccccacgtgtctcaacaagaatattggatgataataaaaaaaaataaagtataagatgagtttgttttttaaagctaaatgtcgtaactttgtatacatttgtattgaacgatcattaaaagaagttataaacaattgagatgatacattttattacgatttaaatcaaacatagttctatgatccaaaggcaaaaactaaggtaatgtggatttatgaaagaagaacaaaaggtggacaatttgagctgtaaataaatcatgcagtggttagaattaattgattggtgatgttctttaataagaaaaggaaatcaataacatcaacttcacttagtgaggataaattataactatatatataggatgtaaataatatgattgtgctatatatgtctagatggcggagataaaattgaagtagttttaaatcattgaaatattatttaagggtaattgtatttttactctgttttgaagtctaactaatgattttatcttgtttttccaagtttactcatttgacactcttttttttaaaaaaaaaatgaaaatcaggtcttgcctgttttgtaaaggtaacctaacggtgttaacccggaaaaagaaatatcatttatgtcctcatcctggtttaccgagacaggtgatggtggtatccttgttgtcgcaaccttcctaaagatatcgtttgaaggtctatttcctaccgatctttcttcatgaggtatgtcctcttatggtggcactttataccactacaagatgaccacgttggcggatttatacggggaagaacggatccatgctctatgtcatgatttccctctccaacccaaagatgtgaataatggagctaagtgtagttgggacgttgcactcctgtttgttcctcagcatggtgcgattttgttgaatttttttttcttatgatc

SEQ ID NO: 791 - DNA, 41268 bp, Oryza sativa
catgcttcttgtgttttgccggtgatcgaaccaggttcccctgaagtcaagtgaccagtcaagagtttgaacgttgaaacgttgccttctagcgatgtgccatgtgccctaacgagtttagccaatcaaagctagtcacaggtcactacagttcgcaactgattttaccctggacaagcaggtagcttcagaaattagactgatcattttgccatcaccagtgtcacctcaactgttccacccgtgctctcgccagtaatacctctctatgtacagctctctgtccctgaataacaaatataattaagtttcttttggtatgcttaaggtttgtttccctgtcgttatgtacacagagcatgctgttctctgttttttcctgtttggtaagataagatttgtttgaaataacacagacggcatggtctcatgtctctgtaatcaactgttcgttaactgttgatggtgacgcataaaaatgcatctataggaccaagatggatccgtgtgatctgatgatctgatgtgcatactgcatagtatcatactatatagttttctgtggttggaagtgtcaagtgatcgaagtttcagttgaaagatccatccatcgatcggccgcatggcgtctgatccgctgaacacatgtatattcagtttacgatcatctctccggggcccgtcagattagcacgccgtctgacttgacctagtgcccatctctcgaggtttcagatcggattggagatccagcatgcaggattgatcgaaacttccaggcagacaagataatactagtgcgataataattaagaagaagatttaaaaagaaatctagatccatagttacatagcccatagcattatctcttgagtagaccttaataaatagtatgaagattttctgtagttcatgtaaataaaaacaaatctatccagggcatgtataaacctctgctcaaatgcttactgtcgttgatgcgagtctggtagaaccagaataaaacttatgctaattccggcgcatcaaccgtacgtgcatgtggctcacttttctacatatgcatttgcaaattgcagtttaggagctcctaaacttgtcgctgcttccaattccgtgtcaacattcagtggaaataatagaataaatgtttgcgtaactgaagattggagtgcgaatgttcagtggaatatatgctgcgtaattgcagatgggtgagttaggcgagagtgtatatattttcggccggccgcgacggttcgatcggttaagtacgtgtgcactatgccatggatgccatgagagacctgacgatgtatataattttcagaaaacaaatgctgcgtgtagctagtgcataatatggatgcatgcatatgccaggcttgatgatgaggaatatgagttggtaaaagccccaattcccggtcgtaattctagtgcccaaaatgatgctcccatcaaccaaacacgcccgcttaactttgatcaattaatgatgatgaaattgttccctagcttgtcctctccctaacctatactagctgtccaactgatttgcttttggacaagattaagcgttaaactactcaggcgcaaattgtggaatactctaccccaaaccaatccaaacctaccgttcagattaactatgactaatctagtggccattactgtactgcttttgcagctagcttcctctcctaacaactcaagcatgcatgcgcgattgcacgcacagctaaaacgaagtcgtctggttctgatgcgttgatgcctctttaattctgcatgcgaataataacaatattgtcttctccggcgccgtccatcctcgagattccctacgctcaggccatgagggggtatgtacgtatctatgctgttttttctcgttattctgcttttttaattagttttctacgcagagattccctgctctctttatgatttctcttgtagcagtgaaaaattaagaactcggcgcaagtacagtgttaggaacgcacgcacatgtcgtggatttcgccgagaaatgattgattcgcgcgctacatatgcatggatgtttaattactaaatcgatcacaaatctgcatgcactttgcggctagcacttcacagttttaattggttagtgctctatatttgtttgtgcctagctagccagcagcttagcccgaaaacactgaagaaataatgccattttgagtaataaggagctaattaatctatagctacctaacgcctatagtgctaacaaagatgtatcgacgcgtgctatctgcgtgttctttccctgcaaaagatcgataagaacagatcgactttcttgtagcttggaattaaggcaagatttccagggatactgtctgtaaagttttcatgctggttactccatttaatttttaaaaattcgagcacgtgatttgtacaaataatttgcgttttaatctgattattcttcggttcagttgaacaccacgcacctccaaaatatgcagatcagatcagcatttgttccaaaattaatcatcttcccttcgctgcttcgattaggagagcatgctgccggctggaggagtagttctgtttattatgcagcaagcataaaagacaactgaacgatcacatgaattgaacatatagaaaagactcgtttcaactgtcaatatatacagaagattcgtgtcagtttgcagttataaaaggagaagattacgcacagttcagatcgcgccgtccgccggccggagatgacagttagtgatcttgtagtcttgtgcacgcgacgccgttggctagcttacaacggccaggtcatttgactaggagcacacataccgggcacggtcagcccgtgaaagttggacccgacagataattttgaccgtcaggtatcgccgcccagaacgcatatatgatctagctctgcgatctaggccaagatgctagctgccatgcaacagctatgcagctcgatctgatatatccatcttactagattcttattagtagttaagcattagttactgtactatcaacaagttaatttcatcgatcatatcaaggctatatatatatatatatatatatatatatatatatatatatatatatatatatatatcttgatggattgatctctagctttgattcctttgcacagaatctggtgttgcttgcaaatactactacgagcagtagtacatcaactggtagctaatgaagtgatgatttatgccgcctgcatgccaattgccagccacgcgccagcgccgccggcggccggctcgacgccctgcgcgcgcggcctatcgtaacatggcggccttgaattggaggccgcagtgtccgacgagtataaattttcacaggtcgtacgactgtcacgtgctcccgcgacgctgcgtgcgcttccggtaaaagcaaggggcaaccgcccgctgcccacatggatgacgcgagacgggcctagaggcggccccggctgctggtgggcgtcgcgatcgagcaagagagagactcgagacggttgtgctcgcgcgtcgtcggagctaagaacgaggagcgcacacgtggatgcgcggcgactttgcttgtgtccaccggcgagtccacgcgtacgtgcgcacgcctgggtgttggagttggcgaatccgtgttggcagtcgcggatccccgcgcggagaaaagctgcagaggctgcgggtggtgcagcttgcagctacccgcgctcgctcacggcaacgaccgatctccacgccacgcaacgcaacgcagcacgactgcacgactgcagctgcacgggtgttacagtgtaacagtgtctgcgaggcttgctgcagtggattcggctgtacagtagcgaaagccgtaggagcgtgcgccggtccagagcacagtcgtacttaaaaatgtaccccattcataaaaatggaaagtgtgatcttaaacatacacatttgatatctctagaatcagttttttttaacagagtaggagtacgcctcaagcagtggtagatgcgttgcgtgcacacacgattgagctagcgagctgcaggaacaaacgttaccagctgcactagctagagagagtaaagtattatatacggagtactgaacacactatacgctacacgcgctgtgactgtatgtctgtgacctttgtactgtgctgtgccagtgtgccgtgcagtccggccaggtctccgcgcgccgcgcgccgcgcgccgcgcccccaccacgtcgcgcgacgccaatcagtgcgtgccgtatgaacgtggcgacctctgggtcgatcacctgtcacaccgagctagctgcacgcacgcacgacgtcgcgatctcgcactaccggggccctggcccttttccatgcacgcgcgtacagcgtcgtatagcgcacgtatgcaggccgcgggcgacccccaagtccagtccagtcgctacgagctgaaagaaacacgctgcccccgccgcccaagcgcgcgcgcgtactactgttgctcgcttgcccggccagccggccggcgcgcggcctggccgcgccgcgccgtgtcgcgcagggtgcggacaccgaggctcgctggcacgcgggcctgtcgcgcgcgcgccgcggggctatccgatccgtgcccccaccacgcaccgtgtacacggttctggctctgccatactacatgaacactgtgtgcgtcatgcatgtgtgcaggcagcgtgcgtgacagtgtgagagcgccaacgcggtttacgtgtgcgtcgcttgtgcgcctagcctagctgtgtgctgcaacactcgtacagaatccaagtatgcagagaccggccggcgatcgatatcatttcgatatatgtaatttgttgcgtgcgggcggctgcatgctcatgctgagcctgctgcttgcaatgcatgcaggctactggtaatgtgccaagtggatgtgcatgcatgcatgagagtatgaaactacacataaaaaaaatagtcctagccctagcccagtgccccagtaggccagtagactcaaaaaaaaaaaatttgaccaaaaacaacgtatcaaatatttagacatatgcatagagcattaaatgtggatgaaaaaaaccaattacatagtttgcatgtaaattgcagagacgaatcttttgagcctaattacaccatgatttgataatgtgatgttatagtaaacatttactaatgacggattaattaggcttaataaatttgtctcgcagtttatcggccgaatctgtaatttgtttcgttattagtctatatttaatactttaaatgtatgtccgtatacttcaaaaactttacacccaaaaaattaaacacaccctaagccggcaatcgcgggctcaatgcgaaagtttctaatctctgtccagctacgagagattttacgagcatatatagaatgtcatatcgatcgatcatcatcattgctaatgatgccagtcaagcaacattcacacacatcctgctataaggacatcatagcctcacgtggcaacgtgttggcaagtcatgtactactacattgtacatgccttgccataacgggagctactccagctacgtgcagcttgggcaacgcatgcatatgcatccaatgcctggttcgcaaagctctgctttccatcagcgcgcaacaaaagcagccagttggaaaagggttttggttcaagaaggtgctagctagctagctagccatgtccatgcatgtctctctctctctctagctttggcaaactcccatgcaagaagctagcgaaagcgaaggcccgcccatcattcgccttctgatccagcaagcccacgccaactccttgtctctttctttcttgcactgcatggcatattggcatggcagctccaacgaatcaatcattgtctaggttccgtgaaccaccgccatctgctggccccctgccgccggcgccaagtctttcttatgcccatacctgtatatgacctcttcttctctagcttcgatcgatcttgccatttcttggagaatactagtaccagagagctgtcaattaacacaccataggtgctttacttttgttaattaggatcatcagatcactggaacttcttttagtagcttgatcatgaaaatgtatttcttcattttcatttctgaataagaaatagattgaaacacttgtctaataataaagtgatcgtgctaattcgttcattgcttagagatgattttttttcgagaaatgtgcataaggactgctcatttgtttgaagatatgaataaagagggagttcagctgatttgttaggctgataattcaatagctggggaacatacccacattgtctcacatgctctccccatcatattttatttcaccagcccccacagagagagacacataaagaaatgccagctccaatcatcacatgaacaactactactcgctgaggatcaggtgatgctacatagccagaaggccacttgtacagcttaatttgtagccagccacttgtttgatttaattttctgctctccccccatattcatttcttgacatgccagccagcttagctctcggctcttggggagaaacgcattatttctgaatttctgatgggtccatcagatcgtagctagtactagctagatagacgcctcgctcctgctgggagttggagttaatcagctaattatcatactgcaactcgatcgatcgcctcgtcgtcgtcgggtccccttcgtttcagagaagatcatttgttcagaaaagaaaactaaactaaagggttcagagacgatcgatcaatgcatcatggaccacagaacgtgtccctgtcgggagaaacatgcagatcgagcgatggctggccctgcgacgcccattgaccgcgatttgtttaagcaaggcgcgcgaggcgaaatttgtttagcgatgtgatcaggctaactgtggagactgatggagttcgtcagtcagatgggggcggttgccaattggatggcagagggccctgccttgttggtggtttgcctgcagagagttagagagagagagaggactgacaggagatgcccctaactaactgcattcataaccgtagtacctacctactcccggtaggtaagttgttttcagatctgcagagtttattatggctagagcactgctacatttactaatttttttactaaacttttactaacaatcatcttaatcatttaatttagagatgaaagttatgaaaaatctatatgtactcatgatatgacatatcgtttctttaaaaatttagtaaaaaaaagttagtatgtactagccttttccacatggctaaatgggttagtacaggcagcaaacctatctgctatggcagtaatctttttcgtttttacaagtgtgcgaggccgcatccacgttaaacgactaaatgcaaaggacataactacacagctaaccagctaccactctatctataagaggtatcatccacctatacttcaaataagattttctcttaaactactcatctgatctatgatccgattacaccgttgtgttcataataattaaatctttacaacaatatctcacatgattatatttcgatgaaaaattacaaattacttttatgatatgtctaaattacttttagactttactgaatttacttcttagacatagaagtaacttagtgaaatctaaaagtaatttagatatattataggagtaacttataacaaaagaaagtaacttcaattacatgcacggggttgacgagagacgacgccaggtcccctccactctccatgtcatcggctgacacatagggtcagatccagccgctccgaccattgagaagcgacggttgcgggcgacgaccactgcatcagggagatggaatttgtccaatgaaaaaaggcataaattaaatttactttcttttgttataagttacttctataatatatgtaaattacttttagactttactgaatttacttttatatatcttagaagtaacttagtgaaatctaaaagtaatttagacatatcataaaagtaatttgtgatttttcatcaaaatataatcatgtgagatcttgttgtaaatatttaattattacgaacacaacggtataatcggattgtaaatcggatgagtaatttaagagaaaatcttattttaagcatagatgataggaatatttcccctacttgctaaatggaataatagcaaccaaaacttctaaagtacaagcacatgggtgtctctaattaagactaattggagaggcctctccaaatagatttaccgaaatgcaaacctttgtttgtacacgtgattagcaagaaccaaaccatgtttcaacctgtcacggttaacaaggccatctgaactgaaggcccaatacgtcagcgagggacggccttcttcttggctttacttcggcggcggtacagcccatgtgtatttctggggtttaggcccacagcccacttgaggccgtggatttttgctggacttcggcccattttgccgcctctcctttctcctccagcaagccacctgcacgcgcggcgttccggcggccacgctcgcgatcctcctcggttcctccgcctccgtcagcgacctcggaaggcggcggcgcgcgtcgtcgtgctgctctccgccgcgcgccacccggccttcccgcagctccggatcgcgtccccccagctgagcatggaagtgtgagtgctctctacttggcttcgattgggcttggaagtgtgggcggagagggctccgatctgatcgtgttcgatcgctgtggcagggtggcgtcggcgccggggaaggtgctcgtcgcgggaggctacctcgtgctggagcggcccaacgccggcctcgtcctcagcaccagcgcgcgcttctacgccatcgtccgcccgctccgcgacgagctcagccacgactcctgggcatgggtgagccccgagccccagatttctcgaacaaactttactagtagcatcgcggagaattgctccttactctgccgagcacctgtaccatactaggcgtggacggatgtgaaagtgacctctcctcagctctcccgggaggccacctacaagctctccctgaagaaatcaacgctccagttgacgtcttcaaggcaagtcattgatcatttgctgggattgtggcagcagcgctctggtctgtagttgttttcggaattcacttttggtgatagtgttaacaacttaatgttgcagggaatctgcaaacccttttgtggagcaggcagtgcaattctcggtagcagctgctaaagtgactgtcactgacaaagaggggaaggaggcactggacaagttgcttttgcaaggttttgcgattttagtctgaagttttgctcctgtgcaaatcatgtttttgtatactatgctatattttgatttcgtttagttgttaaattttcatctctatttttttttgtaggtttgcacattacaattttgggctgcaatgatttctattcttatagaaaacaggtaaagcttatttccttaattagcttgcacgtatgcttgcctttagccttttgatgagcttcacagcaccaaccccaggctagaagtcaaaaaagaagtgagatttaacctgaacgtggccctagttggttatttcagctttgcgaaccacctaatcttaaacatatattttcttcatattccactaaagcagtaacaaactcatttgccacttgccagtgcctaatttatggattaacatgataatttactgaaaagaggtagctcaggtagaaccataagggagaagttgtactgtgctttgtaatcggtattttctctttgtatatccgtggaaaatgtttacaattcacctatctgaaactgcaataaattgcacaattatttagaggcattgctttgaggtctgttctttctcttatacagttaataaatttgatatttgttcgtgtgtgctctatgtggtcatgatatcgtttatcatgtaaacaaataaagattcgatgggcatgcaaaggatgaaccatttgtaaataaataaaaaaaaaatcagtgcagataggttgcacggttctataaactgaaatatactctcttcccatgtttaacttatgtgtgaattacaatgcagatcacccttaaagagttgtgccactgttaaataattagcttgctattttctatcgtttctccagattgaagcacgtggccttcctctaactccagaggtattgctttcgttgcctccattctgttcaattacatttaattcagaagttgctaatggaacaatgactggagaaaattgcaaacctgaagttgccaaaactggacttgggtcatcagctgccatgaccacatcagtagttgcagctcttcttcactatcttggaactgttaacctttcatgtttgggccaatcttccggtggcaacgcagctggacgagatcttgacttgctgcatgctattgctcaaagtgcacattgtatagcacaaggaaaaattggcagtgggtttgatgttagtgctgctgtctatgggagtcaacgttacacaaggttttctccagaaatattatcctcggctcaggtataaaaaaaaaaactgtcattaccagatagttgtctatctaaaaggttttctattataaagcttgccatatctgattggctgataatatatctgcacaatatttacaggttacaggtgggcactgcatggcagatgtggtggcagatattgttacacagagttgggatcatgagaaggttaagttttccttgcctcctctaatgtcccttgtaagttaaaaagaacttatgattgatgactaggtttcctaaatggtcaataaactatttaacgggctgtcaccagtcattagaaaaattatgggtatgatgattgccttataagatttacagcttgattagaggttagttgcacttctattgtgcctttttaaccatcagttcatggctgttttttattatcacagtttgtgagaaaatactgttataagcacgaatgctacaaatcatgcttgtttttttctcagtaagaaatgaacatgctagtttttgtgatcactatgcattcctcaaccagaacgtagtttgtaggtttgcattctcttaaaaatatctatccttttgatttaggtgacttgaaatgcagaacttttagatgaagctttaagggcactacccagaaacgcctttctgtttacaaggcacagcagagatcagacattttttgtgagaacgcaatatgaacaatctatccaatattctttgcagtgttatttgattgcttgttgccttattgattagggagattgtgttctgttcgttgattgtaaggataagtactacttctgactatagggaattttttgttagcttctaggggaacctggaactggaggatcatccactccatcaatggttggatctgtgaaacagtggcagaagtcagaccctcagaaatccaaggagacatggagtaaattggggattgctaattcagtgcttgagaaccaactgaggaacctaaacaaacttgctgaagatcactgggaagcctatgaatctgttttacgatcctgtagtcgtctcacgtgcagtaaggtaaataactagattacatattcttatatcaaacattcaatattgtaaacatataatatatttgtttcaatgggcaagaagaaatcatgttgttatggttaataatatgattgttaactgtttagactccatcaaggatcacggttatatagtgcataaataatgcaactgttatcctggaaaagtgttttttgatggaccagagcttgaaccatccaattttttaacagcatcttctacacaattctgatttctgaaatacttatctttgttgtttgcatgcttcttgttcttagttatcaccaggtgcatctgtgaatttggaaagagaactcgtctttcagtactatatgctaaaaccttttctctttgttcttgcaagtggacagaggtggctaccaatcaacatcaagaactaattgttagatcattactggccgcaagagatgctttccttgaaataaggcttcatatgcgagagatgggcatagcagctggtgttccagtaagacttagttccttttaatgaaattatggatgttgaagataacatgatcgattcttctacatggtggctggcatagttacatctagacaaattgtttagctattaatttgtagataatggggacattatagtaatatacacctgtctcgttgtcctcattttgcagattgagccagaatcacaaactcaacttctggatgccactatgaatatggagggtgttctactagctggagttcctggggccggtggctttgatgcagttttctcagtgattttgggtgaagcaagtgatgctgtagccaaagcttggagctcagctggtgttctccctcttcttgttcgagaagatccccgaggtgtttcattggaagctggtgacccaagaacaagggaggtgtcaaccgctgtatcatcgatacaaataaactgataatgttgtttgaattccgttagatttattcatgatgtgtacgtttggtgtctctttcatgtagcactagccaaacatgatatgttgaagaggctacacgcggacatggttaaataagtgctgtgcacggagcaagatatcatgttgtgacagattgatatgatttagccatgtgaaaatgcttgtaactattgaaatgtacgcatagaatgcctatttaagcattccaataagctcaaagttataggagttcgggcctttgatttcagaactcctgtaacagtttccatggtttttgttagaaataaaagctgttgtaaaagtttccatggtttatcacagaactggacctgtttttggcgtttgaaaggggttgtgacaatgtgacttgtgagctgggtcgtcatctcatctccttggataaggactgcttttagtgaggaaatgctgagagcataattctgcaagaaatgcgtccaaaggcttttcaaagttgagccttggaggaggcattggggctttcggctttagcttttcggaaatgcccagggtcaaggaatgtccctaggtgcgcactcttccttgggctacaaatgcttcaccaatcaaggtgcccagggtcaaagtattttcaccaatcaaggtgaacttctctgaatacaaggtacctgtcactgtagctcatcctgaaaactttggcgactacttttttattctgtaagcaataaatttataaatacttaaaaaacatcttatattatcaatttatgttgcatcctaaatgtaaccatgcgaattttgtgcatcatatctaactattgttatttgctagctgcatcataatcttatactaggctcccaagaatctaacaaataatgttggcaatagaagtcgtcgcttttcaaaattatgatggatttaacaggagacggcagcaaaagctggaggtcactaaaacggcggctggttggagagtagggtgcctaccatgtctaagataatgaggcatgttggtacaggggaatggtacgttacgtaccctgtgggagcatcggaatgaagccgaggcagtggtcgtcgttttcgctccaggtaacaccggatctttagcacacattccctgggtgcaaagctgtttctcttcgatggctcacctcgcgtggccatccatatgcaagatctgcttacgtagaggaggaatatatggtgaatttttgtctatacaagacttgaaaaggctcaaaagctcccgtggggatgtagagaccaatcaatctcgcgcctcccttcatagttgacatatgtctataggccaatcaatctctacgtagaccactttgattcaaaggaaaaacatagaaatttcatagaattttaattctataggtttaattttttcaaattattatttttgtctaaatgacccttacctcaacccataaaagttttggagaaaatttagcattaggtttaacctcatagaaactttctttcgaatctctctttttctcaaaatccttttttttctacggtctaacccaataactatttttgtttttttctatgttttacagtccacaattttacactttcatttctatcataatcatgtgttttttcaattgttgtgttttttcaatcatatgttttaaagtgggcagaaatcttattggttcgcacaaggttttagactcagtttgtggttttgtgctatgctgtgtggtgcttattttttaaaaagttttggcacatctgacttttactgtttatatgtatgtgaaaaaatattaaagtatcttgctatgaaaatgttttccctagaaaatacgcggatcattactaacaacatatctacaaagttgacttttcggaaacatcatgcattccacggagagagtaaagagaatttgtacaaataaacttaacaatatttgtacttgtgcctacagtaaatcagtaatcactgtagaaatattttgttagaggactgcacaaacattagtagttgtcaaatacagttgtaaatgctgatgtagtacgcaataatatatcagaaattgaagcataaaatctttcggcgtgcgcccacaaaattcgaaggaaaagtacactagcattatggatcagtattggactaattgataataatgcataacagtaaatataagggtaaattggatccgtgccattgtaaacatgtctatttagataaatgccaatacaattcgtctattcgtagccatgccactgaaattttataaaacgttttccatccattttgcgttgaccaggccggctggcaatctcctcctcgacggaaaaatggcgatggagcttgccgccgtctgacaatctcgccaccgccatcggaagaaacaggaggagaaaaattggcaatggagcacacctccatctccgagacaagacgagcttgccgttggaaaaaagatcacaattcacagggaggaaaacaaattgatgatggagctcgccgttgtctgagacctcatcgccaccacgacaagctagccattgccgccgtctgagaccttatcgccgccacgacaagctcaccatcgctgccgtcagaaacctcatcgtcgccacgacgagcccatcgctgccgccacctggggccacggaggaggcggcacacaccgggggcgatgccgcggcggaccggctcgcgccgtccgggagtgcgatgggcggctggacttgccagggatagataaaggagaaagaggatgaggacgagcatctcgcggccgctttgtggcccatggcgcgctgaggaaataggagagtagggttggcaacggggcgggttgggccagaacgcccccggcaccgctcccagacttctcccccggcccgggccccgcagagatggtcgggtgaataccatcacccgtccccgcccccgcaggggacccgcgggtgagtgggcccccgcaccacccggctgacgactgatgattgacgagcgaggagccgaggcgacgctgacgagggacaacgatagacaggtggctggggactgggcatcgctgccgctgtcgccgcggatgcgcctccctggccgccaccgcggatgtgcccttcatggccgctgctgccgtggatgcgatgctagcccttgccgtcgctgtcacggatgcgccgctgacaccgacgccgatggccgtgcccttggtcgtcgacgttgcggctcgtaagaggccgccaccgccgccggccgcaagaggccgccgcgcgtggccgccgctgccgccgctgttgccgtccatgcgtgatggctgggtggggtgggaagggagctcaatgaggataaggttagggtagggaatagatgaggaattagggttagactagatgggtcttttgggctcgtaatatgctattattaatagtctaatatacatttcttcggggacccgcaggtcacctgcccccgcccccgtaggggcgggtccccgaccctacgggtgaaattgccatccctagaggagaggatagggaagaagggagaaagaaagaagaaaaccgaaaaaaaaggatggatgaaaaatgtgtcagtattggtatggtcctaattttataaagtttcagtggcacgatgatgaatagatgaattgtaatactccctctatatcatattataagttatttgacttttttttaagtcaaacttctttaagtttgaccaaatctatagaaaaatatattagtatttttaacacaaaacaatcatgttattaaagtatatgcaatgttatatttaatgaaactaatttaatattttagatgttgctaaatttatctataaacttggtcaaacttgactagaaaaaaaaatcaaacgacttaaaatatgaaacggagggagtagcatttttctggataggcaaatttgcaatggcatggatccaattacccaaatatcaatttttgcatctgaaaattctctacccaggagcttccaacgcatcccttttacctttctttcggcactagaatatcttttcacattaattaattaacaaattgcaatgcatttttatggttgagcttctttctttgattcttccgaaccagaagaagatacgcaacaattcccaccgatcaagtatatacatgtcgttttctaggtggaaaaagatggagtaacaaattttgtatcatttgcagctttcaacgagtatttgtgctctgtcgaggaggggttctctgaaatcacagtacacagaaaatgcatcaccatccaaacagagctactcctacatgaattcttttctgaaaaggcagagctacacctgaatataaatatatgaatctgaatgtcccagactagctagtcaagcacagaacctctagccgacaacgactagtcgtcagaactctgaagaccactcgccgatgcatgctacagagaggctgacgaatgacaatgtccaagttgaatcaaatccactgccaccatcaccacagaaacaatatatagagattagagcctattcccttgatgccaatatgctacctggtgcgtgattatctcaggtgtgcaaccccaaagcagcttagcattcatccacttgggctagctgtgttttgtgcagtttttagtgtacataatgctggaggaggaatcatctatggcccccctcttttgtgcacttgtgctagacgttccatattaacaaatgaaattattccttatcatttgctttttgttcatgatctccaaacaagtgattttctaattcctctgagggacctaaagcctggtgcagtatgcatgtatattggtgttgggcataaagtctggctgtcaacttgactatttttcttatctgatggaacctaaatgtgctagactgatagtcatgggccatgccaaatatgtgagatcatatatgattggctcatctcttttcaatataaggtaaaagagatccagagtgcaaatctagcttgttggagcttttgctttaattactctgcgcctaagaaaagtgaaaaattcttttcagagaaaggggggaaaattccagactatccagttcctgaacaatgtacctgcatatatgttctagtggaagcatttttcaggccgactgctcacagctatctctttgtgttaatgttgatccacataacagcgtcaaataacaacacatacagttaaataaatattgctgtatttacgagtaaatagtatcttcagcactcaaaatgacactcgtgtttcagcaagtaaaaaaacatatgtcaaagtacatgtgcatgcattatctacctttcagaatcacccaagtataactggattttatacctcactaaccccggcacataaactaattaatctgtcgactgatgcaaaatggaatcgatccggcttatgtggcgaccaattaactccctggaacttaaaaaaatccaagaggccagcggggggtaaaataatggattgatttgatcgatcatttccatccagctaaattaaagcgtcgatactttcttacgtctgtcgaataaaacgccctccaatcgctcgtcgcggccgctgttgagctattctccgatcctctcgtggcaatggccgccgatcaggctgcatccttgcagcaatttgcagtttaattctcctttccattaagctttcatctttagcaagtcgcctcttaaattagtgcatatatataatctgcactaccatttgcagcagctcgcgacaaactagctaagaggctaattagatagcttacactcccctataaatatggctcagtcgagtgctcgcttggaagcagcagcagccagcaagctagagcactgagcagtgagcgtacaaacgatcggtcggccggcgagaagaggagtagaaagaagaagggtttgcgtgtgtgtgtacatggattggagcagggcggagaacgcgaggttcgagcaggcgctggccatgtacgaccgcgacacgccgggccggtgggagcgcgtggcggcggtggtcggcggggggaagacggcggacgacgtgaggcgccacttcgacctcctcgtcgacgactgcggcagcatcgagtccggaaactacggctaccccggcaccggcgccggcgccggccgcggcagcggcaacggcaacggcaatggcagggacaagaacaacgacggcaacacgaacaggcgccagagcaggtaaaaattactgacgcaagatcgatcagcgatcgatcatatcgccttcgatttcgatcgatcgaaaaaaatgacatattttcgctggcggctgcattagataggtcgctagtgaaaattcattttgctgatggtcggtgcccctcaccctctcgttacgagtttgctggtggtttttaaatttttccaccaataaaaataataagccaatattatgaaacatcatttttctagtagtgatcgaggtgtctctcatgattttatataatgcatttgtgcatgcagagccaacgggccgcagacatgacgtacggagaaatgaatgtgtgtcaacaaacaacaagcacgtaaagataacaagagtacgagatatgcatattatgtgtgctatatatgtgtatttacgtatacatatctgaatgtggtctacggctttggatattggaagcatctaccttgatagctgtagcttaatttgttatgtagtgagagtctgagagagagggaagagcatgcatggctagctgctggagtactggctaaagcttctgccatcgagcagtagtcagcagtggtatgcaactacgtatgcatgcagttgtcagggatgtaaaatgtatctggctctactttgtaacgtgtggtttgttggtcttgattaactaattaatgtaatggaatgcaaggtttggtttctgactatgaaagaagtatatgtgtttttgatttactaactgtcaaaataccttatcaaatttgtagaggtagtgtttctcttggtctctttcttggtttgaagctttaccactgcaactattgctagcatgaggcccttcacagggcgcttgcgtggcgagtaacctcgtcggtctagctacgccaaaccttgacgtggaggagaaaaggaggtgagtcccgtgtctttgcaagttttgtgcatcctattaaagtcccggtttcctcacacccgaaaaaagaaccacgcttgctactcctcaccaatcctccccatttcgaagatactctgcattggatggcctgtacttttatgtgtgtcttcatcacctttttcttaggtggaagctggaactatgggctatgggcacggtgcattactcttgccatgaagctcttctccttatggaatatagtcctaggtcctaacgacaaccttgtgttttcgtcaaccctggttttcattttaggatcaaacacaagtagccaagcttggggttgggggggggggtgaattggatgagggacatcaatgtgtgaaggtctgatggaccgtgggtgtctgcgggacatgtatatccgagggactgtcgatgtacggtgaaggcggtgaataggccgagagacaccaatgtgtgaagggtatgtggtaacttttcctcggtcaacccatcctccttattctttcttatattgtgtagctggcaccacaaataccttgaaacattattgttttcatccctagtggtggagctaataccctatttgagaagttttcagcagctataactacttctagaatatccagctcaaccaaatagcctatattctcattcaggttttgagaagcgatagctatagaatctaaagaataaactactagttaaaagccaaaaaacctagtttctatatattttcaccaactggatgcttataagctagttcttcaactctcgaatcggacctgaatttgtaaactcaactttgagtacggatataattcttaaaaagataaaagcatgccaatgatgctttaaaacccttatgagatcaattattagacgactcatagcttccattcaactctaattaacattgaccattcttggatctgtatctcctatacttagaatagattttaactctatttttattctgttcttataattttttctctcaccaataatagttctagaagtctacaaagcatgatactgttgaggatgctgtatagtttatgtgccgatgttagcatgaaacctaggtaggtatgctagtaccgggttggatctatatcccctatacttacaacatatttcaactctattttgattttgttcttacattttttctatctcactaataatagttcaagaagtctacaaaaagtgatacaattgaggatacgtccagatcggttgcatccatgggccatgtacagatcagtagcttccatgagggcgaaattgaaagcattacaatctttctactgattgattcgccttcgctgccgatcaaccctaataagctatcgactgcaaggctttccactgttccccaagcgccatcaggatatggatttttgttaattgggataagggttttctgatgttgaatattgccggtctgaatgtgtatgaacttatggattcacatgttcttatcaagcataggcaaaatgctgcttttttctagcagatcgtgagccctacatcgagttcagttactgtgtggttttctttaattttccatgcaaaattcatcagcgtacattttttttctactgaaaaggtagaaacttgtcaacattattacaactaggaaggaagcccgcacaactgcgccggcaagaatgttaaaagaagtcatatatcaccatattcgctataaagaccatagattactttaattataatcataaaagtaatatgtataccgtcaaatagacaaatgatattcaaacaaaagttactttatcccggttatacatatacttatctatcaccactacatattaccattgtcttaaaggtatgtgctcttttaatagatagaaccatatttatacttaaaaataaacctaatatatcaataatataataaagaatccatcttcacttcacagtgtccatgtcttacttattactccccccgtcccaaaatataacaacttatagcctatggaatttgtcccaaaatataacaacttctccaccaacattctcttctcaactaatcacaaccctccaccattcaattttcctacctaccttcacttctcctccaatcacaacaccctccccccccatttaatcctatcaactttcttaataaccgtgtccaactctaaaaatgcttatattctgggatggagggagtagatatgtaatcctgatctcctgtacacgtatgctgcaaaatctcctatatgtatagaaacctctctcctaatctctcctaaaaatatctcttgtatttatagaaacctctctgtcctaatatccatatatgtacgccataaaatacatactgttcaccaaaaaacctccatacatgcgaacaacatacttactgagcccgtcctgctccatgacactaatgtcatctactaaactatgtatgaatattaaaaaatatcgcttttatcaattaatatgataaaatcactaaaattatatataaatgttcctctaacgcatcaagcataacatagcccgtcatggttttcttctcttatgccttaaaccatgggtttcgcatcgacgttgccataccccttaagatcagtgtggggcacaatttcaacattcattgtcattacaataataaatgattgcatcagtaactaagccaactgagctctattaacaacagtgacctctcactggaccatcaccttagcaatattgtcatagtatttacaatatcgtagcatgccctgtcctccatactttgtgccctttagggaataacatagagaaaatagaggtaatgaaaatagttcttttaagttttgaatcgatttgtggtatagagtaggcacggtgtttttatggtattaatcagtactactaaattttagtggtacaaatataattttctcttttaaaacttagcagagttgatcattcgacactaattcagaaaatctaatagctttagtggtgagaaccacgtggaaaaatatttgcgcaagtaataattctttgcaaatatatgattttacatgggccttgatattattttccttgtattattatagatcttcctcacctatacatgttcatgggataatatatgatagaataatctgtgttgttaaatttatttatgctaattgttaagactatttaaatgagaatgacatgaaaagggatagaatatgttccatgtgaacttttttaataaaaatgtagttcacatatttatatatttctttaaaaagattagcgatcaaagtcagtaactgaatatagtaccgctgccagttaaaaagattatttggatgcgaaagacataataaaaggattataatattgttccatgtgatagtattttattcaaatatagttaaatgggatgtagtattttttttaattcataaatcctgtttaactatcatataaacatgagcgaaaggagctacggaggaggggctggtctaactgtatgtattacatacaaacataaaaatattttaattattaatttgagaattaggagtgaaggattggtaggatttttatcgtacttatgtttttttttctcgtgaatactcccttagtaaaataaaatccaatcttaaggataaatcttaggattaggttattttgggcacagggtttatgtattatttttttctcttataggaatacgtttaaagaggtgagttaaaatatatatgcgtgaggtgaggtaacatatgagtatgccgtgcttcaaaaggaaactaatccacgattgtgttttatatagtgaataaaagtacttgagaaaaagaaaggtaaaaatctgttataggtgggcttatacgtacgtacatgccgtatgattgttttttatgtgcgtgcatactcagagagagatattaggagggaggggttaattactcgatagatctaatctaatggttgataataacgggtccatcaatttaaataaaaattgatggttggatgttttgcttttttcttagaatttatatgattttctctatttattagagcgccacgtggtggcgtagaagcatttgtagaatatcacgtggcgctttgaaagtatttctaggaagtttaatgaacttttagtatataatagtttgcttttcaataacatcaagttcttctttaatctgcaagtggacattacaatagcttgatcgaacctaactgcaagctgtcactttcatgatcatgagctgtgcatagttgtatagtactctgcgcgaagaactattctacgtgcaatgcatagcatgtacaacagttcttcctcccagcttgaacctttgatatgttgtatgaagtctgatcgggtttttcatatgtacatgagtcgatctgcagttttcttaataaaaaattctcatgaaccctatctgtacgtacatgaactgtctagatttttctcttcttttgcataattgctacatcaatcactcaatctgcttggtgttttcatccacgaggtgcttatgtacttctccattgtctcggcactcctcatcagtcccagaagcagtacctctcaaccctccttggcctagtggcgaagtcagaaattatcgaagaatagggataaccctaaggcttaactaataagttgttcatattctgtaaaatttatatggtaatctatctatctatctatctattatattatattattaaaatagccttgaaaggagacaccacgttcgctgtaggggctagaaattcccacattaatcgaagaaaaagaaaaaaaaaagaaaaggagagtccaagtagaagtacaatctaaaaatagctgaaattcggaattaaaaataagcaatattaaaagaagtttccatataagaacccaatacgagattaatcaaaatttaaaataaaaataaaataaaatccaaaattagaaaaggaatggagagtccaagtagaaatacaatttaaaaatagctaaaattcgaaattaaaaattagcaatattgaaataagtttccatataagaacccaatacgagattaatcaaaattcgaaataaaaataaaataaaagccaaaattagaaaaggaaacgagagtccaagtaggaatataatttaaaaatacctgaatttcggaattaaaaataaggaatattaaaagaatagtccatataagaacccaatacgagattaattaaaattcggaataaaaataaaaataaatcctaaattagcaaaagaaaataaagaagagttcaagtaggaatacaatttaaaattagctgaaattcggaattaaaataagcaatgttaaaagaagaatccatataagaacccaatacgagattaattaaaatttcgaataaaaaaatataataatatccaaaattagaaaaaactaaaagagagctcaagtagaaatacaattttgaaacaaatgaaattgaaaataaaaaataaaaacattaaaagaacacaatacaatattaactatctttttgaaaaaataaattctgaaatagaaaaaaaagatttcaattaggaataaaatttataaataactaaattttgtgacaaaaataaagactattgaaaaaaaaagaccatctaaaacacatgacgagataaattaagtaacaggcctataaaagagtagagttggtggtggttgatacgacttataaaaattgttaataaaacaccaaatagaatcctaatgacgattaaaaggagggacgtcaggcaggccgtgaagcaaacaagtaaagcggttgccgggacttctagaaagtaaaaaagaaaaaacatattgataatcattttcgatttttaaaatctcaatgacaataataaaaaggagaagcagcgggcggggtgtataagagtatagttgcagagcctccaacggttgacgggacttctagaaaataaaaaatgaattgcaacgatagttatgttcgaattttagaatcacaatgacaataaagagtgggcggcggatgggctgcagagggatatagtgacatcgtttgatgggacttctaaaaataataaaaaatgaaactacaagtccaatgttagaacttctaaaaagtaaaaaaaaacaataataatcatgttcgattttaaaatctcaatgacaataaagaaggaagacagcgggcgagccgtagaggagtacaatggcaaaaccgctgacggtttggcgggacttctagaaattaaaaatgaacctaaactataattacgttcgatttttaaaatctcaatgacaataaagagaagagatagtggacgagacatagaggagtataatggcaacatttgacgagacatctagaaattataaaaacgaaacccaacgtgacaataaactcgaaaaactgtaaaaatccaatttttaaaggttccaagaagaatgaatagaaatagtgatagatcgagcaagcaaataaagaaggagatgacataaggggtagcaattggtgtaatttttaaaaactatataattaaaaacatgaggatgataagatttggtcttttaaagtcttaacaatgagacatctatttaataaattttaagtaaaatcatacttaaaaaatatatgattgttatgtgctagctacgcaattgcgtgggccacccagctagtttaagaaatttcaacatgattttggagtcaagccataactaccctaggcctacctccgcccctgcccctgtcatggcctcctccatcgtcgatgccggtgaaccgccgtcggtcccattgctggatcagttcaacacaatgaacacaattcagtttagctggctttctattattgagaaaatattcctctctgatttcaatcggtttattgcccattaacctaggtttgcaattatgaaaccggttcgtgactctttgaatgttccaaacccatccatgtcagtttcttttaaacccaagcttccggtgatgcaacttgaattccacaagcaagggtgtcaacttagggtttggcacttgttgcaactctgaaaattcctaatgttcttcctacactgtgcacaaggttagcaaaaggtcttcaatcgtatcattgttcttttataaaccgtagtaacgcacaaacaatttgctagttatatataaattacaagttgacttattataactcatcggcaattttaaatcgtctaaacaaacatataaatgtagacggtaaaaagtacttaaacaatatttataatgtgttataaccatcagattgataataattatcacactttaatttttataaaaacatatatatttttaaataatgtaagctttatttaaacttagttaataacattacatcaagagaataaaatctaactgagtgatccccgacctctgcatataatgcacaaggccaaaaaaatatatgaaagaaacgactagaaatatctcccaagtataaaagtttgatagaaatatatatcttagtggctagattagaccgccacctatgctctggataaaaaaaaactcatgcaccacctggtccaattgtcgtgacagatatttgtagaactatttatatcattttataatatctacatacatcactgaaaaccaaataagtaacataggttcttcgcagtcttcttatatattcacttaaaaagcgtctcggattaaattaaattgacaaatgatttattaattgcgctattttaggctatatatcgtctttcataagtgaccaccaaataacatatataaattgtgctacttcggtttatttcggtcactcccagacttaatagataaaaatatgatttggaaagccatagacttacccgtttaatagaacaccaacttttaaatttaactttaaaaattaggtctgaaatagactaaacataaacatagtttcacatctctaatttatattgtgagagcattttagccagtttcattttttaaggtggaactaaaatcgtttaatcgtttggtttggttttaacttgagtagagatgaagctagagtctaaggtcgtgccaaacggccctttagcagatcgaaaacgtgatttggaaagccaaacaacaaagcaacgtgcaagcataacggattgggtctcttctctcttgacttgtcacatccggcttgcgctggccgtcgcaaggccgccgcatactcttctcccctctttgactcgttttgcgcccaagtcgatccccaacgtctcctcctcgctggttcgcccgccgcgccgcgccgatctccatccgttccacgagcagcggtgaccgggtgctgtcgtcctgctccccgcttcccttccggctccggtgagcacccgtgccgacctcacatcctctctctttccccatccatcccgttctacccacgccttctctcgaattttgcagtaaccttatcttctcttctagatctggaagctaggttttcaccttgtcttcttagtagccttagttttactagtagagtagtagtatcaaccgccgtggcgcacgtatcgttcgcccctggacctgaggattacattccgtgtctatagttcaatccttgaccttaaggagtataaatttcattttggaccactttttattaccggtgttttgctttcgaccaccctttaatcaacgtattcactttggatcagataatcttacctttgttgcattttggactaccctaactctcttctcaagcatatgaacgatttcgagtacgccggctccgattcatcagtgaattcccaccgctttatacctggcaatttatttgacagatgacaagtttgatgtagatagataaaagatttgagtgtgctccaaagtgacacaaaggtaagattttccggttcaaagtgaaaatattagttaaagggtggtccaaagcaaaacaccagtagtaaaaggtggcccaaagtaaaatttactcttatatgaatttcaacattgattctgctctgcagccgatctggttgattgatgagcagcccattgccttttttggcagatttgaggcgctaaagtttccattccgtgttacgaaaagctgcattaggacatggacatggcattgccaatagtgaatgccaccgcagcggtgcttgctcgtgtctcagctgcattcaatgccccttttgcccgcgcagttgtctttggggttcatatcgatggtaagcctcttacgtccacatcaatgaggaacttgtgatgtgataagggcgatcgacattcggtaacattccatttttcagggcacctggttgttgaagggctccttatagcggtcatagtgtttcagctttctaggaagagctacaaaccgcccaagaagccactcagtgaaaaggtaaagttatcttctgcctgttcctcgctgttactttgtgttagagtattggttttggtcattgctttccagaacttgttggtgaaagttagcattttgatctttgcaggagattgacgagctatgtgatgaatgggagccagaacctctgtgtcctccgatcaaggatggggcccgaattgacacaccaatgttggaaaggtttgtatgatggttacattctaattaaagtttaaacggtagttgatgcaccatatgggagttcttttttcttactttaaggaagtttttatgtttgatagtgtctgttctgaaggtagtttcttaaagctccttgcaggaaataattcgttttcagtattcctctatattatttcataagtagtgagttactagataaactatgagagaaagcatgacaggattggggcagttgtaagctcaagcattggttaacttaactaggcagtgcagcatgtgggaaggcaatattgacttgaacctttattcttgacaaatactgcatgcaaaaagatgatttgcatgccacaaatctggtcaaattttagacgaatacagggcatcatgaatcacttgaagtatcatgtatcccttgctttccaaatgcttacaatcttctattctttaggcagactaacttttcttgaagttattatagttgattcgcaatcgccatctgctttctgtaacttgcagtatcttctcaaacatttttcctcttctttttacgacgttaataagaacatcaaatgacttaatacatgctgccaaatgcatcttgctagtattttgttataaaagttgtcctccatctgttataatcttgtatctttatccagttatcaacaatactccatttatgtgcttgcgttgcactaataatggacagcagctttctgaataatacaaatttaggagtaacttccagcatccctaacatagcgtggccaatctcaaataactctcactcgtagaatattcattttgttgcccttccctcagatattgcaatgcatgatatatcatctgtttgatgagtccttgtttatggatgtgtaatgctggaattgagaatgtttatgtttgcagaatacctgcaattcttgggcattgcatgttttttctcctgagttttgggggtcttaacactattacgtttcttgctacagtgctgctgctccacatacaaccattgatgggaaagaagttataaactttgcatcagcaaattatcttggtttgattggcaatgagaagattattgtaagccaaaactctattatttaggagttattttgacacttcttccaggatatttgacatgggtgaattgcaggattcttgtgttggttcactggagaaatatggtgttggttcttgtggtccacgtggcttttatggaacaattggtttgtatactctctttttgccaccactgatctgtgttgcaaatatggaagagaaacttatcttttcattgtggaacacttgcagatgtccaccttgactgtgaggcaaaaatagcgaagtttcttggaactccagactcaattctgtattcatatgggatttctacaatatttagtgtgatacctgccttttgtaagaaaggagacatcatagttgcgtaagttaaccttttgcccacatagtaatatgaacaataccggcacatatagagtttgtcctctctttttttttcagtacaacagcttatataaatgttttagttattcacattttttatatacctgccttttgtaagaaagaaatcaaatgaaaactgcttccttgccccccccctccccccccaaccaaaaaaaaagaatgaaaatcctgcacaaaccctttagaaagtagtgtatatgtctgccttgtgatcttcaaagttgtcacctcttacatgtatctattctttagttgttattcttcctcatgcaattagctccatacctggatagttcttttactaggtagcacttttcttttcttgatttttcatgtttgaacctaagcaagttttctatatgcattgcagtgatgaaggtgtgcactgggcagtgcaaaatggtcttcatctgtcaagaagcactgttgtttattttaaacacaatgatatggcttcacttgcaaacactttggaaaaacttacacgtggaaataaacgagcagaaaagatcagacgatacattgttgtagaatctatctaccaggtgtggtgccttttatgataactctgattggacatgagtatggttttttctcatttttctcatgaatttttacgacctagaaaatcatgaaatcgtttaaacatatgactttggatatatcctctcttactgtgacgattgcagaattctggtcaaattgctcccttggatgagattgtcagattgaaggagaaatatcgattccgtgttattctggaggaaagccattcttttggtgtgcttggccagtctggacgaggccttgctgaacattatggagttccagtgagtacccctgacatttttgttctctcatcgcaccaaagtagaagattaaaaagaataggtataatccatggagtcctggtagacacctgttaatttatgaaaattgtgttactgaccattttaattggatatattggcacatcttatttcttacattttcttgcatgtgcagattgacaaaattgatattatcactgctggaatggggaatgcattagctactgatggtggcttttgtacaggaagtgttagagttgttgatcatcaggtaatgcaactctagattgacggaaaatcaattgcaatagaatgttgttaaatatcttgacctattaagttattgtgcttttgcagcgtctaagcagttctggctatgttttctcggcttctctgccaccttatcttgccagcgctgcggtttctgctgtcagctacctggaggggaacccgtcagttcttgcagacctgaggagcaacatttctttcctgcataaaggttaagaagattatcttgttatttatatacttatttgaccaacatttacttactttttaatgtgattaatgtagatgtaaagtttttaatgctttaatacctagcatgtaatgttgtggcatcacttttatcatgtatttttcccattagtggtagtttcaaaacagctgcattgaaattgtgaaacacattatgggattcaatagttgaatttgttcaggcataatatgtcgttactggtgcctgctgatcaccttgatgccttcgatgttttttatctgcagaactgtcaggtactccaggacttgaaatttccagccatgttctgtcacctatcgttttcctcaaactgaagaaatcgacgggttcatcaaacaccgatatagatcttcttgaaactattgctgagagggtaagtccatgtcgacacaacagaacctttccagctgcaaatgaactttcacttgcatatatttacagcatcctatttccaacaggtattgaaggaagattcagtttttatcgtggcgtcaaagcggtcacctttggataggtgcaaacttcccgtcggaatacgcctcttcatgtcagccggccacaccgattcagacatctccaaagtgtcctcatccttgaagcgggtctcagcatcagttctgtcagattacatctgatcccctttctctacgagctgtgcactaatctctgtgtgcatgtttggttaatgtacataacctgtacatttgtaggttccgatgattcccgttgccgctcatacttgcaaacacttcgaaaaatagacgtagaacagtgaaattaggtgtgttatgtatcgttcggtcttctggtagtggtttcccggtagaattcattctatatctttaattttgtcctctattcatcacttttatcattttggcttcaattcatcactttctggtggatttatattcttttttttagtgtagattggttgcgcaaatggcgaaaagaccccaaattctcaaatcggcacaaatcgtttccaggtttcatcttacccaatcgctccttccttgcaaatccaacctgagcagccatattaaccaaactgaaagcgctgcctatcgaacaccacaggcggagacgatggatttgtgccggacaaccggagcacgtgcaacgcgtccatgttcagcacaaaaaaatataactacttcaagctattaggacaatgttatatccaaatacatagaaaaaatattgctatattttggaatggagatagtacttccattcaaatcatgatatatataaatattaaatttgaaaatgtacaaggattgttctgtcttaaaaaagaccaatactacatgcaatttcaaaacccgcagcattgaactattaacaaaaacaagcgccataacacgtctgatcaacagcggtaacaggttaccatatgcacactcgtttttgagttcaaaatacaccagacatcttaataagttagataaacatctgattaatttttgctagagtagcaacattctcatctcgctttgctcttcttaagaagctttggatgcagcacactctgcgcgataagctttgaatgcagcacgctctgcgtagtaggccggtacaactagatagaatggaataagcagtgagtaataaaacataagtgatccgatgtgcaaggcataagcagaacatacaatataagcatttctaggaagtactccctccattcccaattatcattatattacatgagtgcaacaagaccaagaaaaactacgtttactgaggtaacaaactcatatgagccatcctcactatgttctacccaataacaaacaagacatcacatgtccattacttccatgcacaaataatgaatagacttaaaaaatgaatactagtatgatgatcatttcagaataacctaaaacaattgtacgatgatcaattggaaaaggaggggtatcctaagtttgatcaaatttgtagaaagaatacatcgaccatgtcaaataagtaaactacaaatgatgctcatttgatatcacaaatattatcgtttcttctataaacttggtcaaacaacaaaaaaaatattatactttggatagtagtgtttactagcgcaaaatgtatgctcccacacaaatcacaaaaaaggacatgccctcattgttcggttactcgtaaaaaataaatcacaaaaaaggacatgccctgccccttgtgctcatcaaccaattggagcagcatttctttcctttccaaaatccagaataccccctaccctttcgacaacacggaacccccacacctttttttttaaagaaaacacagacacaagaaagaagaataattgattgataggtagtataaaaggactcacctgcatctatctttgggtattcccgacgatgacggctgggtatgaacatgcatttgcaaatatggtcagaagtgcctactgatagttgatcacagcaaagcaatccaaaagtagagctgtgaaacttacaaggtgaaaagcttcaaggttagagactgaagttcaccagctagaaagttgttgtcgtcatggacaacgtggtagcggaccacgcgggaggttgactacagtcaaccaatactagctcaatatatttttttcaaggatagacaactccttatgagtatatttgcagattcaccaaactaaaatgtaccttatgagtagtatggcggcaaaagaacttatacttagcggtgtcagcctcagttcctatgaaacaatacccagtcaccaaagccaagtagcatgtatgtgtattcacctcactcggtaaaaaggaaatactacaagcagaatcagcaaacacactaaccaattgatgcagtaggcaccacgaccacatatgtcagtgatggttgatcttctttgtaggaataggcacaagcctttcaagggaagaagcacaaaaccatcaaaatgagcaagtcaaaccaagatacaggaaggcaaatcatattgtattcctacctgtttaatagcatctatttcttgcaggcaaatgcgctccatctcaccttccattaatccacctctgtgcaagatgttgcactgttagcatatatctaatagtatcacactaatcaaggaatacaagtattactacctgtagaagattatcctcttgggtctttcttttatcattttgtagaaggaccgaaagaacttgctggaaaaaaaatgaaaaatgttagtacaccaaatggatcaaagtgacggtgagctacagattatgtagaacacagaattacgtcatcatgccaccacgtctagaatggagatttatgatgccattatgaggttgatgtgaaattaatgtatgatactttctgaattttggccagtccaatgaagccgccacctacatgactccaacaaaaaatatgatgccaattggattgtgtaacaacaaaacgcaaatccaggagatggtagttacagaagagacatacagatgcaatgccctctgaatccactcctgcctctgaatcctctccaagatcatagtgtatcgtgtgagcaccaaaaaatcgttgggacttctgacacaaggggtaagtgcagtcgctgacgacgtacataactctttacaacctgattaataaaccaaaaacatgataacactataacaaacaaaatgagaccaaagagaaatgaccttcaattgtatttggcgtgcaactctcttcagattccgtttgcttaggcagggtaaacagaaaacataaacaattctaaggctctcacacatctcttcaatttcccctgcaatatatcatatgcaactgtcaaaaaagaaaatcaacagtgaacctgacacaactaacttccataccatcataacttctatcatctgccataatcacaattagaatgtctatctttttgggcacatccagcaaagtacgtcgtatatgaagggaagtaaggggtacatcgacatccatttttggtaatgtaccaaattcctatcatacaaagatattaagtcagatgtgtggtacatgattagtagaatgccttgttcaaggaaagtatgcagggctttaccattcccatgtctatacactttcctataatgtcactgacaacccgcgctgcatgtttacgcttaggtgaaaaatttacacatgcccaacgtctcacaattccacgttcgacctaaaagggaacaaatgcctgtttgagaatgattctataaagatattatgaatcatgacgagagataaagagagttgcatagcagtgaaaataccaaaaaccccaaacgttaaaactataccaagaatccatcagccaagtatgttcttaggttgccccaatcatgtttgtcaactgttcaaggtaaatattatattcagactatcagatccctggttttgaacacaactttccgattatgtggttctcatattgttttgtgttggaagacttgcaaactcgcatcaagcacgcaacattaactatcatacaagagttgtaacacacaagctggtatagtgcacatctcatccgaggactatatgatgcataatttgatttgagtatgcatgacattttgtttgatgatacttagaacatcatcagcaaaatatttgtcctcgcggcattatttgaacattgaagaaagaaggtgaatcgacaaaccaaatatatacaattccgaaacagaagaacacactgattcaaccacaatatcatggcatcaatcaagtaaagtagcaaatttacaacagttgctaggctgaggtggtgatcaaaaaagattttccaaacttcagttgtcaatgtccttttcaatattcagattgatagcatgaaaatggtatgcacatatctctatagtaaaaattgttatcgaaaggtccattaggtctaatagatctacaagaacagaaatcttttgacagtgttaatttctaaaacaaccttatgagtgaaggaagtactaaataactagcaatacctgcagctcatcatagtcatgactgatgtgattttcccatcgcctcacttcaggagtgttacattctgcagcaaccaagtccttatcctccacaggcatgttgctgagtttgtagtagccattggtgtcaaacaccttagagtactcatcccaagacacgccgctaggcttcttgtatggatgttgtgtttcccatcctgtcttgagaatgtgctcgcgttcccctggagacagaggaagaagcaagaaagcataaacaagaaaggacaatcaacgcaaaataaaaagggcacaacgaatgccacacgaaattattaagaaaggtgaatggactagactgggagatacaaaagagttaagaacaagctgctggcctagggtagattgattaactttggactagaccagaaactgagttttaccagggcacaggaaggcttcaaatgaaggcggttcacttaactcagaataagtacttcctgctaacgctgtatgagtctctatttccttgtaggttttgaggcagccttctgcgctattggcggcctgttcatgtccattctcttccagccgctggagctgtttacataattcatcattctctctcatctgctgcacggaaccatcatcatccatctcttcatcaggagatactggtacatattcatcatcatcaccataatcatcatcatcatccatctcttcatctgatgtagggaatgcttccaagtaaatgatgtctgagtcagcatctcccatatcttccaaatcacttagatctgactcactatcttctctcatctcatcagaaccatagactttctcagagtcgccatttaccctcttctcctcacaagaacaaaaaagtgttttgccctcagcaacatgattaagaaactctagcatgagagttgtgcaaaaggaaaaaagaacaataacacatcaaacagaatgagagagaaaccttggaacgaatattgtgagcaacattgttcaggtatagcttgctgggtgtcctagcatgctcaggcaaacaacattgatataagaatccaaggttcttacagatatctttgactttcgctgcaaaacatcgcatgcaactgtcaacaaaaaaaaaagaatataaaggtgcggttgatgcaaatcataacttccataccatcagaacgtctgaattctggaagaattacaattagaaggtttatctggtttacttccactccttgtccgccaaacagttcttgcacatcatgcaaagtactttctagtttattgggagagttcaagtctacgaacactgcatgaacagacttcaaatcctattatgtaaagtcaatgtcagatgtgtcacatgttgccaaagtaatggtgcccaggaaagagtggacggatttaccatcccaatggccacacacgcttttttgagctcagatgcaaatttctgtgtttctgtagtacccattaaagaaaaatttacacatgcccagttttccacgtttgctcctttgacctaacatggaaaaaaaatataaatgtgagaatgctctctaatatatatgtagtacagaaggtaaggagagtcgcataacagtacgagtcgtcacaaagaagatgacatgctaagtgttcaagcagaagtgacaagagaacatcttatgtggtcaaggtcttatttgaaatcattcataagctaatggagcttgcatgatggtatactagattataactttgaagttccaacggcaaatctattttcatagcaagtccgacacccgcatgcactgcaagtaccaagttcatgtacaagaattaagcgtcactaaatggaatcagaccactattttgtatacaggacacatcctgaaacagtagtagtagcattcaaaagtagtgttttattttggtcggccagcaagatgacttgcctcggatttgttcttcttggctacatgagcaccatacgctgcagaacactcatcatacaggagggcagcagcatcaggaggaggatcttgatctacaactctggaacactcattatccagtagggcagcatcagtaggatccggatcctgatcttgatctacaagcgaggcagcgaaggctttgtcctccccaggatcttccgtactgaaattgcatcggccattgttgccgtctttctcatccatggcctgtgctcctaatcctgcctccagatagcctgatcatgagagagtaggagacgtttatccatctataatctatcttgctcaaacgaacgcaaaacgaaaaacagcatgaatatatcacgaggatgcaacgaaatccgaattagttagagctaatgataatgataaatcgattaataagaaatacgagatcagaggcatggaggaattaaacctagttaatttaccagggaccaggaggagtgctccgggaggcgacagcaggctgtagggctgcgtgcggcgcgtatccaaccgatgctcctgaagggttttcgacttgtgttgatgtatggaatggaatcgactgcaacggaatatggtaaggagtattagcccacatactctaaaaaaggtaatagcccaaacggcgacaagtttttgggccaaaaagttcatgtttggcccaaactttgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatcgacgggttcaccgagcagcgacctagatttttcttgaaactattgctgagacaacagaaattttccagctgcaaatgaattttcattcgcacatttccttttaccaacagttcttgaaggaagattttcttgggaatacagtttttttttcacctgtaaaatattttcacttttattcttgggaacaccgaggattcatacagtcaaaaattttcaggccgtttgggtatttggtaagggtaagacatctatctggctagtcattgcaacaaaaacgaactctgaaacagaacgaacatggcgaaggggaaaaagatgaatagacccaaatctgaatcacaaagccatatcgatacggagcctaggcaagccgaatctctcgcagggtgttgaagcaatgagccaatgatgtgggctgaatgtacagagaaaggagaagctgggacgagagataaagggtcggaggcagagtatggaccggtgagtatgaggcgacggcgcagatcgttctcgccctagattccctctccgcttgtatcagctcttccttcccttatggatagcgaaggtgggtagacaacggacccggcgtgaaccgacgctggtgcagcagatggtggtgaggatcgaggccggtttgcataagtggcgcagagtagtagagatggttgcggaacggatcgcggcggcgccggcgatggggcggcgcaaacgtggcgactcagcggcaacaacgaaacgaagcggagagtggtgtgcggtggcggcggggcagagcacggagcgtcacggagtagcgggctcgacggcagtcgaggctgcgaggttcgatatcggacggataaaaatttgtgccccatctgcggttaatttacatgctaaaacggctgtaaagttttggaataagttcaccggccatccctcaactttacgtcaagtctgtataaggtcccctaactgcaataccagaaatgtatacttctaaactatgtaaaatcgtaaaaaaaaaaggtcccgggacagtatagatgcctggtttcgttgacgtgacatcctagtcaggaaaataataaaattgatatgtggggcccacatgtaagtgagagaaaatggtgtgggccccacatttcacttttctttttttttctcttctcttctgtcgttgattctctcaagtagtcgagcgggcgtgatggcagatgggggaga

SEQ ID NO: 792 - DNA, 2144 bp, Oryza sativa
  unsure (1)..(2144): unsure at all n locations
ccatgatcgccaacctccccatctccttcatctaaactccccgcgcctcctcctcgaagcagcggtcatcgacgttggagccccctccgttctagtcaccgacagtagccaccatcgtgtcggccgcatctctccccctctccatccgccgctgcccccgctccaccgtcggctgcctctccccccctccgtcgctgcgcccgctcgactgctcgagagaatcaacaagagaagagaagagaaaaagaaaaagaaaggagagatgtgggtcccataccaatttctctcacatacatataggcccccatatatttattttatattttttgctgagtaagatgccacgtcagcgaaaccagacttctatactacctcgggaccttttttttttgaatggttttacatggtttaggggtacatatttctggtatcgtggttaggggacctcagacagactcgggtaaagttgagggactactggtgaacttagtcctaatgttttatgatttacagcccgtccaaacgggctttttagcctacacggaaaagattttacggtcttgtgttttacactagcattgggccaattacaggccttccaaacaagccttaagtctcacgtttttccaaacaggccttccagcgagtgcctcgcatgaaccctcctctccattggctggtttggtttattcattcttcttaatcattttattggctttggcaggcatcccgttagtcaggcgagtgggttttgggtgaagctgtcagccgccaaggccaagttccacccagtgacaaaactagaatgaaaataaagtgtcaaaggtgggaactaaatgtatagataagtgaaccaagtatatatcgctatgtttgaaataaactcacttttctaattaatatttagattttaccccggttttcattagcatgcttttcaaacgactaaacagtgcatttcgtacgaaaactttttatatagaagttgctttaaaatatcaaatatatctatttgtcaaatttgtaataattaaaaattaataaatcatgtgctaatagctttcttgttttacgtgtgtcaacttaatcttcatctttattaatttcaagcaccactgaccatcaaacaaaaatcagatcattcatatgaatttgttgataagtaattaacaatgaaaaccacattgtcttactcgttaatttcacaccattccccaatcatgaggtctcagcccataacaatagctaaaatattttcaattgggccatatcatagcaaataagactagattaaaaggcatccaagcgaacaaagcagtacttctatctagttatcttatttctccaaaatgacatgtataccaaactatcacagagctagtgaagtaaggtgcttgggatctagcggatggatctagggacttgcgtcccaacaaggcccaacactaaattcttccatggttccaccaccacctacctctctgtctggtgagcttcctcaacttgaccatgtatagttcgattcacttcgtcaaaccgttaggaactctccactccctgcatatttacaccggtttccatcacgatcttgcaaattagtggtggcgtgtggctataaggatcctatcatgtgattgttgcctcgttttgtttcatggttgacatggatagacgttattttaatgattcgtgttctagacatatgtaaagcatcgtgttctaaaaacattcttggggttaggctacatgccatttggattatttgatgcattattaacatttgtcatatcctcttgtcgtgttttaacctccagatttttttgacgggaatttaacctccagatttacttcacagaaacgaacaggggcgagaatagagataccggacatacacatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 793 - DNA, 968 bp, Oryza sativa
  unsure (1)..(968): unsure at all n locations
cgtttgcattgcagggatcatctaccgcgcgtcacggttggtacgatatcgtttgtggtgtagcgattgcatggcgtcctggactagttctggttggtagccacgtcacaaacgtcacactcgattaaagcgagaattatcccctcactagaagatcgggccacgagagagagcgtcatcactcgttccccgtcgtgggccacgccgctgtcctcctccacatggcgggccacacgctaaaaatctatcttcaaaagtgcatattgaacgcaacttaagataacaaagctaacccaacaatcaagagaacatgtatagttaggcactgttcacttctaaataagatgtaggttttatcttagtttgcattatcacgctatttaaacggttaaacaatacatttcgtacgaaaaccttttaggcaaaagttattttaaaatatcaaataaatcgatttttaagtttaataaaataattaaaacataattaatcacacgctaaagatttttttgttctgtatgcttgtacttaatctttttttatcttcagtaaacttataaacgaaaacagaagcctctactttatataggttcagagagattcattcgccgcctcggtcggtataggctggctttatacagggccgcggtcgcgccgtcgcggccgcaccagccaccacaagcagccgtcctgggtcacacccgacctgtcccggccgaccccaccgctgcgagctgcggcgcgcgcaagcgggatttacagccacccacaccaccaaggcaccaacgcattcatccaaaccgccggccgccggccgccgggtcgtcgtcgtcttcacgcttccttgccaccgcgcgccctcccgggctagcccgccgggccccgctgctaccagagagggcgatggcgacggcgagcggcgtttncacttccctgcagcttccctccacgcggcgggtgggcggctg

SEQ ID NO: 794 - DNA, 521 bp, Oryza sativa
gattcatctatgcattcttccatttcagggatgtgtattcactaaagatatcaacaaagcgatcatgatcagcgatgcgatggagaccggaaccgttcagatcaactctgcaccggctcgaggacctgaccatttccccttccaggtattgttaccatgccattgactcggcttgccatcattttgttcaatttaccttttgctttcttcagttgtttgtaatttctatggggtttggactacagggcttgaaggacagtgggattggatcccaggggataactaacagcataaacatgatgaccaaggtgaagagcactgtcataaacctaccatctccatcctacaccatgggctgaggtgttccatatagatgatcagatttctataaccacatgagtacaatgtagagaattcaaatgttttgtaaccacgtgagctttgtacgctatttgcaccacagttctccctgtatgttgttggctcttttacaattaagaataatgcatgttgaagtatga

SEQ ID NO: 795 - DNA, 698 bp, Oryza sativa
ttattttgagacggatatagtaactcctcaaatatttattaggttgatgtagtggaggtatgaatctagaaaccgtttggcaaaccaccaaaccagtcaagtactcaagttttgaaaaatctcaagtgaaaatcaaacttcatcgtcaaatttagtctgaaactctgaattcaaccgttttccttggtaactgagcagtaatcacggttcacggttatcgaaaataccgctcacaaagtgttcatgagagtgatcggtgaaaaaacagttatgtaaggatccaggtcctctacaattaaactactaatgtagggtatgatattcagcgatagaacggttctataagagcgagtacaataattgacgataggagcaccacgtaggatttttcactgatgtggagaagagatagttgaagagagagaatgagcggggactaattagtcgctcggctccacgtgcaacccgaggttgtgggcccgctcgccacaacgatggcgcccctgcgctagccacatgccttcgtcttccctcgtcgccacggtcgtcacctgcgtccagcgcccacctcgccccccgtcggccacgtctgcctcagctactgcggatgtcactgcttgcgtccgcctcggccatggccgtcacgtcgtagacatcacccttgtccggtgcagcaacttccctcgtccaccttggct

SEQ ID NO: 796 - DNA, 530 bp, Oryza sativa
attcatcagctaaacagggtgatgccattgaaaccggtagcatcatcaggttgcaacacatgaggacacggaaatggttacatagccacttgcatgcttcaccattatccggtaacctagaggttggttcaacatgaatatcccatgtgatatctggcaacatttagttcctaaaatttcataggacctcagttgttatattctgagtttattttttcccaaaagcttgagtgctcttcaaactgattgagctctcttcaaatgattatcagtaatagtacatgggattagaagacctacttatccttccctatctgtggacatattgtgtctagctgatctcatattgttgtacacaccagctgaaagatgacagcgtatctgccaatttgatatgtattttatccgaaaccaagaccacaaaccaagaagcaatagtacatcattcggccatccactgtctggatttgctaatgttcatgaattacatggccaacagtgcctagaattgctttgcaactaatgagact

SEQ ID NO: 797 - DNA, 716 bp, Oryza sativa
  unsure (1)..(716): unsure at all n locations
nnnnnnnnnnnnnnnnnnnnnnnnnnnnnnnnnnnnnnnctgtagacagagttgtcatcaatttttaccattgaaacaaagcggaaggttgcaagcagcagttctgcctgttactccacctttgttagatgatgaagaaaaacggaagcaaatgtgtgaagattatggattcaaacaaattggagaacagttgccagataatgttactcttaaagatgtaatggatagtctgcctaaagaggtatatgagctaccaacaccagctatgctgctgtggcttcctatacacaaattcctctaatgtaaaatttcttgtctgctaggtatttgaaatcgatgatctaaaatcttggacttctgttttaatatcagttacttcttatgctcttggtattttcttnnnnnnnnnnnnnnnnnnnnatcttcttcccttagcctgggcatggactggtacagcagttacgggggtaagaaccctcccctccctttgtaagcttatataagtttgtgttcctttcatgtgctacatgcttgcttgctgttttgtctattgtccactatttaattgatgcctttgtaaagttctttgtcataggtcatgattgtgcccacaaatcattttcgaggaataagctggtggaagatatttgtggaactctagcttttttggcattgatatacccctatgaaccttggagatttaagcatgacagaca

SEQ ID NO: 798 - DNA, 600 bp, Oryza sativa
gtagagttaggactgtgcatgctgaattgtaattaccatggttagttcagcagaatttgcaaaaagaggccaccagaattagacaatcgtcatgaattaatcaaggtacaaaccaatggttgctggtacatcagtagcaaatggctgtagcactagcgtgcccatatttatattccaagcctccaaggtatacaatacatatttgatgtaccgaacaactgaaaaaggcgcttggtttggaagcgcactatttttaaatttataggataacttctgacagcctttcttctaaatgaacttttggcaaccgctctgaagccgtgtaacacaatccaacaaagcaatttgcagtcaaaatttcgggcatgtgccgttctagttagaatttaggatgtgactcactaagtaattgtgattgtttctctatgcaaacaccagccaacagtattgatttcatcatgcataatctggcatgaccttcttgaggaatttaattggttgggattcctcaggcgcaacctcatcaaagggaacatagtatctatccttgtcgtaaacatggcatttagtcagtattgtcttcatcaagcgccagttcca

SEQ ID NO: 799 - DNA, 1346 bp, Oryza sativa
catcttatttagaagtgaacagtgcctaactatacatgttctcttgattgttgggttagctttgttatcttaagttgcgttcaatatgcacttttgaagatagatttttagcgtgtggcccgccatgtggaggaggacagcggcgtggcccacgacggggaacgagtgatgacgctctctctcgtggcccgatcttctagtgaggggataattctcgctttaatcgagtgtgacgtttgtgacgtggctaccaaccagaactagtccaggacgccatgcaatcgctacaccacaaacgatatcgtaccaaccgtgacgcgcggtagatgatccctgcaatgcaaacgagagaacactgcaagaataagataagattcaatttaatattgcgaataggtgatgaagcacaaagaaatagttacgattgaagtggtagatctaatcgacacggcaaatcaatacaccaactattgggggctctaaatctatagtcgtcgactaatcgagcgaggactagagacaaggtgaatggcacttggcaaaattcaactaaacaaaacccaattatttttgaggatgtacaaagctatttgtagaggaaaataaagctagggttaagtgctaattcgtggaggtggagggagacacttccgagatggggctagtctattacaaggcccaaggcccaagttcggtttcagcaatagcattgtcttattttggcgattcccgttgactcgagatgaatttggacatgagactggatgtgtttgaaaggtagcgagataagctttccacgaagtccaagatcacccaaatcggagttggcatgaagactctaggtccatttgaagtcagtactgtctccggaggccgagctggacttggacttggaattatcattggaacgtgtgaagttatgagcgtatccgacgaagtgatgtcctcatcatcctccccttcttgaattggagtcgtcctcgactcaatcccatctttttgattgtgtgcactctctcgtctagtggccatccttggaggtatctcatcttgaaaaacattctcatattcctgagtaacagtgggtggcaaagaatataaagtactaggagcagtagcgaatgtgagtataggatctttgcaaaatagagcatagcaacaagaatctggctcatctagtgcacaaatattatatttagaagccaacgaagcacccttcaacttaatttcattctttgtggtacttggttctattttactagttgaagcaagatgtttagcaataatctgattatcacttttcactttcttttcacattcaagtcttgcaagatcatctttcaaag

SEQ ID NO: 800 - DNA, 663 bp, Oryza sativa
gcaaccatgtcgcctacaccactaggctaacttgagctccttgtttaggtaagactatgcataataaatgatgtttctggtgcaacatcagaccaatcaacccaacggtgcagcattcatcataattatctcaaatgcaattggcggccgacacgcgtatcaacgatcatctcgatgcaattagttgacagctcaaacactcattgcatcgaaacaacatatgtctagcggttattctcagcttataattagtgctggacttctcgtgaaagctcaaggatacaaacatagttgaattgtaaatacaactagcatgtaacaacatttagattttaacatgaagttattctgctattagcatatggttctgttgaataaatgaatcatgtgcattggtttccttgagccacaacttttatgtgttaatatttcttttcttctgagcatgacactcttgttaataatgattataatgatgtttctggtgtcctaatcctaatagagacgggtatattgctttagcaccaacaaaggataatagtgaaatgatttttttcgctttcacccattaactaacaatccgttgattagttatatgtaaattaatctatatccattgatttagaatggaaggattagattgacataatatcacactaaaac

SEQ ID NO: 801 - DNA, 796 bp, Oryza sativa
cccaagattctcgtattccttcttcgctgtcccaaaaatttcattccccgtgctagattgaatggtcgcaacccctataatctcacgatcctcttccacgttggccagtctctctcgctcacgtgcgcgaaatttccatccaaaactgccaacgatctcatcgggaggcaaacgatgaacacagctaccgtgaatccataatcaataagagctcgttggctttcctgcaaaaaaaaataaaaaaataaaagtagagctcgtcggctttcaagatgtgcaccgcggcgtgagtgcattcacggatggcgacaccttggcccctcgaaggtagacttcgggtgaggtagaatcgaggccatgatgtcgctgtcgtggaggctgtttcgcaatggtgcagcatggatatatgtgcttcttcttgttgtacggcatcatcgcggtaccgcgcaagcaccaccttgcttcagagataaaatacgagccaaaattgatcatacacattgatacaatatgtggactatctgttatttggtgatttctttctaagcagttagctcacatcataacacaactagctacatgcatggatatagccacttttgattgtcaacacttgatatctgaatgcagatttaattgtttgattgataaggtatatcaacacaacagccaacctagtgtactagctagtgctagtattaactctaagatgacatgggagatattggagctaacaaccggatgcactattgaccttgctctgactcatcactgaatgaacaatgtttttggagtt

SEQ ID NO: 802 - DNA, 677 bp, Oryza sativa
tgcagccaggtaggagtacagatttttcagttgcgtagtcgcatcggcagccggtcgggcagccggcctgttaaatgaatgatccaaacgtttgatgattcttcacatgaaaaaggctacaccagcaaaccaaggggcacctacccactgtctgaattactttatccgtcccacaaaagatcaaggggtatttacaaatttgtcatcggtttttctaatattgcaaggatgcaactcgaatgataattctagtggcatttttgtaattttctggtgataattttacaataacgatttaaaatagtggtaaatttgtaattgccctaaaagattcaatctagaagtttcgtccagatttattataatggattatgttaaattcaattttagattaatttttttttggatggaagaagtgtactccactttattactccttgttactagtagcaccagaaagaagtggcaggttgatcgctcgggcactttgctggctgctgctagtacaggtgttgaagtgtaggtacaagtgttgaagtgtaggcacggtcgtgtgatctgtgtgctgaatcttggactcgtcggtagctctgctcagcttcagcacgctggaaagggaagcagccaagccaaggcaggtctgcaggtggtctgtctgtggatcgctgagcagtaca

SEQ ID NO: 803 - DNA, 993 bp, Oryza sativa
cacacatattgttgagtaccaagaagacatattctttgcaaatatagcttttacatgaataatatatagagatcctttttgttttattttaatcttttattgcggaagcattacgaccggatgcactttgtattacacaaaaactactttgggattcataagtagccctcaaaccatagcaacagaatctcatgtgtactactgcatagcgcgttcattgctactgtggtatcgacactaaaatatactgtggacacgataacatgtacgagacctcgcaaaaaaccaactcaaaattctacgtacatgtatatatacatagagaaaacaaaacaaattcataccctgaatagtgcacacaaacaacacgcatcagtatttctttgtttaaatgtttttatatctccatttatatatatattgaatgtcaaggtgaatatttgtgtggcgatacacattatcatgtgcgcacttaaaaaaaaacattttttgcgtcggtagcatggcgctacatggcagggtcattcctccatagagaaaatttttattttttaataatagaccatttcaaaaaaaaattctaaatctgaaactttgtcacgccacgcgcaccacgcgcagttggcgtgaccatgttgttcggccacgccaccatggttggccacaccagctactcggctggcgttgccgaaaggtttagttttcataaatactttttggaatggtctattaataaaatttagaaaaataaaaagtctaaacaataaaaaagtttcctccatagaactaccccgatgcataggacatcaggtagcatttgtactttttagttattttagactatgaattacaatactattgtcaattagagtctaactaggttctccacgggctgttggttatccacggtctggttaaatctactgttggtctagccacatggtcctgattagaggagtctgagattatgagaagttgttggtgagaatctca

SEQ ID NO: 804 - DNA, 1632 bp, Oryza sativa
gaccatttacagcgaaaaattcactggatacaggctgcctttttttggggtcgcaacattcctcttggcatgcaaaatggaacgaaaaattagcgtattattaattaagtattaaataaaaaataaaaaatagattaatatattttttaaagcagttttaaaaaacacgacgtttatcagtttggaaagcgtaaatgtaaaaaacgagggaataaaagttactagaaaggaaagaaaagaatacatccttagctaaagtttccttccttcattccaaaaataacttaatctaggatgtgatgtgatccatcctagaccaacgataaattcaaattcgttggtttagaatgtgtcattttgtatcttagattaagttattttggaatagatggagcatatgaaggagcaaaaacacatgaacgtacacggcgccatttattccattatttcgctgcatatgtaacagatgtgataagacgaggagaaatatgcatgcatcagccatgggagatcagctagtgccatagcccataggctagctattggagcatttaagctaaccgatgacgggaattttgaagacgatgccgttgtcgtccatgaagacacggacgcgcttgtcgttgaaatccggcgtgaggggcgcgcccggcgggagcacctcgacggcgacgtccggcctgtccttgccgatctgcgtcgccgccagcgtcgccagtacgcccaccagctccggccacgacgacttctggctcatctccggcgatctctctagctctcccctggctagcttagctagctagctcaaccagagaaagacgatggttgtcagtgatcgatgctgcggctaaatctatgagtgaatttataggaaggtatgtacatcgaatagccatatcagacagagagatgcgaaagcgaccgacgaagagagagagagcgcgcgccaaactgcatgtctgagaccctgtttagataggtcacatcgaatgtttggacattaattaattataaatattaaacgtaaactattaataaaacccatccgtaattttggactaattcgcgagacgaatctattgagtctaattaattcatgattagcctatgtgatgctacagtaaacattctctaattatggattaattaggcttaaaaaattatctcgcaaattagctttaatttatgtaattagttttgtaagtagtatatatctaatactctaaattagtgtctaaatatagagattaaagttaagtccctatatctaaacgccaactgcgttgccagaatcctagatagaaatcttgttttggtcagtataactatcttgtttgctgatgcatgcacagctagagctcgcagtcgtcgtctcgtcgagctgttttaattggttcatccgttaattattcatcgcgcgcgacgaagtgatcactaattcctagggcttctgttggtaaccacgtccgccgaacaactaggtgatacgcacgatgttccaggggtgataaaacgaattaaccgcgaaaattataaacctaaacagccaatttaaattgttcattccaatgaccggaaattggatagcaaaactctagctagcagcaatctcggtcgtccgtccagggccgt

SEQ ID NO: 805 - DNA, 636 bp, Oryza sativa
taatccaaatcgacgtatacatgacatgtcgaccacaaaccgcatattctcagtgcttaataagggcccatagtgtgagaacaacactccaacctcaaagaatacgacattgatcacatccctttttgtcctcaaatccgaaaatataaatcacaccctttttttctcccccaaacaagcacacacaccacgcctagaatccaacaacaatggagcttataaagacgggttctgatcactttcatctcttgtacgtaccgtcgtacgggaccaacacaattacacaaagcaaaacaacagttcgatctgtggcagccacacaagtccgggaagtaaggcctcctttgattcaaaggaaattcatatgaattttagagaattttatttctaaaggaaattttcctatatagtcctttgaatcaaaggaatggatcttatggaatcccataaaattcctatggaatgtctaatgctatgcaagttttggagaaattctaatataaggtagaacctcatggaaactttcctttgagtctttatctctcctctaattcctgtgttttttcttcggtccaatctaatggtcattcctgtattttttcctttgttttgtaatcctctgttttacacttgcat

SEQ ID NO: 806 - DNA, 2591 bp, Oryza sativa
  unsure (1)..(2591): unsure at all n locations
ttcccaacccctcctcccgaaagcagcttctgtgtttgctacgggaggatgggaacatgtatagtgcgtacggaaaacggagtaatctattaacacgtgattaattaagtattagctatttttttttcaaaaatgaatcaatatgatttttttaaaacaactttcgtatataaacttttttaaaaaaacgcaccgtttagcagtttgaaaagcgtgtgcgcagaaaacgagaggaaagtgttgggaacacccccttgcaaacacaccgtttagctgttctttctgaaagatacgtggctagctgttccagtgctcctacaagaaatatcgtaagatccaacaggctgtggcaacaaaggagttgcctctaggcaaagatcagtgtgtcgagaagctttcagaccacttcactcatgtctagctccttttggtttcacaacccgataactcctagttgaaatggcagagaagacttgcgagtgctatattgagcaaacatcaaacttgggtacatcttcagggtctcaaatcgactcgctgtggccacattttgcatttcttatttataatataaacaaaagtaggcaaacatggacagtgtttaggccccctttgattaggcttataagccaacttataagtcgaaaagtctaagcaaaaataaacaagtagctttttcatttggcttttttaagccataagccactctaacactattaagcaaaagctaaggttggagagcttttttttggcttatatgagatagatgtatgactccaccactaaacttaggacattaaatcccctggcttataaatcatataaaccattaagctgacttaaaagtctaggccaataagcctaagcctaaacaaagagggccttaagagaccagacatttgtcttgacagtacatatctgactaggtgtaccgaccaatcatgcatacactggagtagctttgagcaaaagctcagttcggcgatgcgcagtgaccccatatgtttctgtaatatctagctcatatatgcctgttccattaggcaaattccaatcaaaatgataaagaaggcttgcgagtataatctccaaacaacaagtttttttcaaaacaaaagcaaaacaagatcacacaatatctcattgaaacgaaatcacacaacaaaatgattggccactcaaactgcaccagttggatcaagatctaatgtgcatactcttaaatttgtagccattggatcaagatctagcatacatagtctttatttcactaatctagatttaactctctcatccgctcttttcctccaaannnnnnnnnnnnnnnnnnnnnnnnnnnnnnnnnnnnnnnnncctgaagcttattgaaccggagctaatcacaattgctaggaactgaaaagaggtggaggaaacaactgtaacctgtgtaaggtcttgcaatatctccatatgacgagtcaatgtatgagaaaggacttctgagcctcctgatgatacccatgtctgcatttgagaatttacttgctgaagttgcttcagcgatctttctatatcggactcgatatcattctcagaaccatcagatttcatggaaatcaatttacggtaagcactcatttggtcatctaactgagcttctagcctccttgccttcaatgaaacaaaaggcacaattacttaaagtaaacaagtaatgcaaaaaaacgtcaacgaatctttttaacacattaaaccaaaatccaatattttcagcaaatgaaattgaactaagcaagggaatgcatcagatgattttttttcctcttaaagtggatggaacggagaatgtcatggagagatttaataataagaaacaaagctagcagtgccaatgtcccaagataactgctccaattcgtagatctgacagatccgtttcattctgttttcagttacacagtcagtatcacgggtttacctttctttttccattttcgagcgtgattcatggcaactatatgcgaaaaaaaagaagggtttggtaatgcggtatgaattctttcctaacacaggcttgtattgggccgtcactcgtttactttgtgcagaaacatccagtgtaaagtcagaacaccgaaatgacgctcatcccgcatgcatcatccatgtcaacaagtgccaacacccaacagccaagtcatccaaaactccattggctctatgtgcagtctaaacttagccgttttgaatttcgattgcatcacagtatcacacaccaatgataccccccacacagtaattagaaactacaaaaggatgccacagcctcataagctacagcaactagttgcgcaatgcacttcgcagcactagacagatagtgaaaatacatgccacaagtgcacctcaacatggagctttgtatgaattgcagcaatgttttcgctccgacaccatctagatcacgccttctgctcaagccttcacaggaaggaacaaattcccatggtatacaagtacaaccctctcttcagcgggaaattcgcgcccccgcaccggtcgaattcgcagataaactagaaaaagtacaactccgaggccaaccaaca

SEQ ID NO: 807 - DNA, 6331 bp, Oryza sativa
cccccccccccccccccccccgcgcaaaagcccaaatgtaacacgcaactccgacgaccagccagatctcgagcttcagcgagcgggcaatcggagccagcgagccacgggtggggaggtcaggtcgacgagagccgagactgtggagagagagagagaggcgggggtggggggaggggagttgacggctcacctgcttgcggagggcgtcccaggaagacgcctccatggcggcggcggccgacggggcgcggcgcgcgggggatctcggtgggagagcttgggcttggctgctgccgctgctggatctctcccctatcggggaaggaggggagagaatcggagagagtaagtaggacgcaacgcagaggggaggacgaaacgggaggggtggttagttggagcgttggacgaagacgacgacgatggacgagcagagagcaattcgggtgccgaactggcgaactgggccgagaggtgccgaattcggccgccgagcgcccgagccgcgcgctcgtgcgccaacaatctccgaagtggactgccgtaaactctttttttttccagttttgctatatatttatcgataaattttctcccacaaatttgacagatgtcgtagtgtaattatactgtaactataatgtaagttgtatgcaactttcaaaaatctctctgtaacatattatttcgataaaatggaggtcgtggaacaaattctttcacatatgtgtgtgctgtgatttttttcttcctcaccagaataaatcttgtaatagatctaacgattcaaaattacgtgaaacttacatacaagttacactatagttacatacaagttacagtgtaattacattacgattgtactataattatatctgtcaaatttttagaagaaaatttgtcgacaaatgtataggtggcccttttttaatctactttgtaaagggagaaggggatctggggttggctagatttcagtcacctaaaattctcattgttttttttcctttaaaagaattctcatttcttctgttttcatttaattttcaccgagacttggagatcatgccctttttcttctccgacgacaatgctagctagttagattctaaagtcgagaaggtggttataagagttagagacagtgttttattttatagggatagcttggaggacatgcacagtagcgacagggcggtggtggcactggagctatgggtgaggagggccaacggtgggtgaggagactaacaaattagaaggtggaggaaaagggtgacacaagtcacaaaaacgccgaagaaaatataatatatgatgtctcaccaataagagagagagagcaccgcggaaaatggtgagacggaggaattgaagaggcaatgaatatcttcctcactagatcattcttggaatcgtattgtttgatattttatagggacgttttagtgtgatattatgtcaatctaatccttccattctaaatcaatggatatagattaatttacatataactaatcaacggattgttagttaatgggtgaaagcgaaaaaaatcatttcactattatcctttgttggtgctaaagcaatatacccgtctctattaggattaggacaccagaaacatcattataatcattattaacaagagtgtcatgctcagaagaaaagaaatattaacacataaaagttgtggcacaaggaaaccaatgcacatgattcatttattcaacagaaccatatgctaatagcagaataacttcatgttaaaatctaaatgttgttacatgctagttgtatttacaattcaactatgtttgtatccttgagctttcacgagaagtccagcactaattataagctgagaataaccgctagacatatgttgtttcgatgcaatgagtgtttgagctgtcaactaattgcatcgagatgatcgttgatacgcgtgtcggccgccaattgcatttgagataattatgatgaatgctgcaccgttgggttgattggtctgatgttgcaccagaaacatcatttattatgcatagtcttacctaaacaaggagctcaagttagcctagtggtgtaggcgacatggttgcatttggccaaccagggttgccttttttttttaaaaaaagttgttcgatccacccacccagttcataccggatggatggttcttaaagaaaaccgatctgatgagaatgttgattatggtttcttgtgattcaatcaatagaccggtccaatttttttttagcaacgggacaatgcatcctcctccttttacaactaaattacactatccttacaaatgtcgcccaagtaaactccaaaaacattgttcattcagtgatgagtcagagcaaggtcaatagtgcatccggttgttagctccaatatctcccatgtcatcttagagttaatactagcactagctagtacactaggttggctgttgtgttgatataccttatcaatcaaacaattaaatctgcattcagatatcaagtgttgacaatcaaaagtggctatatccatgcatgtagctagttgtgttatgatgtgagctaactgcttagaaagaaatcaccaaataacagatagtccacatattgtatcaatgtgtatgatcaattttggctcgtattttatctctgaagcaaggtggtgcttgcgcggtaccgcgatgatgccgtacaacaagaagaagcacatatatccatgctgcaccattgcgaaacagcctccacgacagcgacatcatggcctcgattctacctcacccgaagtctaccttcgaggggccaaggtgtcgccatccgtgaatgcactcacgccgcggtgcacatcttgaaagccgacgagctctacttttatttttttatttttttttgcaggaaagccaacgagctcttattgattatggattcacggtagctgtgttcatcgtttgcctcccgatgagatcgttggcagttttggatggaaatttcgcgcacgtgagcgagagagactggccaacgtggaagaggatcgtgagattataggggttgcgaccattcaatctagcacggggaatgaaatttttgggacagcgaagaaggaatacgagaatcttggggacggaggcattgatctgtgagggcggcgaggttttctcgtgggcaaaagagaaaatccttgcaacggcatgtgtcgaccccgcatgcggcgggcatggaactaacactggagggggaggggaaagcagaacggggcgggagcatgggatcggatgaggttggtgtgggccccataaattgtgttttctatcgcagctagcgtggtaaaccgtgctatcgctgggtggtagattagtcactcgctttcttctctctccttgtttctctcccttccatacaggaatatgatgatatagcatattttggagcccgctgaatcaccctactgtaactgctttcatgaacttcatagggcactcacagtgcgtcctaggtttttgaggagccaaaactgccacctaaaactaataacttcgtaagaaccatcctccacaatgcatgtgacctatttttttccttcccagtgggttctacccgttctctctcctctctttctctctgcctttccccacgggttcggagcgtccttctcaatggcaggagcaagatcggcggcgcggtcgtccttgcggagccgggcggagcagcgaaggcggcgggcgccgacggcctgagcggcaacagcaccgggcgactgtcgctgctcgggcggccgggcaacccgggacggatctagcggaacggccctctccccgcgggtccctgcggccgcctctcccctctggcgcttgcctctccgccccttcatctccccctccggcttcctcatccagcggcggtggaggagcccccagcgacgcgactggtggggcacaggggtaggccagcgaggtccccggcaagggcacgcagcggcggcggtcgaggacgtccccggtgatgcggtcgacaagctccccgagctcacgtggcggcgcggtgccttctctctttcctccgtctcccttccccctctctgttcacaagtggcacggagggggtgtaagcccacttctgcgaggaactggtggcaaagtttgcctccctgttcctctgttggtcacagcagatgctgagatggcgtggaatctcctacttggattggtgaggctgaagtgaaccgtagaatgattccttccccgttggatggtttctggacatgagtgaggaccaccaccaacttctcgccaccccgtcacgacgaagacgtttgctccgcggcacaccccgcgactttgcgtccgcaaccggcaaattcgcctgcgatccgggcccgagaaccccccgaattgaaacgcccaccgaaacacgaagcccttccttcctaacgtatcgcccacattcctccacgtctcccgcaccgccctttatttcccttctcgattctcatctctatccatagttccataccctccccgttgcctcgcctaaacccatcaccccacgccaccacttcgccaccgccgcagccgccgccgccgacgaagacgacgatgaaggtggtgcggaacctcgacctggagcggtacatggggcggtggtacgagatcgcgtgcttcccgtcgcggttccagcccagggacggcaccaacacgcgcgccacctacacgctcgccggcgacggcgccgtgaaggtgctcaacgagacgtggaccgacggccgccgcggccacatcgagggcaccgcctaccgcgccgacccggtcagcgacgaggccaagctcaaggtcaagttctacgtgcccccgttcctccccatcttccccgtcgtcggcgactactgggtgctccacgtcgacgacgcctactcctacgcgctcgtcggccagccctccctcaactacctctgggtacgcatccatccatccaccgattcatacccaattcaagtatttagatcaaccattcaatctctcatctgcatcgctgggtgtgtgttgtgcagatcttgtgcaggcagccgcacatggacgaggaggtgtacggccagctggtggagagggccaaggaggaggggtacgacgtgagcaagctgaagaagacggcgcacccggacccgccgccggagaccgagcagagcgccggcgaccgcggggtgtggtggatcaagtccctcttcggcaggtaggtaggtggtcgtgccagctgccatgccgtccagactccagagcttgatgccaccatgatcgtgtacattattattgcttcagttcaaaggctagttggtgaattctgttcaactcgtcggcctcggggaatcccccaagctgtgaacctgttcgttttctggattagtgtttaatgtgtccgttttgtgatgaattgtggatatctgcaaagactattgtgagttcagcgtgattgtacttagggtgtgtttggttgcaagccacactttgccacagtttgccacgcctaaggttaggcaaatttgacaggtgtttgtttgtagccacagttgtggcaagattcccctccaacaaattgggtcccacgtgtcaatggctcaaaaaagtgtggcaagattctcttaggcttagtaagttgtggctaacaatttgaccacctcaccttaggcaaagtgtggtaatttttgttggcaagtaatggtaaagtgtggctgggaaccaaacagtcccttaatttactagaagtactacagaatcagacgagtatttttgctccgaaggccacatgagtatttgctccgagggctacaggtgtttcgcaggatatttatccatgatagggtatgaaaacggttggagacgatagagtatttctacggagatgattttggtgcaatcaggaattttctatatacataaaatttaactatttggtgctaattttaatatgacacaaatagaaagtagaaaatctaaattttatagtcggaaataattgacaacgatattgtttttaacgaaaacgatatcctaccgttttttcatcctactgcaaaacaccgtggcaccagctcctgccttggtagtttaactgcaaaggacctggatacttagagcaaaggtaataatatagtctattgccagctccaaaaaatagccatgtgtacacagtgtagcgctaatgtgtattatagaagcactgtagcataaatattttattatattagtgggacccatatcttcatatatctcattctctttctccatctcatccccttcctttcatgtcgtattgttctccagtaagtc

SEQ ID NO: 808 - DNA, 16076 bp, Oryza sativa
cgaaggccacatgagtatttgctccgagggctacaggtgtttcgcaggatatttatccatgatagggtatgaaaacggttggagacgatagagtatttctacggagatgattttggtgcaatcaggaattttctatatacataaaatttaactatttggtgctaattttaatatgacacaaatagaaagtagaaaatctaaattttatagtcggaaataattgacaacgatattgtttttaacgaaaacgatatcctaccgttttttcatcctactgcaaaacaccgtggcaccagctcctgccttggtagtttaactgcaaaggacctggatacttagagcaaagttaataatatagtctattgccagctccaaaaaatagccatgtgtacacagtgtagcgctaatgtgtattatagaagcactgtagcataaatattttattatattagtgggacccatatcttcatatatctcattctctttctccatctcatccccttcctttcatgtcgtattgttctccagtaagtccagatgatgttcagtggcgctacggcggtgtggatgcaggagatggcagcagccgtgcgacgatgaggaagatggcggcagccgtgcagcggatgtgggtgatgccggcagccgggcatgatgagggcgcccatgcggcggacgcgagatatggcggtcggtgtgcggataacacgggagatgagcaggacgggggtggcggtcgtgcggcagacgcgggagacagcgacggttgtgcggcgggcatggaagacaaaggcggccgagccagatggcgacggtcgtgcgatagacgcagaagatgggggtggccgaactggaaggcggtgacggttgatccagacgactgtgaccgtgcggcggacgtggaaggcgccgccaaccgtgcggataacgcgagagacgacgatggtcgtgttgtacgacggatgcatgatatggtgtcggtcgggcggaatgagagcggtggtgacggctgcaaccaaggtggacgagggaagttgctgcaccggacaagggtgatgtctacgacgtgacggccatggccgaggcggacgcaagcagtgacatccgcagtagctgaggcagacgtggccgacggggggcgaggtgggcgctggactcaggtgacgaccgtggcgacgagggaagacgaaggcatgtggctagcgcaggggcgccatcgttgtggcgagcgggcccacaacctcgggttgcacgtggagccgagcgactaattagtccccgctcattctctctcttcaactatctcttctccacatcagtgaaaaatcctacgtggtgctcctatcgtcaattattgtactcgctcttatagaaccgttctatcgctgaatatcataccctacattagtagtttaattgtagaggacctggatccttacataactgttttttcaccgatcactctcatgaacactttgtgagcggtattttcgataaccgtgaaccgtgattactgctcagttaccaaggaaaacggttgaattcagagtttcagactaaatttgacgatgaagtttgattttcacttgagatttttcaaaacttgagtacttgactggtttggtggtttgccaaacggtttctagattcatacctccactacatcaacctaataaatatttgaggagttactatatccgtctcaaaataagtttattttcactaatcttgcacatacaaaatgactagaatacccctaatttatcaaatcccaatgtaactatttctcattttatcttctccaaatacaaatatcccatattttcacaaatttcgatgcaatgattattctaaacatgaacttactttgacacaaatgaaagaagctagaaatgcacttattatgaaaccgaggaagtacatcgcatttgtaaaccttgcatagaaaaacgtatcccactattgttccctagcagcaaaaggattctcgcctgaacaaacaccaccaaacttactcgtcctttgaaatatggaattttattccgaattctgcgaaaattgaattcggctgtgtagaacgtctgcggatctccatctacagcccattttgcagcccattacgcacagagcccagcccaacttcccccaccacccgacccctaaattctcgttcggtgattcgcagcgccgccgcgctgctcaccggcacctcgcgccgccgccgccgccgccaccaccaccacctcctccgcctctcctcagctgcgtccatcagaatcccgcctcgttccttccgctaccgccggctgggatagagaggccacgcagctctcgtcgtgcgcggttcaggcaactcagcccgcgcaggcccggatatggcggcggccacgcgcgccgcgacggcgtcggcggcgaggcaggtgacgaagcggaacttcgcggaggccgtgcaggatctggcggcccacgtggaggcgtgcgactacgtggccatcgcggcgcagaggacgggcgccccgacgggctggcggcgcgcgctgccggtggacaccccggagacggcgtacctgaaggctaagctcgccgcggagtccttccagccgctccacttcgccatctgccccttccgcgttgatgccacatccccttcgaccctcgtcgcctatccgtaagcagctctctctccctctctccatcctgcataaggattactatggcagctaggattttcgacaatgcattttgtcgaacgtcttgcgcgatttctgtttgcaacttgcttgcgatcaaaatgtcagcggcgtcttcgagcaatatgaaatgcatctgactcttgccttgcagagtgcatcagaatgccatacagatgagaaactacctgtgttgtcaacatttttcctagtttggcgaggagttattgaaagttgtatctccacgttacatctggaactagtttaagtagtgaaaccaggggaaacgaatcgtagcctcgtaggcaagcttatcacatgactagttaattttctttgcagtttttatgctgggccagtgatgaaaaaaacatgagcatgaaggctcatcccaggatgtaaaggaagactactctatcgtcctgggttcgattcttcacgctagatgtttagttgaattgtcaggataaaataatgctagaggctgtggacagccaacgatatatattatgtaattcagtagagaggtggtacaaataaagatagaagtgtccacttatccatgttgtgaggaaattaaatgatgtatttgaaataaatagcctgttataaggacaagcaaggtgttaatccaggaaaaaaatgacatatggtttgttggctcattgccatttctagccttacaaaatttttttgccagtgacaagaattggtaattgccaacttttttagtaaaattggctaggtctttgtttggtttggtgccaattaccaaagttgtacttgccatccaactaagcatatgccaataatttggcaatgccaatttttggctacaaaccataaagatgactaatattctgtcaccgtcaatgattttttggtttggttgagtttggctacaaaccaaacagacgcataatctatggaaatcgaagatgggggtcctttagcatagtgtttgaacttttccacagttaatgtagagcaaggcaggtccaattgtattatcacacaaatgggataaatgatagaataaatcagcttcagtgcttaagtatggaccaggtaatcaggtaataactgaaagcctttggctgtactgatatcctctgtcattcaatgaactgaatcagttgacagtcaaatgaaatataccatataaactagcaagcaacccaccaaaattatatgtgctgtttcaacttgacgtcctatttgaggaactgaatcagttgacgtcctatttcaacttcctggggatatagatcaaccatttgaggactggtggctagcgatgaggcaaaggtttgcgaagcaattaagaagagcattcgattctctatgtttgatattaagttggcttgtgtggaaggaaaggaatgccagaatttttgagaatcgaaggaagtctccatcgcaactgtttggcggtgtcttagaggagattgtggtgtggagagaagcgggagtgttcaaagaacctgctgattagctgttgtctttagtggatgtggttttggcgacttgtctgccagctccaactgaagctagcctgtttcttccagatatcgacagtgttctgttgaggaaaatatgctggcgttaatgtaaacttaactttattgcatttcctcttcaaatcttaatacaatcggttggtcgcttctttggccaacctggctaaaaaaaatggtatgtgctattgcacagaaattaccatatttaaggacaacaaagttgctttgaaaatctctatatctcctggagtagctcttgactccgacctgtttctattagaacaacaatttaaccatactaaaatcttctgcttgtgctactttcaaagaacagtacttgtattgacattcatttatgcatgacaattgaaaccaccctgttttgcatattttactagtttgttcataacagttaagttcatttatgaccatggccaatcaatttatccatttttattgtctataaatgttagatgcagttttgtatggagttcacaaaaatttctagacaatcaattcaaaatttttgtccacttgagagtaccatgttgtgctctcccttgcttcagtccatagtattttgtattccctgattgttgctgatgcttttgtctgtattttggatgtacaggtacaattttcatttatttcccagagatgagttacagttgggaatgcctgcttacagtttttcctgtcaatcatcttatttatcatctatggctcatagtggttttgatttcaatatgtgcatttatgatggtgagtattataccatgtactgtgatgaatagcaagttgtattattttttatagacagcctaattttctggtggccatatgccaggtatatcttatttatcaagggctcaagaatccttggcaagggaaaggatatttatccctcatgttcgccaattatcatcgtcaccaagcacatccattgctgattccgtttttctgactagaattaaatcgagaatagagcattggcgaaaaggatatacaaaaccatgtaaaacagctgatggtaggttattatagataaatgttcagtctaattctagtctattggccagtcctgacatcgcttcttactgggcaggttctctagtaaatacccttaggcaactgattttgggtagtgaatcgtatggttcaaggcccagtttcagcattgatgtttgcagtgatcgccaagttcaactggttttggaggtgtgtttttacaagttacatttgctttctctttcttcaaatatgatttcatcaattattcagagaatcatagatttcatcaagaaaaaaagatgaatttaggttgagcctacttatgttctgaattttgtttcactattgtattggttttgagtactgatatatgaaaataattcactgattttgagaactgatatacgaaaagaaatccactgatttcatgaagaaaaatgaatttaggttgagcctacttatcttctgtattttgttttactattgtattggttttgagcactgatatatgaaaagaattcactgatttgtaacagatgctttgctttagatttaacatttaatttcaataagccgatccttatataaagtataaataaataaaattgcaacaagcgaaatggattgttccatctgttacatcacgattatgtaagctgtaaagttaaataataagcctgtttacctgtgtaatatttgattgttttgagctatgctgcaggcagcaaatcatatctctgatgaccttgtacctcttgttgttccggacaaagctgggacagctagggcagtgcgtgtgatcttcactagttctccagaggataagaaccttctcctggtttgtatctcttcagattggcagcatgtgcttgtataaaataaaaggaaggtgtcacgtattcaggatccgttcttatggaaatcattttcagatggacataaaaaaaatggaggatgaacataatttgaagttccgtggttttcgagaagttattgatctactatcatcttcacagaaaccaattatatcttataatttcttgaatggtaggttgatgcataacaaacctgcacaattttctgacatgttaatcttttttgctcttgatttcaacatctccctcttatcccagatttcacaatgatacactccaaatttgttgcacctcttccaccaaacttgcatgaattcatgtgctccttgaggatggtattttctaatgttattgacatcagtcacatgtggagagaaattggccctttgagaaaagcgaagaatatacaaggtgctctgagttacctacaaagacaatactttgtgccgatggatgtagaaatacctcagcaaggtatagtttcagctgcataattgacatgccatgtttattcataaaccatggatcatttccttttcaatcgtgtttgggaaaccaaatgaagtgtgggtacaaaatcgatgactaaatcttaaattcttcaagctactgaactctcactttttattctcttttgcagatggtaacaacagtgtcaccaaaagtggggaaaatgttctgagaataacaaagttgtttgctaaactaagtaatttactgaaaatcagtcccaatggtcaaactcactctggtgataagtgtcacacagttgaggaatattcttacatattgtatccgagttgtacggctgaagaatctgaagatgataaatccagtaatgagtcaaataccaccagatcagtgagaactgataatgttgttttcctatgggggtttagggagacatctgtcaaagaactgagatctcgccttgcaagcttgcatcatgccttctcaaaagattttgagctcagattattggataactcgtgctcagctttgatattccacagttctgatacggcaatagatttactaagagaaataaactcggaaagtccctctctgaataatttcttttcggaaggcctgaaagctgcaggctttgatgcctacaggaaggtttgcaggtcagggctttgggattcagatttagctgaggccctggatggtgtttcatctgaaccatctacttcaacgctttctgggcgtggcacctctgagatatgctggaatacttcgctgatgctagatctaaaggaatatctggaacgctaaacaacatatatttttatggaagtcgcctcagattaataagagtttccaggtctgatcaaccacaaccagtcagcattgctggaatcttcagttaagctcctatgaggagaacatcacttacacgatgattatgttgcttgactgaccataaatgggcaaggtgtttctattcgtggcgcaatcatgtggaacagtgatattgttttcagcttcagcacaatggttgcttacattgcttactcctcacctgacatggcatgactacatttttcgtaatatcagctaacccaggtttctcttgtctttacggagcttccacagaaaacccaggcactccgaggtgaaggtcatccttgtacacaatcagctggccattgcttcgtttgatggacgacttgctgctgaagaggaaatcagttacaccgactcagatccccacatgaggactacctcaccgtattctgatctcaaacgattcgtaaaactagccttctgtggccatgagagagcaacgcaggactcttctatgacaactagccagttgcagcacgcatggaatcgtcaaagtcaggtactcaggtggggaattagtattggaacctaagcccgaaagtcagtcggtcacagcattgtgaacgcatgccatcgtgttcctgcctaaccacatggtgactcctggcctgtagagcaacaccgtgaacacaagcaacgccaaagtctcctttcgacattatgtccagacatttgcagtgggaaaaaagtatgctttaatctttccctgcagtgttatcccctaaccaaccgaatgaagagactgtttcaagtgacatggtatcaagggagtaaaaatttgatggaatagaaggcaattttagtcgacttttctgtttaagaacggtctgaagaagaaatatttgtgctctcagagcatgagcactccagaaaagaaactagatctttagatctttgatgtgatacaaattctcatttatagatcgtgagatggttattttctccttttggcagtagggcttcttattggctatgtattttaacaccaaaccataaccacatgataccaaaattttagcaataccaaatcgtgtattaaaccaaacgagcccttcaagtctcatcgagggacatcaaagcagaaaattgtgaagatgtgatggtagttggatatacttcatggtgaaaacacactcgctctaatatactcatacaaccacttacacctagtcatgcaaactcaacaaccaaatcagcgaaataatattcataataataaaaacatttaaatagcttttaaatggcgttacacaaagtcaccaaccacaaagtgaaagaaccatagagagagaaaaacccactagaaataggcattgaatgaatgatggagtgacgaagtaacaataagcaactcacaagttgaatgtgaaaaacataagaaaaacaaataaaaaaaagatagtcgtaccgctggatagggttggatatggttgaatgagtaaccgagtaataagatcaaataagtaatagtaatatggcattatgtttagcttaaaaaaagtatatgtatacatttatagggtaggctcaacttggttccactggctcactgccctatctagcactttcccccctcatcttcttcattgcccctctataggctcttatcatttttctatttttcaatttttcgcgtgacctcaaataagatcataaaaatatcttagatatagaaactagagatagttggatgattcaatgaagttactttgagtatacttactaagttgaaaaaagatactgaaaaaggtgtaaagataaaataagtttaatataatagatttctaaatttcacacacaatgccaataaaatgcatgctagcatcacaattgtaccaattcaaactaatgaataatgttggatgtacggttgaatggtgggggcgaataagtaaggggtgtgcttagtatgaaagagcatccatacacgcttcaaggatgaaactttacccggttttactggctcgccgcactattaagtactcacttttccctcgttttctcctttatccctctataggctcggggtctgttttcatcttttcgattctaattgacctcgcactaaaataagccaatgataacacttggatgatgtgctgaagtaatcccgagtatataactagtttaaaatatatgcatccgaaaaaaccgtaaaagataaataacgcctaagaacatcaacaacaactttctaaatcttacttactaaatgctaacctaatattaccattgtaattgtatcaactctttttttttttgacattggccctgtttagattccaactttttcgtcacgtcgaactttcccacacacacaaactttcaacttttccgtcacatcgttacaatttcttcaaattttcaattttggcgtggaactaaacaaagccattgtaattgtatcaactctagccccgaataaggtgttaaaagaaaagagggagggaaggaaaaaaaaataaaaaaacaagtctaaccccaaatagctttagatacgcgaaatggggcaaaaacaaagcgatggccgaacacccgtacacgtctgaggggtgggcccgacccggttccgccggctcgtccccccgctttcccctcgccttcttcatccccctcctccctctccattcctggatctcctccgcctccgcctccgcctccgcctccctcgcaaggggtctcccacgcatcgccgcccgccgctgacgcgtgggagccaccccttgcccccccccccacaccacccgccgcttcccatctccgacaagcgcctacaacggcgtaagtagccctaaccctaggtcgctggatgcgccgatggccgccgccgccgcagcctgcgtatagagccccgacgagggcgtggagatccgggaggtatgggcggggaacctggaggcggagatcgcggcgatccgcgacgaggtcgaccggtacccgtacgtcgccatggacacggagttcccgggcatcgtgtgccgccccgtcggcaacttccgcaccaccgacgagttcaactacgccaacctcgaggccaacgtcaacatgctcaagctcatccagctcggcctcaccctctccgacgagggcggcgacctcccgcggcgggggacggggggcaggcgctgcatctggcagttcaacttccgcgggttcgacccccggaccgacccgtccaacgccgactccatccagatgctccgcacctgcggcatcgacttcgatcggttcgccgctgagggggccgacccgatccgcttcgccgagctgctcatgtcgtcgggcgtcgtgctcaacgccgacgtgcagtggatcaccttccacagcgggtacgacttcggttacctgctcaggctgctcaccggccggaacctgccggacaacatgcccgccttctttgacctcatcagaatctacttcccggtgctctacgacatcaagcacctcatgaggttctgcagcaacctccacggcggcctgagcaggctcggtgagcttcttgatgtcaagcgtgtggggacctgccaccaggccggctctgactcgctgttgaccctcgggtgctacaacaagatcaaggaggtgtacttcaaaggatcgaccgagaagcatgccggtgtgttgtatgggcttgttattgaggatggggtgaacagaccaccaccaactcagcccaatgaatgaatatggttagttaaataaaacaatctgaaatgggaaaaaaaattgaaactttcgttggtgaatatatgttgtctgatctgatctgatgatttgcttatggtttccatggtagtttgttgtgccttgctgttactatttgttgtagttgagttgctttagttgttttgtctttgactctttgtgctgtgcaatcatctttcattgtttgcccaatttttatcgctgactgcactgtttagttcaagtagcaagttcttgtcatgatgaattagtgcgaaagatagtaggatagttcaaattatgtttagggactattgcattagatatcttggacagcttgtctggttaattttactgcaaataagcgattgcttcgcttccatacaaaagtatgtatttaatatctgatcgttctttttgatgttgttccctgcctgtgcaatcaggcagttcgtcatggtgttctgaaggtacaatactctcagcatgacaattcttttttatgttgacatgcctgtttgtgtggtggttgtccttcgtttctcagtgggtacttctttatatcactgcttgtagtatgctgatgaaatgcaaaatcttaagtggtcactagctagactacgaattatgtttgtttcaaaatgttttcatatgtctattgtatatcattgtttgcatgtactggtgcctagctagcacctttacattatcatttataggggtgctaatggactggatttaagtgggctgaatgggttggatctaagaacgggttggctttggttgggtccgactggattgatttaagatttggcctggatcgatttggggctacaagtgaagcggtttggattggattggatctggctgaagtgtttttggttttaaaatggattgaacccatggaccccaaccagtacattgccttggatcctggtcgagtggttgcgcaccgggtgtccgagcgtaggaggcgccgctgtccctcccctccccccagtcatcttccgtgcacgggctgcaggaggtgccaccgctgtcctgcctccacccaccctgggcacagtcgcgccgactgttagaacatcgacctgagggtagtgaagtgaatgaggtgagcagagcaaagaacaacatcgagcaaccaactgggagtaaaagagatgagattctttggttgaaatctcaaaaattggaaaaaaaaggggacattgaatgcatgatttcttgaagatttcttgaggatttgttgtccagcactcagcaccttaattttaaatctgtctgtcgccatttgttcagcggcttcatgtctcagttattgtcctcgccgtcactgtcgcgtgggtgccagcagacatggtgcagagtgatgtcatcttctgtcagcggtggcactttctcgaaaccagccatgctggggcacggtgggagacaccgaatgtcgggttgccttgtctgtggcaacagtatggatttcattttctctaggaatggtctcagaatgggttcaacctattattttgcatttggtttggattagcttttgtgttggggtgggttggcttggattctacaagtgattagttgatttggagtggactgggaaatatgcaatacagacaaatggggcggggtggatttggaatgggtttcagtccactggcacccctaatcatttgatggacgttctgcatatcggtaacatgggggaactgaaaagattaacatgatctggtttatggttgagagtaaatatagattgttttactagctagcttgttttagcttcgtaacatgaattttagtattcatatttttctatgttgtttattggttacaaatgacaccatttcatcagatgatgagctttaacaaatgcttcacttgagtttggtcatgtggtctgatatcttcttcaatttacatttaacatggcattcctctatcgcaactgcttgactgaacttgctatcaatcctatagtttttctttactaaatattgatgatgacattttttattccttatactagatatttgatggtctgtcatataaaattcaattgaaattaattagacatctataggaatgtattactttgtgttctgttgaccagtttctgcagttgtgcatttagctattcattgtatggctgtttcgtttgcttttatctctatatgtccggttgttgactgtttatgtggcctttgggaggacttgcactctttctgtttgatgtttttcttcctgttacttcagcaatacctatgtatgaatgctaattatgtttaagcatttctctcgaaagaagagaggacttataaataactttacatcctaattatccagtaaagaggtacttctgtttgatgtttttcttcctattacttcagcaaaacccatttagacatgccaattactttaagcctttctctagaaagaagagaggacctgtacttgttttgcatgaatagtgttcctttttgaaacttagtagtattatggtaatgaacttctggcttggtttctgaagtttcctgcattggttatggtcttggtttgccaatcgtcacatttctgtacatatggcagaacacttgttctacactgacgacagagctcctgctcttatttgaggtcttcccaacagagaagtttgagtctgctcatttccttttactgtattatctgatttggtctactctgtgcctgtggtttgatatttcattcccaatggtatgatcgattgcctttgtggtttgatattttatcccaaggcaggacctgctgcatcatatatatgaatccagagttccattgccgactaatgtggatgatcctattaataggatcaacacaccaaattgtttggtttttgtactaagtaatattgatatgagccttaaagatcctttttgtttcctccctacactgtttggatgatctaataggatcaacacaccaaattgtttggtttctgtactaaggcctggtttagtttctaactttttcttcaaacttttaacttttccatcacatcaaaactttcctacacatataaactttcgtctttccgtcacatcatttcaatttcaatcaaacttctatttttgacgtgaaataaacacaccttaagtaatattgacatgagccttaaagttcgtttttgtttcctccctacgctgtttgcatctgcttacaatgcataccagatgcttatctgctgtcagaagcttactctttgtttgactagttggattagaaatcaaaatggaattaatttactggcgttgaatgcggctatgcataactgcccatggctggattgatccctatcattttggctactccctccatcttataatatagcaatctaaaattagatggaacactttatagtacaacgaaacgaatcgaagtatgtcttaactctctggataggaagtatgtatgaactcgttgtactattaagtatctcgtccagtactagattgctatattagggacggaggaagtatcattttactcttaaatataggagtagtacaaaagattcctctgctgccaatcaggttggcacggatttttcctttttttgtttataggaggtaaaatcgattgttaccactactacgcctcgatcacaaaccttgagtcggcgaagtgtatattttgacctcacacgcggaagataaacttcacagagcttaagagaaaaatactttttatgaacggaagcttctattaaccactagctcaagccgtcggaccaaaaatattttcctcggtgtgcacaacatgccatttattgtgcactactataaatatgaacacccattttataatttagaccactaatccataggtgatgcctaaagttttttctatttagttttaaagtttttagggatgccagtgcatacttggaggcctcggtgcctctaggcgaatccgtgaacaattataaagcttggcgccaggaaaatacatagttgagcttgccattgattttttaaggaagggttaagtccgatttaccccctagactcttacgaaagtatgctttaccccctaaactatgataccagacataatacctcctttaactattcaatttggacacttaaccccccgcgaccaatttcggctggttttacccctttggtctgacatggcactcccatgtggcaaatgatgtgccagttacataaaattatccctaaatagtctaaattatcctctctctccctctccctcgcgaaaaattccccacccaaacccctaaccctagcggcgcaggtggatctgggcggcgcaacggcgtggtgaagggctgcactggggcgtggtgaagggcgacgtaggcgaggctctgcggcgcgagcggcgcgcgctgcgcaggctccgacgctcacacggcggagcgagacacgcggcggtgcgacacaagcgcagcggcgaggcacacgcgcagcggcgcgacgctcgcacggcggcaaggctcaagcacgggacggtgcacaggtatgccacagagctcaagcatgtcactgatgcaaaggtgcagatggaggccaatgttgctaggcacaaggaacagatggaagcaatggggaagcaaaaagatgctggaaaatgctaatctagttgctaaaaataatatattagataagggaagatgtgtgcttctgtatgcatttgtagcatgtgtatttgtaattctggggttgtatgttaagctgtgatcttcctgtatatgcaatgtactagcatgtaatcactgcatgtaatcagtactgatatatgtcatggagaggctatttgaaccagcatgtttctcaatttgtgatggtcatgttttgtgcaataaagtgtgtgcacagttagtataaatcaatcaaggaggctattttgaatagcacaagggaatatatgcttcagtg

SEQ ID NO: 809 - DNA, 1256 bp, Oryza sativa
cgcagcgccgcacagcctcgcctgcgtcgcccttcaccacgccccagcgccgcccttcaccacgccgctgcaccgcccagctccacctgcgccactagggttaggggtttgggtggggaatttttcacgagggagagggagagaggggggggagggggagggcagggatatttttatgtaactgccacatcatttgccacatgggtgtgccacgtcggaccaaaggggtaaaatcagtcgaaattggtcgcgggggggattgaatagttcaagggggtattatatctggtatcatagtttaagggggcaaagcgtactttcgcaagagtttaggggggtaaatcggacttaaccctttaaggaataacctatatcacttagttgaaatttggcccatagttgaaagaaaaaagatttacttttcctaatatttgcatgtcaaatatatctccaacacgcattgtaaattaaatacgtgtctaagttttcttttcacacaaggcagtaacttagctttgataaaccacatgaaaaaaaaattgatgggcccgatacatcaacattgtccttatgcacacccatgatgagaatatatgtgtcctattaagacgcacttatagcaagcatttttgaagaaggcaactttgttaaaccacatacctgaatactttgataacatcagttggctttctcagtatttcactcctagcttgttggatttcctacacaaatagaattgtggttgctacacgaaaactaattggatttcccatgcaattttacaggaccaattaaatagaaatgtgtttactacacaaccctataaatagaaatgtgatgacatcgccgttgacagtgttcacctcttgatttcatggaaggtgcgtgaggtgggatgatatggagagcgagggcttccataagataatggcctactttcccgacaatttggtgaatctgccgcctgtccctgatgaggtgcatatgtgcatgtcacaaaccatagatctattctccccactatcctcaccagtgttaaggaggatggtgaccaagctgtttaatagccccactgtgtgggcaccatcacaacggccgccaccattctagcgctaccactgatggtggagcttgacgcctatgtccactacatcatggagtctgtcggggagctactcctcgtgagcatgctctagcactagcatctggtacacaaggtggacaccgtgacaaggtgtttgtcccggtcagaagcc

SEQ ID NO: 810 - DNA, 18095 bp, Oryza sativa
aatagaattgtggttgctacacgaaaactaattgattttcccatgcaatttacaaggacaatttaaatagaaatgtgtttactacccaaccctataaatagaaatgtgatgacatcgccgttgacagtgttcacctcttgatttcatggaaggtgcgtgaggtgggatgatatggagagcgagggcttccataagataatggcctactttcccgacaatttggtgaatctgccgcctgtccctgatgaggtgcatatgtgcatgtcacaaaccatagatctattctccccactatcctcaccagtgttaaggaggatggtgaccaagctgtttaatagccccactgtgtgggcaccatcacaacggccgccaccattctagcgctaccactgatggtggagcttgacgcctatgtccactacatcatggagtctgtcggggagctactcctcgtgagcatgctctagcactagcatctggtacacaaggtggacaccgtgacaaggtgtttgtcccggtcagaagccttgacaaccgctccctctttatcagctagatcaggagtttctctgtcgaagctgacaacttgcctactgtcgaggctggctgcatctacttcatgaaacagaacctggcaaacaacaagtatttttgtctcacactcagatgattggaggaggccatatgcatggttaatctacgcaatgttgctgaagcagaaggttgcatcctccctctcaatcaggagcaagtcatgctaaattactatatcaacaatgagaagtcaacaatgctcaacttattagcaggtgataggtacataacagagagtagtctagtggcgcagaaaaaacatcactaagaaaaaaaagtttgatggtttagcaaggcaacacgtagaaaatgatgcacctttgtggatggtggatggtgaagtcggaggagatgaagggatggcagaagcctgattgagtgaagcatgttgggcctgacattttcccataatttctctcaagataaaatgtgtccaacccacttattctaaaatagtatgatggtggctagggtttgaaggaaaagagggtataaacctagattagcggcataacacgtacgattgatattcatccaatggttacaaattgagtagccaattacaaaacatgccagttaaaaccaagatccctctttaaatattagcgacaagtagcgctgctcatacagtcacatgcattgcatgtggaagtgcaaatccatgcacataggaacaagcacctacgagggtttagatcttgtctccactggccgatcaaccatagtggtaatggcaactgactgatccctgccccctcctccgacttcatctatcacgtcagtgactgtctcttagcttccgaagacttcgacaactacgacactttgcgcctcatctgctccaagtggtgtctggcaccaccaaccctaagacgacggacttcgacgatgcagcttcctcaagaagctggccattctcgagctcaacggcaatagatacggggacgcctccattgccacattcttcaaacttgacaccggcagcttcgtacgcaaatgtgtcctagtgctacgtgactacctcttcatcgccaacatggccattggccttgtcatgatcttggagatgacgccaccccataagaccagcatgctcaacccctttcatgcgtaaggtcgcccattctagggagctcatccatgcggaggaggtcagggaggtggccacgacgaactcaccattgatggtgttcacctcctggttccatggaaggtgcgtgaggtgggatgatcaggagagcgagggcttccataaggtaatggcctactttcccggcaactttgtgaatctggcacctatcttcgatgaggtgcatctcaccaaccatggatccatcctctccattatcctcatttgtgtcgaggaagaatgcgaccaggctgttcaatagccctgctatgtggacatcatcatgatggctacaaccattccaactctaccgttgatggcagaaaaaagctcattaagaaaagaaaagtatgatggcttagcatggcaacatgctgaaattgatgcacctttgtggatggagtatggtgaggtcagagaaggtgaagggatggcagaagctaggctttaatttggaggcaatgactgagtgaaggatgttgggcctaacatttttccataatatctctcaagataaaatgtgtctaacccatttattctaaaatggtatgatgatggctagggtttgaaggaaaatatggtataaacctatattagtgaaagaggacgtatggttgatcttcatctagtgtctataaatcgaatagccaatcacaaaacatgccaattaaaaccaagacccctctttaaatattagaaatgtgtagtactggtcatacactcacctgcaccacctctggaagtgcaaatccatgcacctaagaacaagcacctacgagggtttagatcttgtgtccactagccgatcaaccggtagggaggtggctgtgacgacctcgccgttgatggtgttcacctccgggttccatggaaggtacatgaggttggatgataagtagagcgatggcttgcataaggtagcaacctactttcccggcaactttgtgaacctggcgcctatctccgatgaggtgcatgtcaccaaccatggatccatcctctccactatcctcgcttttgtcgaggaagaaggcgaccaagctgtttagtagccccgctatgtggacaccatcatgatggccaccaccattctagcgctatcgttgatgttcagagcttgacgcatatgtccattgcatcgtcgaatatgcctgagagctgctcctcatgagcatgctctagcgcttgcacctggtacacaaggtgaacaccatggacaaggtgtttgtcctggtcagaagccttgacaaccgctccctctttatcagctagatcaggagtttcgctgtggaagccgataacttgcccaccatcgaggctggttgcatctacttcgtgaagccaaacccgacaaccaatgagtatatttgtctcaccaactgatgactgtaggaaaccatactcatggttaatctactcaatgttaatgaagcagaaggctgcatcctccctctcaccctagagcaagtcatgcagaattactatatcgacaatgagaagtcaacaatgctcaacttattaggtggcgatgggtagataatagtgagtaaaatagtgggtaatccagtggtgtaggaaaaaatctcatcaataaaagaaaattatgatggtttagcatggcaacacgctgaaaatgatgcacctttgtggatggagtatggtgaggttgaaggaggtgaggggatggcagaaactaggctttaatttggaggcaaagactgagtgaaggatgttggtcctaacatttttccataatatctctcaagataaaatgtgtctaacccatttattctaaaatggtacgatggtggctatgatttgaaggaaaagagagtataaacctagattagtgaaacaggacatacgattgatctttatctagtgtctacaaattgagtagccaatcacaaaatatgccagttaaaatcaagacgcctctttaaatattagaaacgtgtagtgctgcttatacactcacctgcaacacctgtggaagtgcaaatccatacacctaaaaacaagcacctagaaaggtttagatcttgtgtgcactagccggtcaattggtagggaggtgattgtgacgacctccctattaatggtgttcacctcttggttccatgggaggtgcgttaggtgggatgatcacgagagcgatggcttgcataaggtaatggcctactttcaccaaccatgaatccatcctctccactctccttgccggtgtcgaggaagaaggtgaccatgttgttcagtagccctgctgtgtggacaccatcatgatggccccaaccattctagtgctacccctgatggcgaagcttgtcgcctatgtccaccacatcatggagtctgccagggaactgctcctcgtgagtaagctctagcgttggcacttggtacacaaggtggacaccgtggacaaagtggttgtgcctgtcagaagcctcgacaatcattccctcttcatcatatagatttggaatttctctatcgaagccaacaacttgcccaccatcgaggcttgccgcatctacttcgtgaagccgaatctagcaacctaggagtatttttgtctcatcaatagatgactggaggaggccatgcgcattgtgaagcagaaggctgcatcctcccctctcaccctggtgcaagtcatggtgaattattatatcaataatgaaaatttaacaatgctcacattattagacagtgatgggtacaaaatatttacttatccagtgctatagaaaaaacctcatcgagaaaagaaaagtgcaatggtttagcatggcaacatggaggaaagatgctaaggaggatgagggtgatggcgactctttgacaagcaagactagtgcataaaaggttgcacctttgtggatggtgcatgttgaggttggaggaggagaagggatggtagaagctagggtttaatttggaagcaaagaatgagtgaagcatgctgggcttgagattttctctgaaatttttctcaagatgaaatgtgcctaacccatttattctaaaatggtataatggtggctagggtttgtaggaaaagggtataaaccttgattagtgaaagaggacatacgtttgatcttcttccaatggctacaaatcgagtagccaatcacaaaacatgccagttaaatccaagagcccaattatgtcctaatgatatgatccctctctacatttcatgtcgtttgcttaatagtactacttttgttcgatgagatactgtggtgaaatcatttgctttggcttccaaaaagatatgttgctcccttcgttttttcatatatgacactattgactttttgagatacgtttgacccattcgtcttattaaaatattatataattattatttattttattttggtttgatactttgttgtgtcttgtttattgctaaaattttcttgtgttaccatgatttgagagttcagttgcttatgtggcatcacctatttaattattccatcatctagaataaaattgtatttgattccaattagtagttcactactcaaaaacctgtgcgctgcatgggatagtattttaattacatttttactatcatgttcaagaaaatgactttcaaatataaataactaaaattaattccaaatcagatattaaagttttaattatttgtaggcccatattatattatggtggtttgctttactttttttttcaagtgagctctaatagtgtttagtacacttttgctaaaactcatcagtttttttcctgggttatatcttttcagaagaaactgggagacccttttctgtttgcatatgtggttttactctttttttatatatatagatatgaagctaatatctttcttcctctaacacaatgtagattttcttttagtggttggggggaaggggtaataattctgtccattagtaggtttcttctttcctctaagtgcttcttggcgtttgaaagatcttattagataaactagtgagcagtccactttatgaaggttttgtccaactggtcataggtgccggatatcctaaccggcacctttgatttgttggtgtcggatctacaaccagcacctataaaacatatcggtgcccattttatgtaaagaactggtacctatactgccatataggtgtcggttcttaaatcgactgccacgtggacaaccttataggtgccggttgtactagttcttgaatacaaccgacacctatgagaagtatataggtgcttgttgtagaccgcgtaggacacatggcaattttataggcgcgggtttgtaagaaaaattggcacggcacctatatcttggcaagaaaaaaatggcaggagctccaatttcacatacaaatcacacaataatagaacttcacatcaattcacacccattcatcaacatacaaccacattcacattcatccaaaatctattcaattccatatccatcatcaacatacacacattcgcattcatccaaattcacccattcatcaacatatgcacgtgcctagtccatttatcgtaaaactatatgttggtggctagggtttggaggaaaagagcggatgagagagttaaatctagattagtgaaataaagactatgtatgctagatcttgatccaatggctacaaatttaagagtatgcacattagatcttgatccaactggtgcagtttgagtggccaatcattttgttgtgtgatttcgtttcaatgagatattgtgtgatcttgttttgcttttgttttgaaaaaaacttgttgtttggagattatactcgcaagccttctttatcattttgattggaatttgcctaatggaacaggcatatatgagctagatattacagaaacatatggggtcactgcgcatcgccgaactgagcttttgctcaaagctactccagtgtatgcatgattggtcggtacacctagtcagatatgtactgtcaagacaaatgtctggtctcttaaggccctctttgtttaggcttaggcttattggcctagacttttaagtcagcttattggtttatatgatttataagccagtggatttaatgtcctaagtttagtggtggagtcatacatctatctcatataagccaaaaaaagcttctccaacctagcttttggcttaatagtgttagagtggcttatggcttaaaaaagccaaatgaaaaagctacttgtttattttggcttagacttttcgacttataagttggcttataagcctaatcaaagagggcctaaacactgtccatgtttgcctacttttgtttatattataaataagaaatgcaaaatgtggccacagcgagtcgatttgagaccctgaagatgtacccaagtttgatgtttgctcaatatagcactcgcaagtcttctctgccatttcaactaggagttatcgggttgtgaaaccaaaaggagctagacatgagtgaagtggtctgaaagcttctcgacacactgatctttgcctagaggcaactcctttgttgccacagcctgttggatcttacgatatttcttgtaggagcactggaacagctagccacgtatctttcagaaagaacagctaaacggtgtgtttgcaagggggtgttcccaacactttcctctcgttttctgcgcacacgcttttcaaactgctaaacggtgcgtttttttaaaaaagtttatatacgaaagttgttttaaaaaaatcatattgattcatttttgaaaaaaaaatagctaatacttaattaatcacgtgttaatagattactccgttttccgtacgcactatacatgttcccatcctcccgtagcaaacacagaagctgctttcgggaggaggggttgggaatctccttcccggtacgcaaaacgaaacatgtattattgcatgattaattaagtattagctttttttaaaaaaatagattaattggaattttttaactttcatatagaaaatttttgcaaagaaacacatcgtttagcagtttaaaaaacgtgcgcgcggaaaacgagggagataggttgggaacttaaaggtaagaacacagcctaagaaaagctccagattacccactgcaggtggtattatatttgtgggtcacaaaccctgggtcagcatcctgcgtataattccagacttataccaagcttaacataattgcacttagcttaatagtaaacaaacatagttgataggtgtgcttgctagcgtcagcatgaagagcaaatacaaattatacaacagcttgtcgttctgaatattagaaagtaaattggctacatgaaacgtttgtatatttctcattttctgcacatcgtcatctataaccaacaaaatactcgggactcagggtttaggtcccttctttaaatttaaaagcattagcagaacaaaatgtcagtaaaattctggtgctatgttaaccttggacgcacccatgggaatgttgagtttacttgcttttgttaacgggaaggtagacgccctctgttgccaaccaaatattttcagctcgcttctctctaacgccacatacctgcaagataaatgctacaacttagcaaacaaatttccaaccaaatcacacttggtacctagagaattttgttttcacatatggtagcaaacctacatgatatgctttttttttttactttgttccaactaatacatactccctctagatttgagtttttttttttttggacagagcgagtacaatacacggtaactaataaaaagatgtgatagatacaatatgcattgaattaactaaaagttcataccaactattaagtaaaaatgtcacatccacaaacccagtcactcaaatatccctataaagtttttgcaataccatacttgtactataaccgtgtaatgatctaggattagtttgtttctgctaatctaccatctaacacttactcataatctggaggcaggaaataaaccatttactaaactcacctcttgctgcccaccaccaagcctgttgtacttcttgttgtgactgtgcagataacctccagtatcaacatgtcggagtcttactttctgatcctgtttccatagctttccacctccctcaatctccagcctgcaggacaccccaaaaaaaaaatccactaagccatactaaccaaccaaatggcatttatattgtgagccttaagtaattgcacctccaataatctccagtatctgattgtccatccccaccaaaacagctaacctgtaaaatcacacatacaaacctcagggattatatttgagaagataatgcaaaagaaacgcaagacatagaacttgcaatattatcctaatttagcagtgaactaataagtacggtaatttcttcacagtaagataaatcgatatatattcgtaacatacttaatcctgacatactcatacttaacatgcactgtaatgtggtgtgaccattgtaaaccactttgcttcagatcagcaatgttcaaacttcaggacaaaattagctctaaaacaaggacagcaacaactactggttattcaagttaacaaagcaccgtactatggaagatatactaatggtagttttagtctcattagttgcaagcaattctaggcactgttggccatgtaattcatgaacattagcaaatccagacagtggatggccgaatgatgtactattgcttcttgttttgtgttcttgttttcggataaaatacatatcaaattggcagatacgctgtcatctttcagctggtgtgtacaacaatatgagatcagctagacacaatatgtccacagatagggaaggataaagtaggtcttctaatcccatgtactattactgataatcatttgaagagagctcaatcagtttgaagagcactcaagcttttgggaaaaaataaactcagaatataacaactgaggtcctatgaaattttaggaactaaatgttgccagatatcacatgggatattcatgttgaaccaacctctaggttaccggataatggtgaagcatgcaagtggctatgtaaccatttccgtgtcctcatgtgttgcaacctgatgatgctaccggtttcaatggcatcaccctgtttagctgatgaatctggagagggccgcacgatctgcagatatacaagtaatcaaatagcatcagaaccctgattatgtctgattggactactcactacttgaatggcaatcatattcacttcagaatgtaactgctaattcttcagacgataaataataaagttttgttatttggggttgagatgtgatccatcatcctacacatataatagcagtaactacataaatacacaaaaattcttttgggcagtttccataatttgaacaatataggtgccattgcttacatatctcagtttgataattagtgtttagatattctattgccagcaggattctacaccctcaaatcaacactgttgagcacatttttaaaccgtcacaactcccaagcatatttgcacactgaactcaaatcaatgtgtaccatagaaaaaaatctattaatgtgagtagatacttgcattcagatcaatattgaatggttggttcaatcacatgttggcttgtacaaataggtagggatcaaatcaagagccctattataacatgaacgagaggaattacggatctacagaatgagacgcacccagtagctattggaatcatcgacttcggggaagccagtgacggactgctggccgctgcctgagccatacggcacatcgtgcgagtgcagccggtgcttcgtcttctcgtgcatcagcttgatggtgctcccataagccacctgcaacgccaccacacagatccagatcacacccgaacccctaaataaataaaaaaattcgcagatctcgagatcggggggaggcaggaggcaaacctcgacgccctccgccgccggggaggcggccgcggcgcccctgtcgaccccgtagccgctggcgccgaggaggaacgcgacggcgagcgcgagaacggacgcggccatcgcgacggcggccgcgctacgggacccctgtcgcggatgcggcggcggcggcggcgaggaggatgaaggcgtcgaagaggcggaggaggcggagctggctgtgcctctcctcttggctgctgcggaggcggcgccggctgaggccggcggtgccgtggccgcgggcggggaagcgcgaggcgctcacggtggcggtcgatctcgatctctctcgcgcgcgcggcgggcgtggggtgggcgtgtgcgtgtcgcggccgttgggaatcgggattttgccgagtcggggacggggggaggaggaggagtctccgtgggcgtggagaatgggggaagtggggaagctatacgcgtttgggtcgctggggactggggcccagagcccctccacgtgtagtgggcgaatggagggacggcacgtggcacggacacgtcgaagcttggtgtgcagaccgtaggatgcatgatgggcgacttggatgcagcgcggttaaggtcgcatgcgttaatgggccgtggctttttggtctgtactaggatccattcttgaaagggataagtctattttaccttgctcaacttatgcgggagagctaattcacgcgcgtgcgccggcggcgcgcgtttaggcccagaaagcccagcgccagcgcgcgcggggacagcgtttctttttttttttcgcttttcttttttttccgtgattttttcctttcctttccttttttcgattacttttagaaaaaaatttcgccttcttttttccgtgattttttccgctttttattacttttttttaatcttccaacaacacgtgttttttaaatgttttgtgttgaaagtttttaaaaattaacttaaaaatttttaaatctcgagctgaaagttttcaaatctcaagttgaaagtttccaatcctgagttgaaagtttttaaatccgagttaaaagttttcaaacccgagttgtcagggttatggataccacatacctaatagtagttgactaaatctcggtaggacccaccacataccatatcttatacggaaacaactttcggatataggaagagttccgcataaggaaggatgaatagacttctacatggaaacgacaaggactactccaattgtatccatattggtttccctagttctacttggacaaggggacacctatgggtataaatacaaggccccctaggagtagagaggacacaatcaacatacacggaacaacataagccaacatacgccaagacaagacgccggatattgacttcagagataaacatggctagtcccctacggtgcctacggataccgtcaggagagacatagcactgtctttgatctcgccggacacgaatttgaggaggaagaccactttgttgtcgactacgtgatgatacttcaagccgctatatcgacaacagatagataggctacctcaaatattgtactagtgtgattatggtgaataagagcaacgaccggcttcggccaacaggatgtagggctattacctgataattcaggggcccgaacctgtataaaaattctcgtctctgtctcttttacctaagtctcgcatatatcctggtaccaacgatccccatactgtgcaaataccagaatcgcgacatcaaacgtcgacacgagttgaaagttttcaaaatcctgagttgaaagttttcaaaaccgagttgaaagttttcagaatcctgagttgaaagtctttaaatccgagttgaaagttttcaaaatctcgagttgaaagttttcaaaatctcgacatgaaagttttcaaacccgagttgaaagttttcaaaatctcgagttgaaagtttttaaaccctagtggaaagttttttcaaatttgagatgaaaagttgaaagttttcaaattttggcttcaaaaattcaatttccgagttgaaaagtttttaaatatagactgaaagttttcaaaatttgacttcacacatagattttttttcaatctgttacttaaaaatatcttctagaaaaaaagtattatcttaattaccgtcgttatctaaaactaacatgttagttacgttagatatactcatcgaaaaaaaatccaccggcatacgcgataaaaaaaaccacaaaaaaaaataaaaatccgaaagtgaaaaaaagagtaatagaaagaaaaaaaaaagaaaacctaccctaggggctgcgtgcgcgttgccggcgcgcacgcgccaactaggaagcccccaacttatgccctgattgaatcacatcccttaaccgcaaaaccggatataactcatccctaagtcccaaaattgttacaaatcgactccccggcggtttcgtccgacatggtatctttgaccctgttgactggctgaatcagcttgtgggacccacatgtaagtgacaaggataaaaatgaaaatggtggggcccactgatcagctccaccacagagggatgggatacggcttggcgcggctcctcctcgtggcgctcgccgcgctctcgctgctcgccatggggggcttggacgaccaccatgccggccttagcctcgccgcgcttccgcgtgatgggatgagcgagccggctggtccagctggagaaggtttgtcggcatccatgcaagtaaacagcgagggtgtgcgcttgccttgccaacctcggtggcaacgccgttcttaccgtctccggtttccggtgccgccaccgagatagaggctgaggcgataagggacgatggaagggggcgcagaggacagcgatggtcatcgaggtgcttcaccatctgacgacgaaggagattgacgagggttccggccgccaccatgtcggaccccttcttttttgccattgtcaaggccccacccatgcttgaacggccagatttggtgccctgctcgagctaggacgaggggatgagaggaaaggggaggcgacgacactgagtcgagctgggaagagggtaggagagggcagggatggcgtcaccacagcaccaccacctcgacgtccattgtcgccacaggcccgcaaaactccaccgacggctgatgatctcctccccacacgcgttgcggttggctgacgagctcctccttccatgcgcggccagctggctgccaagctcttcccccgtgtgccgtcgccaccatcctgcctctatactaatgaaaggtgagaaaagatgaagagatgaaagagagagagggcgggaggagagggagaagatgggatgaggtgcagggcactgacaagtgggtccacatcggacgaaaccaccttcgaaactgcttggggtgtcgatttgcaacggttttaggagttgggggacgagttatatctggttttatggttaaaggatgtgattcaaccagtggcatgagttgagggaggcaaaataaactaattccttcttgaaatgtaatgttctctataataggatggcccaatgaataggtagtttctctatagggataagtccattttacccactcaacttattgcgtttgcatgaacaaaaaaacgtccttttaactccaaaatcggatataacaaaacccttaacttttaaaacaattatatttaaaccaccccccttcttgcagcgcacacacaccctcggtctcaaccaaagtaatttttgcctacgtggcattgacatggtggcccaatcaacctttaagtttaaaatatagcagaacccaccttgtagtgaccatctttctccacctcctccattttctctcgatctctcctcacagtcccgtagtcccgttgcacccaccacctactgttggtgggcttttcgcctcttcccgaatagccaccactgtcaacggggctcctctttgaggaccagccatctcatcatagaaagagggaggggtaatgatctagcggcagggattgtgcggcggcgttgatctggcgagcagatggtggcgttgatccgtgatggagggcttgcatcagcctgatacggtaaagggcaacactactctaagggatatcatgatgaaggaaggagttaatctggtggagagcacgtccacaaccatgtagcctgctggtagagtcggcatccctcctagttgtagggtgctatctttggtggtggactaggccataatgtcgaggcctcagtagtagagaaggatgtacggttgccgctgacgtgtggctcccatctttgtttatttgttttgatgttgaatggattgtcatgtcaacaccacagttaaaaaccacgttggtttagaccattagggttaaatcgaaaggttctaagaattgagggtgtgttatacctggtattagagttttttttttagagttttgggctgtttttcaatatattaacgtaatactaggtaagggatgttaaatgaactcccagagtcaacgttatggaaacatcaggctcccacagagttaaatctggtaagtcccacagtgcacaggggagtattattaatgcagcaaccgggaaaacattgggctaggtacgtgccgatccacagagaggaacatttaaaagaatcgagatcaatggtcatgtactgctcagcgatccacagacagaccacctgcagacctgccttggcttggctgcttccctttccagcgtgctgaagctgagcagagctaccgacgagtccaagattcagcacacagatcacacgaccgtgcctacacttcaacacttgtacctacacttcaacacctgtactagcagcagccagcaaagtgcccgagcgatcaacctgccacttctttctggtgctactagtaacaaggagtaataaagtggagtacacttcttccatccaaaaaaaaattaatctaaaattgaatttaacataatccattataataaatctggacgaaacttctagattgaatcttttagggcaattacaaatttaccactattttaaatcgttattgtaaaattatcaccagaaaattacaaaaatgccactagaattatcattcgagttgcatccttgcaatattagaaaaaccgatgacaaatttgtaaataccccttgatcttttgtgggacggataaagtaattcagacagtgggtaggtgccccttggtttgctggtgttagcctttttcatgtgaagaatcatcaaacgtttggatcattcatttcaacagccggctgcccgaccggctgccgatgcgactacgcaactgaaaaatctgtactcctacctggctgcagggcacagcaggtggcaatctcattcttcgggttggtcacgagacctgcagctatctacggcttggaccaaaagagttattggcattcgggtgcacggcgcgatcgcgggtggttcgctgccgctcacggcgcccggccggccgcgtcccaatcgggacgacgtggacgccgccggcgccatgaacggcagcgagcaaaggcagtagtgggctgtggccaccgcccaccggtggtccgagtcggttgggctgctgcacctgtattcttagggccctttgaatcataggaatgagaaaacgtaggaataggaaaaacgtaagattttggtaggaatgcaagtgtaaaacagaggattacaaaacaaaggaaaaaatacaggaatgaccattagattggaccgaagaaaaaacacaggaattagaggagagataaagactcaaaggaaagtttccatgaggttctaccttatattagaatttctccaaaacttgcatagcattagacattccataggaattttatgggattccataagatccattcctttgattcaaaggactatataggaaaatttcctttagaaataaaattctctaaaattcatatgaatttcctttgaatcaaaggaggccttacttcccggacttgtgtggctgccacagatcgaactgttgttttgctttgtgtaattgtgttggtcccgtacgacggtacgtacaagagatgaaagtgatcagaacccgtctttataagctccattgttgttggattctaggcgtggtgtgtgtgcttgtttgggggagaaaaaagggggtgtgatttatattttcggatttgagaacaaaaagggatgtgatcaatgtcgtattctttgaggttgtagtgttgttctcacactatggtccctaattaagcactgagaatatgcggtttgtggtcgacatgtcatgtatacgtcgatttggattagccggccggtttcagagaaacaatagagcaggcagcagttgcaatggccaagacaagtatactggggcagctcatgtaaccgcctgatcgaggcacgcacggcccggttatgcccctcgtgaggatgtgtgagcctcgttgaaaccagaactactcggaccgagtaaaaaaacgtgaactactcgcattttttgggtcaatatcgaaccgaattttattatgacaatatttgttgggattttattggtttttatcggtttctcaatggtttatgtgaaatcagaagatatcgctcgtgagagtatagagagcatataatagacttatacatatcaattattgatattattttgaagctttgtccattatttaaaggactgaatatatgagtaaattgccaaccatatgaacaaccaatgttatcaattattcacatagatccaactaaaagtcgagcacttctacttttgttatttttttactcccccaaacgttgtctcatgaactattttatgcttccctagtacctcacaattcatgttcgtgccttatttttacagatacttgcgagttgcgacatatttagtagagattcagctccagctctcatgcagtttgagcacaactaaacaattttacctccatccaagataagagtagagctggagaaagtgctatcacaaaataaactagagagacagagctgaatttaaattactccacaattctactctagacctagtccttagagctaaatttacgagtccaaatttagcccttagatatctcagactgctccaaatttacccagtccaagaaatcattagatatctcggactgctcctgccacgtccaaattattcaagagaggtttcacgttgtttgtgtggtacatagaggtactagagatactacaacatggaccattgatcaagaagaggagagcaagatacaaaattaaaattatttgattccaatgaaattgttaccttagcatataatgtctttttttctttagtgtgctatacctctatgtatctaacctgtggtcaattatctccagtaaggtcttaaaacttctttatct

SEQ ID NO: 811 - DNA, 12558 bp, Oryza sativa
  unsure (1)..(12558): unsure at all n locations
tgtgctatacctctatgtatctaacctgtggtcaattatctccagtaaggtcttaaaacttctttatctccttcccctcgtctgtatgttgccttgatctaaagtttaagggtgtgtttagtttttagccatactttaccatcacttgacaataaatattgccagcgtagaggatgagatctcttatgcttattttacatagtgagttatttattatctacgggattcacgaatcctgtagacacaagggcctgcattggtcatgcttgatttttcccccttatctacacagtttagtagtactacttgtttatggaactagataaatatccagccgcgttgttgtagaaaattaagttgcataatatgtataaataagatgtaatttgattattaaaactaaaataatttgatacaattttgagactaaaaataattgagattagatgtttttaagagagaacaaagaagagacaatttggaccatacatctatcatccaaaagttagaaataattagggtgatgtgccttaatgagagaagagagaaataacattataaatatttggtaaggatgaactgtataagtatatagaattcaagattcactcaatcaattcttgttaatggaatctgcgaagcagatccataatatccataagaatctcctagatctgatcattgttcccttggtgaatcccttatcattctggagtctatgctcttccggcaacatggattgcagaggtgctcgtgttcttgaagacctgaggagaccaacataacagatgaatgctggtgctaacgaaaaaaaaagattgagaaatgggacttcaggttccctggggacaaaatgtaaatttgaaaagtaacgcataaagaaaacataccggagcctccttacagatatactgtgtaaaacgcagacactcacccctatgaacacacttacagatataatgtgtaaaacgcacactcacccctatgaacacacttacagatatactgtgtaaaacgcagacactcacaacgcatgcgcactcacccctatgaacacacgcacgcaaaccctatctctatgagcatcttcgaagaatgggacagcaaatcgtgaagagattgacgaagaaccctacctctagagcattttcgaagactgggccggcaaatccaacaccattaaatcctagaaaattcgctcacatagagagttgaacccaggacctaaggtgctactgagactcttataaccactagattacaggccctttcactacatatatcaatacttaattgcatttttctttatatatttaaattatgaagctttcgatttttaccttttatgatctacgagctgactattcaatcttgctatctccactattgatgccacttgtcactttgccacctaccaccacaaatgatcttcctcttaaaataactccaagaggatcatagtgagcctcaatattgttttaagaaaaatcggataaaaacatatactactcgattctccaatcaagttttttttaagaaaaaatcaaactgaattttatttttttatagaatttattcggcttttatagggttttatcggtttattaactgattccgcatgatctgatgataccgctcgaaaatgtgaagccccgcacaccagtaccacacacggccgtggtccgccgcagggggcagctctcatctcagcctctcaccagtaccaccaccagtcagtccaccaccgtcccaaaccacacgcgcacacgcccacgccaagagagcgatacagccatagcagcttactccctccgttccaaaataagtgcagctataatttttcgtgcccaattttgaccattcgtcttatttaaaaatttgttaaaaaaattaaaaacataagtcacgagtaaagtactagtcatattttatcatcttataacaacaaaaatgttaatttaaaaaaatttcaaataagacggatgatcaaagttagacgcgaaaacttatggctacaattattttgggataaatattactgctccgtgccaagagagagcgagaaaaaaaaagtaaataaaacgaacaggacgcgaagacgaaaacccccctcgcctctcgtctcttttcgtgctcctccgaatccggtgggtcccacctccctcaccacgcgtccccggccgatcacttcgcctcctcctcctccgctctattaaaccctccttcggccaccgcgcctcctcccctctccaccactcgcgcccccatcaccacccactccactccctcctcccccgagcccgagtgcctcaccgccactagctagcagcagcggcggcggcggcggagaagaggaggagatatggcggcggtggcggggacgggggtgttcgcggagatcctggagggggaggtgtacaggtactacgccgacggggagtggcgcgtctcggcctccggcaagtccgtcgccatcgtcaaccccaccacccgcctcacccagtacagggtgcaaggtgggtttcgcttgcatgcttgctgctctgagctgctactactctgctgctactgctggtgggatgattgccttcccggcttatagttgatcggctgggtggatattggatatgattgattgatcgacgatttgacggcgaccatccctttcgatatttacgaagttaattacggctaagttgatcggcgccactaattaactggagtaactgcgtgcgagctcgccttctttaattctgatagctccccttacctaattggttttccctttggattctcaattgctccctgatttggtgaccggtgaatttcccatcttgtcggcgcaagaacatgcctcggattcatcgccggcttcattcttgcggctgtaattcgagtgttgctacgaattgcgaaacgagttgactttgaacctgatatcacaattagctgagaaaatttgggggtccttttgtgtgtccagcatgcacccaggaggaggtgaacaaggtgatggagacggcgaaggtggcgcagaaggcgtgggcgcgcacgccgctgtggaagcgcgcggagctcctgcacaaggcggccgccatcctcaaggagcacaagaccccgattgcagagtgcctcgtcaaggagatcgccaagcctgccaaggacgcgatctctgaagtcagtggcaatttcagtttgtacttggtgaattttagtgccattcttcatctgaagcgaagctaactgacaaagatggcttgttgtgttttttgagttttgacaggtggtgaggtcaggggatttggtgtcgtacacagctgaggagggtgttcggatactgggggaaggcaagctgctggtgtctgatagcttcccgggcaatgaacggaacaagtactgtttgagctccaaggtatgtgttgcattgctagattcagtcgactttcggttaagtttgtttgccatgttgtttctgtctctcattttgactagaaatagcgatgaaaaaaaagaagcttgtagtatttcagtgtttgtgtctggtggctgttgttaattgatcaacgggcctttgttgactggcagattgacaaaaagttgatgccttggaggcacctgtctaaatcaagttttaatatgtgttacctgtatgataaaatgaggttgatataaattatgcagctaattgacacgtataatggaatatggtattatggaatattccttggatgctagtggtactagtagcccatgtcattctggtttctttatcgtcatgaggtgacctctgaaattagcacttctccctgagtctaggatcactgatcgggatgggcatgcagtgggactgcatcttaagggtcaagattatcagttacagtaacattactacagtaaactatggtacagtagagtctgcagtacctggataaatccactcgaagctgacacatactcacactaccgactgcagcaaaaccaaatccctgagtctgtgtctttcccttgctgatctttctcctctatctgtctagtttttggatattgaacataaaagaagtgcttctgatacttgtgctcatttggccaaagttaaacaaaattgggcaggtgtcgacgtgactagccataactttggcaaaattcgctgtaatccagaccgaccacagctcaaacaagcttggaatgaaaccattccgtatttgatactgtcttcaactggaaatctaggattgccggttacttgtgaggcctgtttccactggttttcaaaatctgaactctcaactgaatatattcttgtattttccaatgatttgcagaagcataaaaattaaaatataggttgtgattctgtgaacctttgattctttgtgattggtatacagtagttatccccactttagtttgttcattgctattttagttgagttatagtaatagccctgtggtgaacttgaactaatcattgagtttggtgtgtaagtgtaactggtactttctaaatgaacttccgtggcccattttatcgttgatgtcgtgaaattagatacttctcatagaaacaaagtattagatgacaggaaaacattcagctatggttgttgctcctgggtccttttcagagattgttagcattgtagtgtgattagatctttggccatctgactctgtgcattaaattaaacatagtttcaaagtcattattccttagtactaattatcaatacctggatggttttgagatgtgaatatgctgctatatttcttcaataggattttcagtgatatggtttgttcaagaaactaatttccaacgattgtgattttctgatcatctttttttttaatctttagaagataacggattgttgaaactgagtatcatgtactctattgcatgctctagaatgtatgttcaagaaaaattttcatgagtcctaagatgaatattatggttgatacatttgactatcaatgctccagtgaatttacttaatatcctgaaattgatgatccatcattttgtttccttcggtatctaattcagtgtcctattcatgcaggtacctcttggagtagttttggcaatcccaccatttaactatcctgtcaacctagcagtctccaagattggcccagcactaattgctggcaatgctcttgttctgaagcctccaactcaggtatatattcttttatgtaaaaagacttgcctatgtttgaagtaaaacatacttaaatggtgtactactgttcaaccagggagcggtggctgcactacatatggtgcactgcttccaccttgctggtttccccaaaggcttgatcaattgtgtcaccgggaaaggttctgaaattggtgattttcttacgatgcatcctggagtcaactgcataaggtaataatcatccgctcctatttctggcatatgcagattcaataagacacagactaaacagtaaacacttatgccatgtagttttacgggaggtgatactggtatagccatttcaaagaaggctggaatggtcccgcttcagatggaacttggaggaaaagatgcttgtgttgtgttagaggatgcagatctggatttagtggcagcaaatatagtaaaaggaggcttctcttacaggtactaaacaatgaatttgattgatcgatctatgggttagaacaacgtttatcgtgttgtttcatttgatctattagatatttggacatgtcaaaatatggataccacaattccttaaaaaagtgaaatcagccacgggaaatcataaaaactttcagataagttttagctaacagaacatgacgtgtggcatccaagtagtgtcatcatgcatatcagataatgttgccatatgcttttccttgcttccatccttgtaccatactatattatttaaatagttctatacacccatatttcatctttatgtgccattttcttttgcttttctattattttccatgcttggccctagtaactatgcgaggacagaagtcttaactgaatttgcatcaaatcatactctggatttctactgacatttcttatgatcaacgtagtggccagaggtgcactgctgtgaaagtggtgctgatcatggaatccgttgctgatatcgtggtagagaaggtgaaggccaagttggcaaaactgacagttgggccacctgaggctgactctgatatcaccccagttgtaacagaatcctcagcaaattttattgagggtttggtcatggatgccaaggagaaaggagcaaccttttgtcaggagtacaggagagaaggcaaccttatctggccgttgctactggatcacgtccggcctgacatgaggattgcttgggaggagccatttggccctgtcttgcctgtgattaggatcaactcggtcgaggaaggcatccaccattgcaatgccagcaattttgggctgcaggtgcacactcacatacatgatagaaatggacattgatgtttgttacaacatgaatatcattgtgcatctgattcatctatgcattcttccatttcagggatgtgtattcactaaagatatcaacaaagcgatcatgatcagcgatgcgatggagaccggaaccgttcagatcaactctgcaccggctcgaggacctgaccatttccccttccaggtattgttaccatgccattgactcggcttgccatcattttgttcaatttaccttttgctttcttcagttgtttgtaatttctatggggtttggactacagggcttgaaggacagtgggattggatcccaggggataactaacagcataaacatgatgaccaaggtgaagagcactgtcataaacctaccatctccatcctacaccatgggctgaggtgttccatatagatgatcagatttctataaccacatgagtacaatgtagagaattcaaatgttttgtaaccacgtgagctttgtacgctatttgcaccacagttctccctgtatgttgttggctcttttacaattaagaataatgcatgttgaagtatgagtcttcctgtttgcttctccttgatgatgaaacgctgctgcatcaactgattatttttcagagaataaacgataaacaaagcacggtgaagtatcgtgtaacccaccataagtggtagagccgtagaggtaggactgtgcatgctgaattgtaattaccatggttagttcagcagaatttgcaaaaagaggacaacagaattagaccatcgtcatgaattaatcaaggtacaaaccaatggttgctggtacatcagtagcaaatggctgtagcactagcgtgcccatatttatattccaagcctccaaggtatacaatacatatttgatgtaccgaacaactgaaaaaggcgcttggtttggaagcgcactatttttaaatttataggataacttctgacagcctttcttctaaatgaacttttggcaaccgctctgaagccgtgtaacacaatccaacaaagcaatttgcagtcaaaatttcgggcatgtgccgttctagttagaatttaggatgtgactcactaagtaattgtgattgtttctctatgcaaacaccagccaacagtattgatttcatcatgcataatctggcatgaccttcttgaggaatttaattggttgggattcctcaggcgcaacctcatcaaagggaacatagtatctatccttgtcgtaaacatggcatttagtcagtattgtcttcatcaagcgccagttccagctggcttcattgatgtactgcaagtagaaggtatcaagggaagagaaatgaaataactatacaaaaaaaaaaaccagtgaaatgcaccccaaaaaaatgggagaaatattgaagtaccttgccccagttctgttttatggaatcataggcagcacgaaggttataacttggaattcttggagaaatatggtgtggaacatgtacatttatgtcatgacaaagtatctctatcctgtaaaaatccattagtcagatacaatccaactctacagaagcatgtttccaagataattttgacaaaaccaagacagtgattcagcttgctccagttgtacaaatgttgacacttatacccgtatgaacacttcatgacaaaatattcacatcatatcccatatttaccacatgcactttactgaaatatatttatcctatgctagtgctaaatgggagtagaactagactcaattgagctattaaattaaaaaaaacatggtttatatgcacctgtggcacattctacaagatatgaaacttatgtgcaatccaggaaaacagtacaaccacatgatggaaaagtttcttaatcctcaaagatacaaataaacaataaatgaattgtcgctgtcattttattggcaaaatcaatgatttgtcatgtgatattaactagcccaattttttactgggattatagtccagtgaaagttttatttgctataattctacatagtatataattttgtttttcatgcagtttcaatacaaaagtgttctaatatccaatcaatctataccattataattaggaccccacccaaatcagggtgtagatctctcttttctgagattttatgtagtactttttagtccatgagagctttcctgtgctaatatccaatcaatctgcactattaaaacaactgaaaagtaatagcatctatcttttgattaataacctattttattgatataaccgataggtcccatgtgtgacaaaaattaatatggaaactagcttgtttaaagatggttaacattacttagcaacttgatagaaaatattataatatgtaagaaaagaaagatgtaaaagaaaacaaaatgcgtaccaccgaggatagtcacagtgaactgtgccgtttaattgtgcctgtgcagcattccactcttctgatgtcttgaatggtatatgaggagcagtgtgatgtaccatcgtaaaggtgctcatctgaagagaacagcttacaggataaataaaaatatttgcattatacaagttaatcaacaatgcaaagcgaacaactttgaacaaaattattatatgtttaggtaagtgctcccttgctctgtcaaattggcagaacaagtatatcaaattgtggctagtttaaacagtgatttaaagcgagtttattccatgttagtactgacgaatggatgcttctgacccaaaatcatgggttcatgagaaaaaatggtaaaccagcatgtactagtaaattggtggagaatgaaatcatatctgttgctagtttgtgaacagtggaaaggaacataataagatctgaaaatatgtagctcgactgcttacgtactgctacaaaaaaaaaatacaatgatacactattctccgaaatgttaccttgtaatgtaaccaaatactgtaataaaaactaaaactgagtcagatccattgccaggagttgataatgcacacagagtagtgatctgaagcaatccaaatatcttcgggaatacaaaagcttaaaatatataaactcttgaactaagaaaaaaaatggtaacagggcaacacagaagtggcatataagtgtcacaaaaggtcagtagcctgtcatctggttggctccatgggtcagagctatattatattcaaggactaattatccaattaacatgagtttctactttctacttgcaatatatagcaccaatatgctctaatagctaaacatttccatgaatttggaccatataaagcttagcagtaaatgatgttgacagaataagaaatattacccaaaagtgataaaccatccatggcatgaaccagaacttgaaccatccagctattcctgatttgagaataatcagtggccatccaattgccatgaacgctagcacagatgctaagcttattttcacccttgggagctcatttggtctgaatttttttagatcaaagtgccaaattaacctgacaagcaatcgtagtgaacagcaatgatattgcttggagaagttgaaggaaaataattcctaaagaagatgtccatgttatatgaaaaggtgttcgaaaaagaaataccagtgagcaatagacatccatggcctgataggaccataagcaaatatcattgctttcctcagtaaggaatttgttctgaactcctttgaaaaaacgggttgccatgcagtatcttctatcaacctggaggttatgcaggaggtaaagatttgaatgaccaaagttcaacctggttggaactgtttttaagtcttttcatattatcaaatggcttttaatacatatgaacacagacttacagataactcaaaaaaatgttgatcatgttgttatgtttgttttatttgtacaattgtttcaacacttgacatgtgaactataattaaaaaagcggcaagtaaaaaactgttttggtatgccatatcccatatgtatttaagcatgatgaagtgcatgagtgttcttacaatgtaatgcatgaccgcactggaaagagcgttgtctgagatttggagaatattggagatgataatatagggtggtatgtacatacatgtttgtcttggcatgatgtctgtcatgcttaaatctccaaggttcataggggtatatcaatggcaagaaagctagagttccaacaatatcttccaccagcttattcctcgaaaatgatttgtgggcacaatcatgacctatgacaaagaactttacaaaggcatcaattaaatagtggacaatagacaaaacagcaagcaagcatgtagcacatgaaaggaacacaaacttatataagcttacaaagggaggggagggttcttacccccgtaactgctgtaccagtccatgcccaggctaagggaagaagatnnnnnnnnnnnnnnnnnnnnaagaaaataccaagagcataagaagtaactgatattaaaacagaagtccaagattttagatcatcgatttcaaatacctagcagacaagaaattttacattagaggaatttgtgtataggaagccacagcagcatagctggtgttggtagctcatatacctctttaggcagactatccattacatctttaagagtaacattatctggcaactgttctccaatttgtttgaatccataatcttcacacatttgcttccgtttttcttcatcatctaacaaaggtggagtaacaggcagaactgctgcttgcaaccttccgctttgtttcaatggtaaaaattgatgacaactctgtcctttatatacagaatctctcttcaaaaaaaatgtacctggtgaaacatgataatgtaacatctaaagtgctgaacggtattgccaaataagcacgacagtaatttaatcaatagttttcattgcgatatacaccaatgaacacactaataagtaatcgtttccattattcttctaaaatacaacttaatataacatctttaacattccatgcttccatgatatatatcatccagtcccggcagagaacacctaactggaccgcacattgtggcatgccgtttcaggagctaccaggtcatggaatttctagctgtcaccccaagattaccatttacaaccaagagcccatatgtaagactgaattaactagtcggctactctgctccagtccgcacctctcgaaatatttatgcttagaacgaacaacacatcccaaatcccaaaagcaccagggaacaccagcacaaaactgctaccgaaacagggccatacctgccggggcaccaccggctgctctccgcgggaacgcgttcttgcccggggcctgcgcatcaacagccacagataaaacgacctctcctcacacaggcattcgaacgaacaggtggtgggcattgcaagtaggaggagcgtaccgggctgccggggcgggagcagcagccgcccacccgccgcgtggaggggagctgcaggggagtggagacgccgctcgccgtcgccatcgccctctctggtagcagcggggcccggcgggctaggccgggagggcgcgcggtggcgagggagcgtggagacgacgacgacgccgggcggcggcgggcggcggtttggatggatgcgttggtgccttggtggtgtgggtggctgtaaatcccgcttgcgcgcgccgcagctcgcagcggtggggtcggccgggacaggtcgggtgtgacccaggacggctgcttgtggtggctggtgcggccgcgacggcgcgaccgcggccctgtataaagccagcctataccgaccgaggcggcgaatgaatctctctgaacctatataaagtagaggcttctgttttcgtttataagtttactgaagataaaaaaagattaagtacaagcatacagaacaaaaaaatctttagcgtgtgattaattatgttttaattattttattaaacttaaaaatcgatttatttgatattttaaaataacttttgcctaaaaggttttcgcacgaaatgtattgtttaaccgtttaaatagcgtgataatgcaaactaagat

SEQ ID NO: 812 - DNA, 9909 bp, Oryza sativa
ccatgaagactctaggtccatttgaagtcagtactgtctccggaggccgagctggacttggacttggaattatcattggaacgtgtgaagttatgagcgtatccgacgaagtgatgtcctcatcatcctccccttcttgaattggagtcgtcctcgactcaatcccatctttttgattgtgtgcactctctcgtctagtggccatccttggaggtatctcatcttgaaaaacattctcatattcctgagtaacagtgggtggcaaagaatataaagtactaggagcagtagcgaatgtgagtataggatctttgcaaaatagagcatagcaacaagaatctggctcatctagtgcacaaatattatatttagaagccaacgaagcacccttcaacttaatttcattctttgtggtacttggttctattttactagttgaagcaagatgtttagcaataatctgattatcacttttcactttcttttcacattcaagtcttgcaagatcatctttcaaagcagcggctggagtcatagaatgcaaaacaactcttttaccatcgaacataaatttatatgtattagtcctaccatcaaaaacaacttctctatcatattgccatagtcgccccaaaataacagaacaagcttgcatatgcacaacatcacattcaatttgatcatggtaggagcctatagaaaaaggtattttaaccaagcgggttaccttcatcttaccacatgtattaaaccactgaatataatacggatgtggatgtggataggtagtcaagccaagattcttgaccatctctttacttgctaaattgttgcaactcccgctatcaataatcattttgatggtatggcctttcacaagaactttgctttggaacaaattgtggcgttggttttgctcttcacacttctctttagcactaagtgctagcttgacaattaggctaggatactgatctagcgactctggatgcaaatggacttcctcgatgtcatcgttatcttgtcctcctgcatggtcagtggcagctaaagcatattcatcatcacaatcactagcagaagtatactcaccatcatcattcacaaatagagctcgctgatttggacagttgcgggcaatgtgtccaatgccatggcacctatgacatgtaatatcacgggtacgtccagtggaagctaccgaagttgcactcttggttggagtctgaactgaagcgtttttgcttggttcttgagcatgggatggcgtggaggtaggtggcgtggaggtaggtggacgaacggcagtagtagattgacgtggtgttgactgtcgtgtgaaagtagcacctgcaaaagaactcctatgcttgttgcgtctctgcacttctctttcagctttgcaagcaaaatggaataatctattcatggtattgtattctttatattcaagaatatcccgaatctctctattaagacctccatagaacctagaaattctagcatcctcagtttcttgcaaatcacatcgtgacaaagcaatcatcatctcttgatagtatgtttctacagaattggaaccttgtcttaaaagatgcagtttatttaacatgtcacgagcatagtaagaaggaacaaatctagacctcattgtacgttttatatcatcccatgttctaggtctaagtcctctaccacatatatcattccaccatagagatgtaaaggaggtaaattcactactggcagctttaactttcttattatcaggaaaatcatagcaagagaatttttgctcaacagctagctcccagtctagataaacagaaggctcaaacttaccatcaaaagaaggcttagtaaattttaccttagataaaggatcatctttatccctaactcgacgtcgtcttctatttccaacactctcgtcttcctcctcatcgtcagcaacagattgctcttcgtcttcatcgtcatatctttggtgtcgatgagcagtggcacctgcaccttcttcacctgcagcctcaagtaaaccaatgtgtcgcacaatattttcatgtccaatattcatattctgaatattttcagttaattgtttatgtgattgattcatttgctcaatttgatccactactttcaccaggctttcacttaaggtttttaaatgtttatctgtgctttcattgtatgatttactattacgcatcaactcttcataccaattttccatgcccttcagtttatgcgctagattctccagtgttggttcgtcggaacttgtacctgacatcgttagcaagcaaaagaaactcacaagaaagtgtcagttcctaacaatatatagatatgtggagcttttgaaggcactcaacactaaagcatataccaaattcttataatattctcaaagaatgcaaaacaggtcaatcaccatggctgtttcgtggcacaatgacacgcttgatgagtggagcgattgcaaaaccggacctgtaaaggttagtagtatgtggatcttggtaggctttactatatcacaaggaatagcaaaaatcaaacagaaatacgaaaattgaataatagtccaaagtactagtcaaaattactggtctagcctagactcaatcctagcttaaccaagcaaatgatcatactcggacaaaacacaactagctataacaagcaactctctctccaagattccaacaaaaaaaatatcacactttctttttctgattttttttcttctcttttatttttttaattttttcccttttctgatttttttggtgcggctcttttttttcttctttttttttgcacctctgatacctttttctttttttccttttttttttctttaacaagtggcaagtgcgtgcgcgcatgcacaaatacaagcagctgctagctattactgtaagaggagttcacgtgcatgtatggaacttgcatgcatggctaaacaaaaggaaacacaccaaggtaattagggagattaactaccgaaacaaagaaactgaaatgcaagaaaaccggacttgcatttgcatgcacgagataacacgggacccactcagtttctgtgttgcgcacaacaggaggaaaacaatacagatattccccaactaaatggaaaccgactcaaaatttagaggaaacagatctctataattccttgcgcaagcaacaaaccaaatcatgaatggatcgatctgctatttttttttccttcaacctagcacaaccgagatgcaaactcaaaccaggatgaaactaggactaaagccagcactccgactcgacagtggacagaaactcaataaagcaaaactgaatgaaattgcgtggctcaaaactaatgtttggtgatggaaaaaaaatggtgtggctatatggtagacaatgggtaaatgaaataaaattgcaaactaaaatcctcaccaggcaaccgatgctctgataccaactgatgacgctctctctcgtggcccaatcttctggtgaggggataactctcgctttaatcgagtgtgacgtttgcgacgtttgcgacgtggctaccaaccagaacaagtccaggacgtcgtgcaatcgctacaccacaaacgatgtcgtaccaaccgtgacgcgcggttgatgatccctgcaatgcaaacgagagaacactgcaagaacaagataagatgcaatctaaatattgcgaataggtgatgaagcacaaagaaatagttgcgattgaagtggtagatctaatcgacacggaaaatcaacacaccaactattgggggctctgaatctacagtcgtcgactaatcgagcgaggactagagacaaggtgaatggcacttggcaaaattcaactaaacaaaacccaattatttttgaggatgtacaaagctatttgtagaggaaaataaagctagggttaagtgctaattcgtggaggtggagggagacacttccgagatggggctagtctattacaaggtccaaggcccaagttcggttttagcaacagtactgtcttattttggcgattcccgttgactcgagatgaatttggacatgagagtggatgtgtttgaaaggtagcgagataagctttccacgaagtccaagatcacccaaatcagagttggcatgaagacgctaggtccatttgaagtcagtattgtctccggaggccgaactggacttggacttggaattatcattggaacgtgtgtgaagttatgagcgtatccgacgaaatgatgtcctcatcaaggaggatgatggcgtggcccgtggcggcagaggggcgacgaaggatggagaacgactattagagtggagctcaacgacacaagtcctgcgatgagcggccacttgcgacatggaaaacaacggtcgagcgtgcccgtattaacccggcgcgactgccactctgattgggatcgatggatgtggttgcgttccggtgtgatttggtagcaagtgagggcggagcaagctctgcctctatgtggcagggctagggtcttccggcgacgaggcggctcagggtgagcagcccgcaggcggccgatggggagaagaggttgttgtcgagcttgcttgggtgggcatccacgggcggcattatggttgggggcacggctaggcgaggggaagaggagcccgagcgtccgcgagcaacattatggttgggggcgcggctaggcgaggggaagagggcatcatggttgggagagagccgactttaaggggctgggatgacgatggaccggaggacccgcgtgggtgctaggagtggcagagagccgactttcccacggtccgagagcagtttgtggcatggtttggtctagtagtcacaagacagcgaggcatgcggcagcagtcgtcctccctcaacgttctgcttctctccatcggctgcctcctccgtcgccgccgtgggccacgccaccatccttcgccgtgtggtcatgtggatgagggggatgagagcactggagaaggggatgggagagagaagtggaggcctggaggagatgagggggaggaagtaggcccactgacatgtgggtcccactatttttaattttattatttgactaaaaatgctcgtgtgttgcaacgggaaaaacatgagaaatttaagaaaaggttaagaaatatttatattatgtaattaattaaaatataaaatcacaactatacatgtatactatgttgaagaaaaaaaaaagttcataagaatcaaggtaaatgtggaaaataaaattttccaaataaactatagctggatttaatttttattaaactctccatgattactccctccaggttgataatacttatcgttttagacaagggcacggtctccaaaaaacaactttgactattattttctattataatatgtataaaagtgttaacaaatatatgattttactaaaatactttttaagactaatctatacatgtagtcaccatatttgaaagacatatattttaaaaatgattcataatcaaatattctaaagtttgacctcaacattgtctaaaatgacaagtattatcagccccgagggagtaattacactatgtgaaatttctttcagtattttcagagcaccattgctatttttaataatacaaacgtcattttagcatttatttaaatgtaaaccctcctttctccctaggccattttgagcccattctttttttagcccgtagccgagccggcccagtaacctgacttctcctcccttccacctcggcctacaagcgcgcatccagcccatcaagcaaccacaaagtctaatcagcgtcccttctcctcctctcattgtcacatgggttccagtactacaaggtcgttccctacctccgtccgattccgcagcttcccaacaccgccggaaaccgtcccctccgtgaaatccgtccgcatctacggatataatccaaaattgattgaggggttttgattcttattttcttctctttctgtttttccaagatatagagcaaaatcgcatcgtatcgaccttgaaattaagccatatagcaaaccctagagttgtccgtttcgcgtacagggagggaatcggactgtgcctagagacgatgtacgaagaaagttggtaaaaacatcttaaacttttataataggtaaagataaagattgatatgtgcgcccattttattttatttattaaattattaaattttgcttcatgtgctacgtcaaatgccacgtctgatgaagatcgagtcaaattagccacatagatgtcatgtcagctaaaaaggccatctaaaccatcatgggccctatattgcaccggttttgacagttgaggggcgagttgtatatggttttgtggttgaaggacaaaatcgaattcattcacgagttaagggacctcagatgaacttatcccgcctgacaatttacatgaggcagtccaatgattcaaaccaggccagccagcccaactagacggctctaaatcagacggcccgttacatagagcccatttgccaaggtccacccaaggcggtcgcacggcccgatcgaaattcacccaagtccagacacagccgacccgagtgcgcaacgggccaagagcgtctggcttgattggtctcacggcctcacgggcgatccacggctccacgctgaaccgccgatgacggtgcacgcaacgtggtaggctgcggtcgctgcgattctgggaaatcgacgagacaaggacggcgagaaggagctaaaagacccgccgcacgactgcacaccgagtgtccgagtgcgacgtcgtcgatcggcgccgcgcgcggtggcgcaaaaatacacgatcgacgcgtggccagcctcgcctcaccttccggagaccccgacgcgacggcgacccgacccggccccgcgcgtcgtcgcgttttggaggctaactaacccctccatccacaaccagcccgcgcgccgatcgttcgcgcgcgtgcgcgcggtggcgacagcgatcgccgtgacacttgtcgccggcgcgatggcagcggccggggtcgcgagaaaactgaaccgctggccgcacgcgcgccgttgccagccgcgacaaagcagctgatagatcagatagcgcgtctcatccagagctcgggttggggagggcggcattggccgttggccgttgggccgttgctcgatcgattagggatgcggtgcgccgtgtaggggcgtgtaccaccacacgtacggccgcatggcaaccaaattctcgtcgatgatatctctcgatctctcgttctctcattttcacggctccattatttctgtagctggagggtagcgatggccgggcgggcggcgaaagggtgtgtttagttcacgctaaaattaaaagtttggttgaaattagaacgatgtgaaggaaaagttggaagtttatatatgtagaaaagttttgatgtgatggaaaagttaaaagtttgaaaaaaagtttggaactaaacacggtaaaagtcattgcattttcaaggcatggaacacgggtaaaacatggttttgtaatatgtacagttcgcggcagccggcaactgcgatctgcaacttctagtactatacattgactgccgctgtagttttactgatgtgagagcgtaccagctcaggatgctcatgcctaggtaggcttgtagccttgcagctcggttcgatatgtgagagcgattgacttgcgaactcttgggacagatgagccgaatcgcattatcctaatcgatcattatcacagagaggaaatgccggttgaattctccggcgacttgttactcgtagctataaaagccaaagctgaaattggtaacgattatttgacgcggctcataagagcaaactcgatcagtgctgcatttcgaattaagttgtgagtttctaaaagaacctcatggtaggccaaaacgatgtcagctcaaggatggaaatgcttggtcgaagagttttacttggacataacacgatgttgttaaagttttattatcattatctaattatatatgagaacatctatagtatttagaagtatattattacttattagtaattatcgtgcgcgaaggtagcgtaactcaactggctaggtttcttgtagtggaaccaaaccacccaggttttaagtcctaaacttggcatgagtgctcgtatttatccatcgacagtgagatactcgtgatccatctacagcgagatactcgtggtgagttcgtcaatctcatgatataccggttcagtttttcggagatgttaatagatagcaagacactacggttaattattttttcggtggtaggtggtgtatccgtcgacaacgatatactcgtggtgacttcttcaatctcatgatataccggttcagtttttaggagacgttaataaatagcgagacactcatggtgacatcgtcaatctcatgatataccggttcagttttctggagacgttaatgggggtagggtgtgcgtgtgcatattcataggactagtgagtgtcagggcgttgcgagcgcatacatttgtattttgtttcttaaacaaacaattataatgcgttataatacgcagcaaaaccgattgtatctaagatagatgtttattggaagttgcaccttcaacaaatcgaaatgacacaatgaatccagggtctccgagcaaacaaacgatgcctccgctcctacttgcaaaccatcatctgtgcgctagcagccagcaggcacctaacagaagccttgccgccttgcgtgcatgtgaatgtctctagcttagttaaggaacaacaaacaaaacatcatgtacatatctctttatcagcgtgacctgctgccgccttgaggtgagctagctaggatgatgtaggaagagcggtttgatgaggacgaaatgagatgccaacatctccaccaaaaaggatgaaccgaaaacgttaggataaatgatcaatttttctctgccaaatttgccaagcaatcaatcaccttaaaaatgtacagagagaaaatcattattacaattcaaatcagggtattctaaaatcgatctcaatagttaatagtatgaacaacggtagctagaagataatttttcctcatataaccaaattaaaaaaaaatcttctcctttaaaattctgatacgcggtgaaaaatgaaacagattccgcacctagacgcaaaggccaaaacaatgggctaaccgcttggagagatacgagtatacgacgcgttgcgatcatcctgcccaaccgttgcataagcccggaccacggttttccccgtatgcccccacctcgtggcgctaagatccaaatcgggccgtccatccatctcgcgtcacacggtccaccaccaccccgcccttcaatcatagagcccgtcgcgcgtcgcgacaccgccgcccccgccgtccgatccgcatccgacggcccagagacggggagaaaccgtcctaccctcctagggcgccgcagcccagggcccctacgagtctagcccccctacgccaccgcgcacctccctcctccgatataacccgcgcggcgcagcgggagggcaacggcaaatcacgagccacacgcgcatcgcaagaccaacgctgagttatcgcatctcggcatccgcatccgcgcgacgacgacgacgaggaggacgacgccgacgccggaggccgtccggggcaaggggaatgcggagcgatgaggcgggcacgaggcactgacgccggcgtccagcgcaagctgcgcggcggccgcacctgccaccggaagcacgtcgaggacgggtagatccatctcttggtagtagattagtagtagttaggtagattcttgaggaggaggaggaggatgatgcgccgcggc

SEQ ID NO: 813 - DNA, 17870 bp, Oryza sativa
  unsure (1)..(17870): unsure at all n locations
cgacttctgccactcccgcggcgtctaccaccgcgacctcaagccggagaacctgctgttcgacgaggccgggaacctcaaggtggtcgactggggccttagcgcgctcgccgaccacgcccgcgccgacggccttctccacacgctctgcggcacgccggggtacgccgcgcccgaggtgctccgcgacaagggctacgacggcgccaaggccgacctctggtcctgcggcgtcatcctctacgtgctcctcgccgggtccctcccgttccccgacgacaacatcgtcaccctgtaccggaaggcccagcgcggcgactaccggtgcccggcgtggctgtccaccgacgcgcgccgcctcatccccaggctgctcgaccccaacccgaccacccgcatcagcgtcgcgcagctcgtcgagacgccgtggttcaagaagacgtccatctccaggcctgtgagcatagagcttcctccggcctttgccgatcctgctccggctaaggaggaggccgagaaggacgagccggagacgctgaacgcgttccacctgatatcactctcggaggggttcgacctctcgccgctgttcgagggggactcggccaaggggaggcgggacggtggcatgctgttcgcgacgcgggagccagcgagcggcgtgatctcccgcctcgagggggtggcggcgcgcggcggcggccggatgcgggtgaccaagagcggcgcccgcggcgtgcgcctggagggcgcggagcgcggcggggccaagggccgcctcgccgtggccgccgacatcttcagcgtggcgccctccgtcctcgtcgtcgacgtcaagaaggacggcggcgacacgctcgagtaccgctcattctgcagcgaggagctccggccggcgctccaggacatcgtctggggcgccgccgccgacccaacgccgaccgccgccgtctgatgccaccattgttagcgtccaaagtcattgtgtcacagtagccgatgctgttcttcctcctcctgtgcttgattcgatagcgacgtgcatgaactagtatcgctgtttgggtggtgggggcagttggcaagaacaaatctgtatctctgcctcaaaagcaacagcatttttttttcttttgcacaagttgcaattgtttttgtgatggtctttgcttacatctgaatattccgtgtcttctctgggacaatctctgctgcatgattgatggtctttgctgtttatatgtattcagacgccgtgcaatactgtatgattggaatggttcacagtttcagtgttcagtccaaagttgtttcgctttgacatagatttctttaccaaaaaaatcggcctggccattgattaaaaggatttccctacaactcttgaatgatagatataagaaggtaatttaaacagtaaatgtgttgtgaaagagaacgtagtctagtggttgcaacgagggtaaaaagacatcaaatttacagtaaatagttcgtagaatggatcggtaaaaaaaaaaggtagttcgtatactctagggctcatcttttcgtttatgtttatgcttgtaagttaaaatttaaatttttaaccataaatttagagctggttttgaggttttttctctcttcaattgcagttcgatttgctcgtcttatcgttcactacttaacttatggattttgatgtctgtcggcgatgacaaaatgtgaaagcgaaactgtaaagcttcaaagaagctaatttgcttccaatttcgatctccgaacactcgtgcgctgctctcaaacagcagcctagttagagcgcctaactatgattttattcccatggcaaacttctaaacgaaggacagaagtttcgcttcgcttccttgatagagagagaaataatacactaatgcgtcacctggcgagaagaaaatacgcatcaaaagcttctgcgacaatcatcagctcggtggatttttccgacattagtaaaaaaaagctatgtgcggttgaacaaccagcctgctttaaagtatctgcgaaaatctttattttcccttgcagtggtgtaattgcacgtaaaagtcaaattttcgcattaggtgtttacgtcgtccgcacacaaaaaaaatcaaaaccctagcgcctccatagtggaggaggtgtggatccggccatcacgggtcagtggcggtggatccgatcatcgcagggccgatggaggcagatacgcccaccgctcgttgctcccgctaccgagctctcgaggaagccgagctggctaccaccagcccgttagccgttcccgctcgatcgccgctgccgccggctagtaagtaggaagtgagaaataatgaggagaggagaggaggtgagagagagatagaaagaaaataaaaatgatacttgaaaaattttaaagtgttgaaagggaacgttcttctgtctacatctctctttattatgctaatgtttaacgaagtggttgttttgaacttgttcagagcaaagctcaagctcctcttgttactcgttccatcagtcggcaactcgggatgcttttgtgcattataaccgttcaacattttgcacgtgggacaatcagtcaatcaggccagctcccttcctgtgttcttccaagccgatgtctctaggacctgtccccgaacatcatctttctcttttacgtttttgacataaattttttattaataaatgacataaaaagtttatctttttttcttctgtttgagatgaatcatctttctgttggggcttgctaattaagttcctcttagatactgccctgttcattctgcagactgcagctcctcatctgagttggggatttgagagtaggggacgttgaggggcatgttcaacggctaacctggcctgttcttgatgatggataaaactgagtataaaacaattatttgagggcacaaaagaataaattaaataatagaagaattttaagaaatgttaatgaataaaggtattgaaaaaatcgtatcatttaggagcttgaaaaccatactcgcgctgatccataatccgtaagcctatgaacctgctatcagacagtttgcaggtaaaattttatagagaatgattaaacagcagatgaataaagatatataggcaatacacacactattgctggattgagcgtgcatacggcatgttcacgagacattctttgtcagggtatctccaaacctgattcatctgctgggctatcctgtccactagtgtgctgtgctcactgataacccttcacttcctgatctatttttctgccacaaaaaataagataagctccaggatgcatctagctaaacttatcactgcatgattttaattgttaccccatccagattaattttagcagtattttgttcgtcttgttctaattattagcttgagtctatcgaaacaatcatgtttactaccttaacctgcaggaagagacaggtaaaaacaacgagtgatttcttaagaaaaaggataattgaataccacagatacacgcagataaagagtgatttagcctacttgtttgtggacagttacgaaatttttcgttaaagagaacttttcatcaagcagacctcttggttgttttttctgggggccttttacagtacattttattactgggtgtagtagtgtagtagaaactaaatcagacccttcatttgtttgggtattttagggcttttaaaaatgcttattagggtatttttgactttcaactctaatttcaattatagaagggtattgctcgtaatcttggcgctgcaattattctaatcgacggatcctggcaaggtcgccgcgccgcccgctgcttcatcccccggttatataacttctcaccggggtgtggcgtcttaaccttctcactggtgtcttgaacaggaataatgctcgatcaatttatttttaggaatcctccatcaatttagacggcacatgtgtatatgcatgtactaatttgaagaaagagcagcgatgcattccaaccatgtttgcattcatgcaattagggatcggcgaaccgtccttctctccggattagaagcaacaaaatcaacagaacaaaaacaaaaatccgcatgaacacttgcacgttcatcactaggacaggcccacctacagtctgagaaaaccaagagatggcgtaaaaaatagagtagattagaaaaaaaaacttaaccggtaattaacacatgcgaaattacttctttaccatgcaaaattttccaaatctacccttggggaaataatactatccataatactcagtgtagtagtggcggatatgatccgttggatgcaacgaatggatgatccatgtttacccgagggtacagtaaaaaaatcctttttctgggcggactatgttgcaagatggccagttgcagtgagtgcctgaaaatgcatgatttttctttggttgcataggcttgaacaaataaacatgatgtttctctcattctgtgaatgaaaatatttaacctgtattatttgaattgatctctagtgcatgatagggacggatagactcaggtcagaatgaaatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaatagactgatatgattttttaaaacaactttcttatagaattttttttgcaaaaaacacaccgtttaatagtttgggaagcgtgcatgcggaaaacgatgtgcaatctatctccaatctcctagaacgaacgctgccttattatctcttaccggtgacagtgtatctccatgcaaaacagaacaaatggagaaccttttcccagacaaaatgagatgcaccatccacaataatgtcatttttaaaagcatataatacataggctcactgtcccctaaaagacaaccctgattcatgcactgaacacagagcctgaatgtataatcataggtgcatttcatgttctattcagaaaatattttcttttgagaggaaagatgatattgtttagaaaaggactatcattggtgtccccttctaataggctcacacattgaatcttggttaactttttctaatcaaatacccattcccattgatgagaaactgttcaattattgtcctttgggtccatgcatgtgtcatcatctccacggtgctttcacctaccatggggatgtgacattggtcacgctctgacaagtaatgacttcgctgagtgttccagaactgcataactctgcttgattatgcggctaatatggcacgataatttcggtttaggatatggaattttgtattcggaataatcgaagtcgtggaggacgacactgacgcatccatccattggcagatagtaggaattaagatgcagccacatgataatgtggatgatggatgaatggtagcctagcctactgttgctagccagttttgggccatggcaggtgtaaagaggtcaggggtacaggacattcagattgatagtagacagataatccatatctacatcagcattatatgagcgcaataattggggaattctatctgtttttccgtggatcatgaatctctttcaattttttttaacaaaccggcacaatacaatgccaattttattgtatagcgtaggagtacaagtatttatctgaaaagaaaaaagatagtacaagtgtttttagagaaactagggtaatatttccacgagtcttttgctcctgctcacgcctaagttttcattcctcctttattttagtgacaagtgaagattgttgagagctctatatgatggaagactcgttggtttctttctttccaaatctcccaaaacgttagcaatataagtgaatctctttcgattggataatgaattcactactcatcgtagcagacataaaacgagagatgtgttgtgatgtaataatctcaccatgtttcggggagagtagccgatcctctcaactccctcttctcccgcgccgacaccatcaccgatgagagagaaaccagccttgttttgatcgagcgggagcagaaagcgtggacggcccaaataagatttggggcccaaattatctttacgttgggcgcagattttgggccaaatacggagggcccaagtactgtacggccctggacggacgaccgagattgctgctagctagagttttgctatccaatttccggtcattggaatgaacaatttaaattggctgtttaggtttataattttcgcggttaattcgttttatcacccctggaacatcgtgcgtatcacctagttgttcggcggacgtggttaccaacagaagccctaggaattagtgatcacttcgtcgcgcgcgatgaataattaacggatgaaccaattaaaacagctcgacgagacgacgactgcgagctctagctgtgcatgcatcagcaaacaagatagttatactgaccaaaacaagatttctatctaggattctggcaacgcagttggcgtttagatatagggacttaactttaatctctatatttagacactaatttagagtattagatatatactacttacaaaactaattacataaattaaagctaatttgcgagataattttttaagcctaattaatccataattagagaatgtttactgtagcatcacataggctaatcatgaattaattagactcaatagattcgtctcgcgaattagtccaaaattacggatgggttttattaatagtttacgtttaatatttataattaattaatgtccaaacattcgatgtgacctatctaaacagggtctcagacatgcagtttggcgcgcgctctctctctcttcgtcggtcgctttcgcatctctctgtctgatatggctattcgatgtacataccttcctataaattcactcatagatttagccgcagcatcgatcactgacaaccatcgtctttctctggttgagctagctagctaagctagccaggggagagctagagagatcgccggagatgagccagaagtcgtcgtggccggagctggtgggcgtactggcgacgctggcggcgacgcagatcggcaaggacaggccggacgtcgccgtcgaggtgctcccgccgggcgcgcccctcacgccggatttcaacgacaagcgcgtccgtgtcttcatggacgacaacggcatcgtcttcaaaattcccgtcatcggttagcttaaatgctccaatagctagcctatgggctatggcactagctgatctcccatggctgatgcatgcatatttctcctcgtcttatcacatctgttacatatgcagcgaaataatggaataaatggcgccgtgtacgttcatgtgtttttgctccttcatatgctccatctattccaaaataacttaatctaagatacaaaatgacacattctaaaccaacgaatttgaatttatcgttggtctaggatggatcacatcacatcctagattaagttatttttggaatgaaggaaggaaactttagctaaggatgtattcttttctttcctttctagtaacttttattccctcgttttttacatttacgctttccaaactgataaacgtcgtgttttttaaaactgctttaaaaaatatattaatctattttttattttttatttaatacttaattaataatacgctaatttttcgttccattttgcatgccaagaggaatgttgcgaccccaaaaaaaggcagcctgtatccagtgaatttttcgctgtaaatggtccaccttattcttttagctctacttttagtttcagaagcactagcccctctctccaaatagactagaatctaagaatatgcagttataaaacctagaatatggactagaacctggccgaacccaaacatttttgacaatttgacacgtacgtacggcccatacttattgggccggaatgtgtcgaccttctgacatggggacgtagtggctgggccagtaatagttgggctggatgcgcatagtgccgtagttatgcgcggatctgttgaaaatagacaggacgctgtttttgaggtattgaaactgttgcaaatagcgatttaattaatgttcttcactagttgagaataaagcattctgtcactgacagtgaatcggtaataggataattgctacagacaatgagacaagtaattttcagtggtggtgccttttactctgcgtgagtgagtccatatgcaactatgcatgcataactaaagattcctaatccgcttggattcttttagggttcatctagatgtacgctgcacttaggtcctgctttaaagattagcccaggtttaattttgagagctaatgtttagttttgaattggtaggctaaacattatgttcggatccataggctaaatcagcgctaaaagttggagagagagtagagagagaggggggagatagggctgtttttttatggtcctatagaaaattagcccaattagcatttcttggaggagctaatattttgaggggtgctaatttactttagccccagattagcccacctatttagattcttggggctaatttagggctaataattagcccatatatggaaccaaatagggcctcaggaactttttgatagccacaacttctctcttagaagagttgattctaagagagaagttgtagctattaaaaagttcttaaggccctgtttagttctatggactaattactaggaatattttcagtacttctattttatagttttgaaaaaaaactaaaagtttgaaactataaaacccaatgttttgagattctcaccaacaacttctcataatctcagactcctctaatcaggaccatgtggctagaccaacagtagatttaaccagaccgtggataaccaacagcccgtggagaacctagttagactctaattgacaatagtattgtaattcatagtctaaaataactaaaaagtacaaatgctacctgatgtcctatgcatcggggtagttctatggaggaaacttttttattgtttagactttttatttttctaaattttattaatagaccattccaaaaagtatttatgaaaactaaacctttcggcaacgccagccgagtagctggtgtggccaaccatggtggcgtggccgaacaacatggtcacgccaactgcgcgtggtgcgcgtggcgtgacaaagtttcagatttagaatttttttttgaaatggtctattattaaaaaataaaaattttctctatggaggaatgaccctgccatgtagcgccatgctaccgacgcaaaaaatgtttttttttaagtgcgcacatgataatgtgtatcgccacacaaatattcaccttgacattcaatatatatataaatggagatataaaaacatttaaccaaagaaatactgatgcgtgttgtttgtgtgcactattcagggtatgaatttgttttgttttctctatgtatatatacatgtacgtagaattttgagttggttttttgcgaggtctcgtacatgttatcgtgtccacagtatattttagtgtcgataccacagtagcaatgaacgcgctatgcagtagtacacatgagattctgttgctatggtttgagggctacttatgaatcccaaagtagtttttgtgtaatacaaagtgcatccggtcgtaatgcttccgcaataaaagattaaaataaaacaaaaaggatctctatatattattcatgtaaaagctatatttgcaaagaatatgtcttcttggtactcaacaatatgtgtgatttaattatcttccaaattatgtaaatcaagcagagttacacatgcatgaaaactaagtttcgaatttgtcataatagtacagaactatgttaaatgaaagctctctatatatctgcatgttcatataaagctatatatgcaaggaattttactttttcattagtagtatatgcatacataaaagatgtgatagataaaacattaaacaataaaatattgaataaccacaacaacccaatcaaacaaggaataaatacgtgtcgaccaatgattgaaccacacaataaaaaactatatctagccgtccctctcataaatgcaaacataacatatctttaggacagatcaatcatcgtccacacattgaaatgtggacctagtgacatcaatcaatccgtggataggtgttgccgacgggatgcgccagtaatgacggaaaggcattcggaaaatatttttttctttagaaagaaccccattccccacggtaaaaaaagctgacaacatgatatagcatgatattgtatcctctccgggatacggcagcggcggccggccaaaccctaagctagaacagcagccgtatatggcatatcatgagaaaagcaggaaaagagagatatggggtaaaggatttatgaaccatggtctcttcccccctctatatataatgctgcatccaccaggctatggtcacacaccaccaatcaatcaaagcacacagatctgagctagctagcgcccacctttcttctcccactccggcggcacatctccgccgccggccggtcagccggcagctagtggctctctcgctcctatgtggctatgtctgtctacctaatggttttctgttttcttggttttgggtggtggcagttgacagaagagagtgagcacacagcggccagactgcatcgatctatcaatcttcccttcgacaggatagctagatagaaagaaagagaggccgtcggcggccatggaagagagagagagagagagatgaaatgatgatgatgatacagctgccgctgcgtgctcacttctctttctgtcagctctccctgcagcatgcacgctgccacagccacactctctccattatctaactgctcctttaatttcctcttctctctctctctctctggactcgcatcgatctccgatgagataagagcatgctgctgctgctgcaacgcggtggtgataaagctaggcagcgcgggacctcgtccttatcttgtactgcaggtttgggggtgagccctatacgtgccatgagctctctgaccgaggacaaggaggaggagggaggagacggctttggagactcttattttggcatgagctactatacatgggctttgccatagtagtagtatactccttttgctcttctctgcttttgcaggtttttgtcttggtttcccagagatctgggggaggacgacgacactactacagccagccagcctcgggggaataagctagggagcatcgcgcgtgacgatttgattaattaacctgtataaattcgagtgctaatttgtcacgcgcgattaattaacctcgagtcgatgggttaatgatgctgctggtgagaaaattactagcggatcccaagatctgcacgccatatggtacttacccgctgtgtgttcttgctgctagctagctgctagctgctagctgcttcttttttacaacctctcttaagaaagcttcaagcttgtgtgtttttgtgctatcatctcatgtgtgctgctgcaaagggggagaaaggacggccatggcagcggctagctagctgtgattattggagaaggttgatgtacactgcagatctggcaacctgcgcacctgccccagaagagaggagagcgtcagtatagcggctggcccagatctggaaactgcgctgtaaacgtatgtatattggttcgtacttgttggcttcgagttggagatcgatcgatctgatcttatatgttgctctcatcgattgatttctgttgatagaagtttcttgaggttttctatttgcctatttgttgtgtactgattgttcgagtctgaaagtggttgcttgattctaactatgccaacattcatgtgcatgagtttttttttcctttttcaaatttatttttgaggaataatgagttttgctgttaattagtacttatttctttggatgttcttcgcacataagcagctgcttgttatgttaacaacttaagatgaataagattctttactgcgaaaaacaacctgttcttggttttaatgttctttattatagacaacactatatatgcacacaaatccctttactcgacctatagaggaccgcaatatatatgcacaaatcagctgggtgggagattcttattttatgagatgagatatgatcttctcagttacatggtgatgattattttctgcggatttgtatggtttttaatttgtgtggagatttaatttctagctaaccaatgtttaattaggaacccataagcaaccttagttaatttacacatgatgttattttcgaagccaattaagatcaaccatctatcttttttgctgcacactaattcaacttttctgtaggttctctcccccaatcaaagagtttttccaaaggttctttccccattcaaaagtaaattaagtaggaaagcaggtggtggtgtttatatatatcatgggcaaataaactaggggatttaataccgggagtataacatatatatttgtaaaacttagcttttctgaccatccctttatttcatattgacctttaaccatcctaattttctaatgcaataggcattttttttgcatgttcttcagaaaaaagatgtataagttctgctcatggatttaatttcatgtggtcccttggtcctgatttatatcccaactttacatcaggggttgagtagaattttcatttgtgttctatatactcaaattggacactttatacgagctcccatgttaaccaggaaatctggtcgttgatcgtctacacatattttcttatttccatctatacatatgtattttttcagtgctataacttctttgctcgaatttgaccaaatagtttgaagtcattaaatatagcatagctattaatgtgaaggtttgcatctaccagcgcaataagtaattttctatttaactcagtttctcattaatgttagttgctgaatagacttttacataaatcaattgagtgtttaattatctataacttctaacaaattaaaaacaatgaatgaaaagtttgtaagatttttttagtatgtgcggtagtgctgtaaaatactacttaagcaacatattgagtctaattaattgggctaattgagtacttcgaaagagctctcacatgcattaataaaaaatagatgtggccctttaatagttggatttatcatatattgtgaacgttgataatattaagaataaagcggtctattgaaaacatcatagattctctttagtttctactaccatgaatgctttaggattagtaattctttagaatcaatatattgaatatagagttacctatcttggaccttaatttgttaatttagtttcgaaatttaaattcaataatcagagtgttgtaattgacgtagctagtctcttctaattctaatctaactaatttattatatatataattagaatttaaataattataatataaaaaaaataatagctcatgcaatgccacgggatgctgactagtcattatatatgagccacttttgtggcctacccctccgtcccaaaaagatccaatcctaactacgaatctggacacatgcgtgtccagatttgtagctaaagtttatttttttttagacagaagtatgtgctaaatgttctgtggcattgtacctgtcgtcccgctgtatgtaatcgcgtgtatgtgcccctgtgtgaaccttgatttagaagtacactagcagtgttccttttgtacctagtctttctgcagtagtgattgctccatacaaatcaaattcacatgattggatgatgagtacaatatttgtacaaatattaaagagcaaattttgcaaaacaacaaaaatcttgacagaaactatgacataactacatcgtattaaagccacagtaccataaattaaactatagattaaaccctgaatatattatgactattttttcagccacacggtaccgtaaaactatatcttttagcatcagattttgtagcaaaactgcatattttggaggttagatccctggcactattgtcctgatatctatatattgttctgataaaactagcacttaatgtgtataattctttgatactatggcgtttatcagctgcgcctgtagtttgtatatgcgcatacaccatttacagaaataatgtagttttggttaatttgattttattcataaataatatacatacaggaaccaacagcaacactatatataatatatttctaaatgtagctagctaaatgcctcttatttagccaaatttcttggctgtgtgctctatgacatagatcggggatcatataaaccatcatttccattatttgaaatatatacttattaaatgccttgaaacataccaatttcaaagggttccgatatcgtagcatgtagctagtgattcgtacgtatacagcagtaaaattgtcttacgatcgaagttgaaatgttggtgctgaatgctcttacacctgagaccgatctctctgctgtgtttggcaaatctgtattttcttgttattactctcagcgtataaaacgttcttaacaaattgagaagtatatatgcacgatgatctctatgtatgcatctgtataagctttattaattgttctttctccgtttcgtattataagacgctttaacttttttctagtcaaaatatatattttaattttaaccaaatttatattaaactataataatatttctaacataaaataaacataataaaactaatttatatacatatatacacagacacacacactgctatatttatcgataaacaagatcaaactttaaaagaattgatttaaatcaaaacgattaaaatcaaagaaagtatcggtcaataaactggtttttgctgctacgttaacctgctaacactttgccgcagtacagataccgatcgccatgtggatgtggtcagcatgctaataacactttgcagcagtacagatatcgatcgccatgtgtggatcgatgtgtctcgctcgatctcagctatccatatgccccaacaacagacaatctggcacgtgttggaaattaagtctggagatggacatgtggagacaactgaaaactctgaatgcatgaaacatgagtcaggatcacctttaattttttggtccctaggagtatgtaatgtgaatgaatgattgaatgattgactgatttccaccatttgtatgccgacttttgtaatcagaagataatatacagtatgagtaatttgtagactaataatatatactactaaaccattgttcttttgttgcaatagtgtgtaatataaattcgcagcatgttctagctagcaaagttactaatacaaaaaaatttgtttccccttatcagtgaatatccgcgtgtctatatcaacgcatgcatcagtcgtcccatcacaagactccaggcgcatatagacgatgtatcatctatatgccataattgctgtgatcttaaccctacaaattattgtgcagtgggtaccgtaccatttcatattggcaatcaattgaccttttgatcgggcatgagtagtgacaagaagctgccgctgaaactctgtattaattcatcctggatcgatcctatgaatgtagcaggattatttgtgctgattctgcatcatgcattagcgtatcatatagatgtcacagtagcattactgttatgatcgatctttcttatataacggaaattaaatggtttaattacatctttgatctcgccgatagacatacgaccaaagtaatgaagcttgcaagtcttctgaaccccataaaattatcagacttcagagatacattcagagcatgtactaaacgaaagagaaaatttctttaatgcccttaaaattttagccgatcccttctatgtctctgaattttcttcactcgcttgtatacctctgaattttgatttggatctcttccatacccttgccgtcaattgatcgctagttgaccatttaataggtatagaaaagttagttttgcccttcaatacgtgaggaatatgtagaaatttgtaaactatattgttggaagcatagaaatttattgtgtgattataatattcataagcttgttgtacatagaaattttaataaatattaaaaagtatgtgtagcattttctttaaatcataaacatagttttgaaaagcattcctatataatatataggacaggaaaaaaatattgaactaccataaaaaaatgctacatataatcttttaataagtaaataaatattagtttttatgtcattatgtaaaaataaactttgtcatgaataataccttgtacaataaaatcatgaatataatagtcttatataacaaaattatacacttccaacaatatagctagtctacaatatccagatttccttcatgtgtaagggcaaaatggtcattttcataggaattaaacattcaaataacggtcaactaattgaatgggtatgaaagggatcaaaaccaaaattcaggggcatacaagaaaatggacaaaactcatagggatagaagggattggttaaacattcaggggtatagaaggaaatttctctaaacgaaatggggattctctacaggaggacaatgataaggaactaggtcccgatcttctgatatatatattgataactctcaattaaatggcggaaacttgacacacatgatccagcttccgatcaatataattcgaaccctacaatcaaagcaccacatctcctttggttatcaaccgtgccctgcccagttgacctcatcgagaagactaatccctacatgcgaatcgaagaacacgagtaagaacaaggtagattattgcaactcgattgcatatgaattattaagcactcgaatttagggttccacaaaccgaacaagcgacaaaactgcaatgccagaaataatctaagcaaaaccaagagatggcgtaaaaaatagagtagattagaaaaaaaaacttaaccggtaattaacacatgcgaaattacttctttaccatgcaaaattttccaaatctacccttggggaaataatactatccataatactcagtgtagtagtggcggatatgatccgttggatgcaacgaatggatgatccatgtttacccgagggtacagtaaaaaaatcctttttctgggcggactatgttgcaagatggccagttgcagtgagtgcctgaaaatgcatgatttttctttggttgcataggcttgaacaaataaacatgatgtttctctcattctgtgaatgaaaatatttaacctgtattatttgaattgatctctagtgcatgatagggacggatagactcaggtcagaatgaaatgacatacagtgcatataagagaaaggtctagtaggcttaactctgcccatgtgtccagctagctcattgcgacaagaaatcttaggctgtgttagagaaaggggagatagataagattgggaagatacgcaaaacgaggtgagctattagtgcatgattaatcgagtattaattatttcaaatttcaaaaatnnnnnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnn

SEQ ID NO: 814 - DNA, 4948 bp, Oryza sativa
ctcctcctccactgcttctactgcctcccttgctctagcccgttgccatgcctattgcggctacaaaccgtgggcaagacgtgtcgccatgggagcgccgcctcctagtgcttcctctatcgcccatcatttccgtcgccgacctcagctgctgcgtcatcccaccgacgtcagcaagccatcgccatcaagcccagccaccatggtcagccaatctcaagacgatgccccgcgcctccttctccaaccagtcattgcggtcgcctttcttcatcaacatccacgctcccatctccctccactgcacccaagcttgagctctgccataccgagctaccgtctcgtcggagtgatatccttccctagagcgtatctcgccactagcatcttcacacttgagcgagtctgttttccccattttcccttctctcccacctcacatcaagccaccctggagttttctctctcctgccggtgctcccaactctttcctcgctccccacgctagctgcctccttcctccatcgggccatgttcaggatcacgtcaatgcgccgccgttgtcgctgttataccaccggatgctgacaccattcatccgctcttcctttgcttgctcgacctgaaccgaggaagaagaagaggaacgtacgtagccaggtgtggggacgtcgccactgcttcatccgatcacgtcctaactcggacgacgaaccaaaattgcgtgtgacaataggaaagatacaaaattttgaagtagttaagataagataagatatacgggtgcagccatgcggcctaatttgtgtcctctgatttcgtagcaaacctgatttgggccgcagcctcgggccgagagcacgagcccacggagagttcggcccagtacattctataggccgatcgacgtggcagacccgagcccaatacgacccacctgctccttccctttcccctcccccaagcgaaagccgcaaacaaatccaaccccccaccaccgcggccgatgtccaccctctccccggacggcgactccgactacggcggcggcggcggcggcggcgaaacagccggagcagtgatggccgacgtcctctccaagggccgggaagcctgctacaaggtgagcgacccaccccctgagaaaaccctacctccaccgccgcgctcgtttactgatgatgatggaggcgacgcttgtctttctccctccaaaccctaggcccgggacgccttctacacgtgcgtggagaagcacgcggacaagaagcccaccgagatcgccaccatggggctcctctaccccgccgactgcaagaagtcccgcgccaacttcgtcaacagctgccgcccctcctgggtcagacgcgggcgatccgaccccttttcacgattcgcgtcgttctcttgattttttttttctgacattggtttccttgggcaggtgaagcacttcgaccggcagtactccgccaagaagcgggtgcagcggctgctcgacggcggcgacgaccgccggggccccatctcgctcccccagccgtacacgttcaagcaataggtagctagctctgctgctggttccgtccctcggtaccgagctgaattacatctttgcgtcggagactggatgcggcagtatttgtttcagatttggtggtgttaagatggaaggcatatgcctctgctttctagtacgttggtatgaattgtgaatggatgagaaagaacttgcctatgacttttatcgcaatcaagatcttgttgtggtagtgtttatatctttgttgcaatacattggtactgtccataatcctcactataatttctgctgtttgatgctttatttcaacggacaaagtttagaagcaaagataaatggttcgatcaagctgcatgttggcctcgttttctcattatcatcttggtgctgttgtcatccacataaatgataatagtatggttaatacatactcgtaatgtttcatgtttgctgtgtgagttccaaagtgtggcttcagtagtctcattcgtaatatttctcttatatgataaaatgtaattagtaaccttgtcttagtatgtgataattcgaaatttgaaatactgaattgataccaatgatatgccactgttttgtgttatcaaatcaacatctcattaagtaattcacatataattttgttaaactgtaagatacagttattgttgaacgcacatgtgttttttggttcatattttgagaaaaaatgctttagtatgcaatgtggatttcacctatgcctactaaactgttgaatgcatcaaaacatcgagtgttagctcttgttgtgattttccttgggtcctatggacagattttgttaagtcgaaatagaccactttgatcatccatcaaaattctacactgactttcattggatcgtattaggagatgatttgagcattatttgactgtttgcaacctcttattgctttatgctgtaaattccttggatgtgtagtccatccaacataccagctggtcctttgcatatgagttttgctcggattttgtttgggctttctgtgaatcttgctttgggtagttcggcctgtgattcataataccagacgacagataagttgaaagcaagatgccatgttgatttgtacgatgacaggatgtagtgccatttcaggcttactccctacatgcagttaatgcttaatgcaaatactaaaatatgaatttatggtaacactgggaactatttaaaccttttttcttttagggtgatctgaagattctgtattctgttatatgcttgggtttctccaataattcttcgatttgttcatctgcattgctacacttttttctggtaaaatgtgttcatgacctgcagtgctatgctttactttggtaatgatgtgtttgtttatacatagatccatactttcgtactgcctttctagtttatactttctagtaaatgcaatgtcattttctatgcaatattcagcttacacatttaggatatccagtgtcccaggtgttgctagatgtgatggataaaattggaaatgcaaatacaaaaaggagggtttacttagttaagtgaaagtgtgaaacagaaaagtaatgttacatacaaatggtgaactctttatgattcatatgaacgataagtttacagagaagtatatatgaattgcttaaattgcacgtaaattgtaaagctttcattggactacaaatctgtgaacctatttcatagaactacatatttaagacattattgtgtcactaagctactcatttaaactgagtagtcaaatactacctctactaattactatagtaggaatttctgggttttaattattgggaaatctatttctgtcatggtaaaggctgttttagatttatcttttgtcttggcagaaggctattttagattatttgttcacacgacttgtcatgcttgcatgtttggaattggttattagatccagtttttagaaattccttcctatgtatttataggcttttgtttcattgtcctgttgtggcagaggcttgttaaagaatcaaaattgcttttgtaacaaatgaaaaatgctaaagtatgcaatgtgattttatctatacctagtaaactgttcaatgcatcaaaacatcaggtggctcctgtgatttttgttgggtcctatgggcagatttttttaagtagggatggaccactttgattttgcatgctttgactgtgcaacctcttatagcttatcctgtaaattcttgtgtcctatctggtagtccatgtccaacatcccattcggtcctaaacatatgaattctgcttgcttttttttttgggttatctgtgaatcttgcaccttgggggggggggggtagttcattgggttgacaaaaaacatatgattgaatattgttatttcagttttttttgtgtgcagggaatcgttatttcagatgattgaatatcgtatttcagtttgacatatccatagagaaccacttttagatattagaaaagtgaaagcaagatcccatgttgagttgtatgacaggatgaagcatttacactgtttcgtgatatcaggcttactccctacacagttaatgcttgatactaaactataaatttatggcaatactgggcacaaatttaaccttttgctttagggtgttctgaaaagaaaataattatgttatgtgcttgggtttctctaataattcttggatctgcattgctaggctttattctggtaatgcgtttatgatcctgagtgctatgccttattttggtaatgacgtgtttgtttatacattgattcatagtgcctttgtactttctggtaaatgatatgtaaatgatatgtcatttaccatgccaaattcaccttacacatctaggatatttagtgccaagggtagtgtcaagggtattgatacttgatagatgtgaaaggtaataatatggagacgcaataaccaaaaaggagggttcagtgaaacagaaaatttaatgttacattcaaatgatgaacttgtttttactcatatgaaggacaagttttacatgaacgtatatatggtatatgaattgtaaattgcgttaagctgcacataaagcgtatagcttccaatgaactacagatttacgaacctatttcatagaactacatatttaagacatttttgtatcgctaagctactgatttaagctgagtggtcaaatatctttactaattagtacagtaggaatctcggttcttaattattgggaagcctattttatttctggtgtcatgatgaagactatttcagatttatcttttatcatgttgaaggctattttagattgtttatcacacaagttttgtcattacttgcatgtttggaattggatattagttccagttttggcgcaaaacttttttt

SEQ ID NO: 815 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnctcctttttgtatttgcatttccaattttatccatcacatctagcaacacctgggacactggatatcctaaatgtgtaagctgaatattgcatagaaaatgacattgcatttactagaaagtataaactagaaaggcagtacgaaagtatggatctatgtataaacaaacacatcattaccaaagtaaagcatagcactgcaggtcatgaacacattttaccagaaaaaagtgtagcaatgcagatgaacaaatcgaagaattattggagaaacccaagcatataacagaatacagaatcttcagatcaccctaaaagaaaaaaggtttaaatagttcccagtgttaccataaattcatattttagtatttgcattaagcattaactgcatgtagggagtaagcctgaaatggcactacatcctgtcatcgtacaaatcaacatggcatcttgctttcaacttatctgtcgtctggtattatgaatcacaggccgaactacccaaagcaagattcacagaaagcccaaacaaaatccgagcaaaactcatatgcaaaggaccagctggtatgttggatggactacacatccaaggaatttacagcataaagcaataagaggttgcaaacagtcaaataatgctcaaatcatctcctaatacgatccaatgaaagtcagtgtagaattttgatggatgatcaaagtggtctatttcgact

SEQ ID NO: 816 - DNA, 394 bp, Oryza sativa
ccggtacagggtgacgatgttgtcgtcggggaacgggagggacccggcgaggagcacgtagaggatgacgccgcaggaccagaggtcggccttggcgccgtcgtagcccttgtcgcggagcacctcgggcgcggcgtaccccggcgtgccgcaaagcgtgtggaggaggccgtcggcgcgggcgtggtcggcgagcgcgctgaggccgaagtcgaccaccttgaggttcccggcctcgtcgagcagcaggttctccggcttgaggtcgcggtggtagacgccgcgggagtggcagaagtcgacggcggagacgagctgccggaagtagtgccgcgcggcgttctccctgacgcggccgaggcggacgatgcggccgaagagctccccgccgcgg

SEQ ID NO: 817 - DNA, 802 bp, Oryza sativa
  unsure (1)..(802): unsure at all n locations
aacctcgagtcgatgggttaatgatgctgctggtgagaaaattactagcggatcccaagatctgcacgccatatggtacttacccgctgtgtgttcttgctgctagctagctgctagctgctagctgcttcttttttacaacctctcttaagaaagcttcaagcttgtgtgtttttgtgctatcatctcatgtgtgctgctgcaaagggggagaaaggacggccatggcagcggctagctagctgtgattattggagaaggttgatgtacactgcagatctggcaacctgcgcacctgccccagaagagaggagagcgtcagtatagcggctggcccagatctggaaactgcgctgtaaacgtatgtatattggttcgtacttgttggcttcgagttggagatcgatcgatctgatcttatatgttgctctcatcgattgatttctgttgatagaagtttcttgaggttttctatttgcctatttgttgtgtactgattgttcgagtctgaaagtggttgcttgattctaactatgccaacattcatgtgcatgagtttttttttcctttttcaaatttatttttgaggaataatgagttttgctgttaattagtacttatttctttggatgttcttcgcacataagcagctgcttgttatgttaacaacttaagatgaataagattctttactgcgaaaaacaacctgttcttggttttaatgttctttattatagacannnnnnnnnnnnnnnnnnnnnnnnnnnnnnnnnnnnnnnnnnnnnnnnnnnnnnnnnnnnnn

SEQ ID NO: 818 - DNA, 697 bp, Oryza sativa
  unsure (1)..(697): unsure at all n locations
nnnnnnnnnnnnnnnnnnnnnnnnnnnnnnnnnnnnnnnnnnnnnnnnnnnnnnncttatgttctgaattttgtttcactattgtattggttttgagtactgatatatgaaaataattcactgattttgagaactgatatacgaaaagaaatccactgatttcatgaagaaaaatgaatttaggttgagcctacttatcttctgtattttgttttactattgtattggttttgagcactgatatatgaaaagaattcactgatttgtaacagatgctttgctttagatttaacatttaatttcaataagccgatccttatataaagtataaataaataaaattgcaacaagcgaaatggattgttccatctgttacatcacgattatgtaagctgtaaagttaaataataagcctgtttacctgtgtaatatttgattgttttgagctatgctgcaggcagcaaatcatatctctgatgaccttgtacctcttgttgttccggacaaagctgggacagctagggcagtgcgtgtgatcttcactagttctccagaggataagaaccttctcctgggttgtatctcttcagattggcagcatgtgcttgtataaaataaaaggaaggtgtcacgtattcaggatcccgtcttatggaaattattttcagatggacataaaaaaaatggaggatgaaca

SEQ ID NO: 819 - DNA, 173 bp, Oryza sativa
ctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacga

SEQ ID NO: 820 - DNA, 59675 bp, Oryza sativa
  unsure (1)..(59675): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttatctggcatggcggagagccgtttggtttttgctaaagcacatgcaatgcatgcttaatttgcagaaactacagtttagatttcagaaagatgtccggtgtatgtgtagaaaggcagagtagtgtgtctgtgtgtatgcggcgctcgtctagtattgtcctgttgtggaattcgacgcgcggaacattttcagatcaggatatttggtaccaattcccatctgattctggaaacgttaatcctgccaagatcacgtacgggaagtacgctctaacattaattccttcaactatacttcatcgattcccttgatgcggaccaacatgcctacctggctactattttcgtctcaaaataattgtatttccatgatttaaactttgtcccaaaataattgtaattttagagtactaattgccccatcaatcatctctcattcaaatttctctctattataccctcaaccatctttccactctcacataaacatcttttaatgaggagcaccatagtcttttttctcaaaccttaatatatgctaaacaatatagaattgtaattattttagggcggaggtagtacttttgtgtctcgtgtcgtcacgtcgacaaagatgacaagtccacacctcagttgactcaggaacgctctatcgtggcaactaatcgtactcctacaagcgaagtactcggtacaacggtacaaaaggccctcttccttgtacagttatatggagtaattagcggttacactgagctggtagatatgcgcccatattctttgcttacaaaaagccattattcagaaagccgttcacaaaagaaaaaaaaacagaaagccattaaacacgttcatatatatgattatatccacgcagggaaggtccatggaccaattgcagctacgtcggtggtcactagtggcacaagacagacagataagtgactatcagattagttattactacttgcttaacaactaatgaaccatggtgggaccaccctacacgaggagcccctgcaccggactgaggtgaggtgcgcctggcctctgtcactgacctggaagggctagtcaccagactcgatcaccacagcgcaaagaggatcgatccgagctagcgaaacttagcttgctttgcttttacgggtcagtccctgtccgcgagctcaggttgctcagctaacaaaccccgcgtcgatcggatcgatcgatcgatctgtatcccagcggcgtcttttccttaggaaaaccacaccacacctcaccagtcacaccacacacacagcaacacctgatagatgcaatcatgtgttgcttcctgcatacagctttaactaactcgaccgggaattcggaatatcgcctcgcctaccgcaggcaggagcgtcgtattgtgcggcacgtcggaatcattcctggagattggagaccggcaggcgtggccgggggagagagttagctagaggagaggaaacgagaaaaacgggaccatctatacatttgtcgacaaattttctactaaaaaatttgacagatgtaattatagtacaatcgtagtgtaattacactgtaacttgcatgtaactatagtataacttgtacgtaagtttcacataattttgaatcgttagatctattacaagatttgttctggtaaggaagaaaaaaatcacagcacacacatgtgaaaggatttgttcccacgacctctattttactgaaataacatgttaccgagagattcttgaaagttacatacaagttacattatagttacagtgtaattatatacaagttacagtgtaattacactacgattgtactgtaattacatctgacaaatttttggaggaaaatttgtcgactatagtaaattcgagaaaaacacttaagtatgtgggtgcgtgcgcgagatgcgtttcttttcttcccgctgccgcgacggccaaacgaaccgggtggacttttaggtgggtgcttttcccgtttggcgatgccggtaggatggatttgtgctcgccggttgccatcagggtttgttatgcactgtgcggtagatggcgacggttcgtgcgaatgaaggcatgcaccacgacgcgacggggctgatgtgccgcttggaccagaaatggatgctgatatgcgatctctggattctgttccattcgtcgtggcaatccagttcgcccctccacccacccaagatatagattttacattgatttctattaacacatttctcaatctagtaaatgatgtattacatgtgaaaagatgcttttaaatataagataaatctatttttaagtttaaaataattaaaacttaattaattatgtgctcatgacattcttgttttacgtgtatctacttaatcttcaccattcgcaggttggaacggttgcatgtacttaagattaacaaggacaattcgcatggaaggatatagcgtaaattatggcatggcaaaccataaatatagatacaaaatcatattaattatgatgagtataatataaaattagcagggtaacccgcacaattatgtggctagcacagcaacgaatttatattattttttttaaaaaaactatcttttataggattccttattcttatcttgatcttcgtcaaatttggtgagcccctatgacacttgctattcgttaaccctaccatgttatccaccagtccacccctttccgctcgtctgcgcgtcattacaatcatcctcttcatcgtcatcacgactatgaaaatggggttccttttgatagattttagaagtctcaccaattgcctccccttcacttatttggttatgatcccttctctttattgtggtagataccttcaaaattcaaaccttatcattgttaggttcaaatatttatagttcttatgtctcgctagtcaccgccttcctactctttttgatgctgctcctgccacccagcttcgttcatgccatcatcttctagaaaaaattgaaccacaaccattaggagctctatatgtgttgcaaaagaatttttatattaaaatatttacaaaatgtttttttttcaaactttaacaaatctataccacccctcatgttctctgcgaggactttttcaaaaaccccatagggttttattttgaaaaaaaaagcttttttttacgatgtggtagacgatcgttggtgtgtgctattagacgatcatcgggggctaagcactttgtaggcaaacccgcctgcaaaatggcaccccatcttggcaatcgacagttttccaaggtgccccctttaagcgctctaggaggcctgcaaaatggacagttttccattgtattcctttagaaaggctgcaacttgcaagggagcagcttgtaaaatggccatgccaacctctagatggcagcacttaggccctgtttctttcagcctgggattattataatctagattattaagattaagctgaaagaaacatacaacttattaaaatagcttattataatctggagcccagcttattataatatggtaagctcatttatgtgagctttttctagattattgggtgaaaaattacccaccatgctaccccactccctctttagacttgcaaacccaataatctaggctctaaaaatctaggaaagaaacaactaaccgtatattatactacagattataacaatctagcttatagtaatctgactcaataatttagattataataattctaaactgaaagaaatagagccttagctcatgttagcggatgcttgccacgttataaaaaaacacccttctagagaatatttttctttcgtaaagaatggactcgtagaggacgggagaggtataaagttgtgaatgtttgaaaaaaatatttttaataaaagaatggttctgttgcgaagggagaactaccctgcatctcacgggcgagtgttagggtagcaaatgggaagaaaagaaaaatcacacatgtgctctagccaaaacaaaattggtgattaaaaaggaaacgaatacttggtcaaaccttaactgacagagaaatgttgttgcattcacatgggatgtaatgcacgcatatgtaatgcacgatcccaaagtgtgtagatcctgaaggggttcacaagattctcccacgatcggcacttctcccacattgcctaagatggaaagatgcacttgccattgtaatgagtagtcgaacagaggttgataggtgataggcagttgtaagctgaggggatcacatgtgtaaatggataatacgtatattagcgaaggacagctatcacggactatacgatagccgtagttcgccaatggaacacttgtccgagaactaacaaaagacataggcaccccaaactatcttagaaatcaggtcgtgtgaggccggtgcgtgttgacggtcgttatcgatcagtttcgaccgtcaatattaccaaaatagaggagaactagtgatgcttgcaatgcataaatatgttagaacaataatattccactagaattaggtttactaaccttttgcagagaatgacaataaagtgaaggagaatcgacatcaactcagacgataaattaatcggacgatgtcgagaaccagacttgtgtatgaatgggccaagaactcagaattgacacgatgaatcaggccaaaattcacaagtctacgaagtgaagcagcagaggaggccgccagccgaaattgggctggattgggccagccccaggttcggccaaacctgatggttcggccgaaccaccctcgccttcgttggatctaggttttggctggacggtcgagatgaagccccaatgacggtcgagatgaagccccaatgacggttggatctaggttttggctggacggtcgagatgaagccccaatgacggttgaagctataaaaggacttcaccttctcacttcactcacacacctcaagcaagagctctatcattcctctcaagtttagtttagtagtatctagctggtggaatagaattagaataggaatcaggagtccggaagtcttcggaagagttcgggtatggctctagtagctttcctttcctcttttgtaagctttgtacttttattagaatactattctacatacatttatggtattggaatactttctgagtatatgagtacctactttacattatattcatgttatactgactatactgctaacttatctaggagatgctttggtgcgggtatagtgtttgcatatgcaattactctatgtcatgacgatgatattagagtagtatctagtagtttaaacgtggtgtctagattacaggatatcattatttggggttatatattgtggatgagaggtgggccgctgatggtgacagctcaataggggtattcctccgcgcctatatatactcctaagttaatttcttggggagggtactcctccgtatttagccccggttggatggtcatgacgggctatcgtaaggaactcggcagtcaggggtggcttttcgaagtaccaggagggcatcggatagagggtattagctagtatatcagttaactagaatgtatgtataatttgtatattagaagtataggaatagatttcctttctcttttctttccacccagcttagattatttattatgaggatgagtagaaatgcttaagtgtcactctacccttggattatcttaacccctgcttagaatatgattatcacaagtaatatataaattattagttgagttctctctacgtgatcttcccacgggataaaataaatacgatacccttggaatactctcaggtgaaatgctacaatggtatatccgtgcgcttgcggatgaactctgtaaccataatataccagaagtatttctgcgccattgctgagaattatgtttctagtaatatcgttaagaaataccaacagtgcgcaatgagcagacaacaattcaattaccacaaatactgtatttacatatccacgtatctttttttttccaggccagggcttcgcaaattaattaatggtgacatccttaaaataaaggaagaaccataagcatacccggggaaacaaaataccgaagtctgctacggatcagatctaatcacagtatacaaagtgtgagatgaatcgccagcacataataatttaatttattctataaataaatcatgacattgcagatgtaaactaccatgaacgcatcattagatctacacatgtaaactaagcagtaaaatataaacagatcaaatatgcgcaacatgtcgaacacgtaccgaggtggcggaaagaccagtttctcggcaggaactactcgtggttgcgggcgtcgacgaaggcgcacggcacgcgagcggagaggaaggcgagccgtcgtggacgaacagggagcagtcacgcgaagcgcttccgaaaaatattattgccgccttctcccggtgcaggacgtcgaaggcagaggttccggagacctgctctcccgattgccggttcacgccggcgagcgggatggagtagtctacgagcgacggcgcagtacagagtaggaggcaaactctagattgatttcgtgtctgttgcgtgaaggtggcgactcggtttatatagagataggtcgcttgatcagggcgcccgcatgatctccactccgcgtaaccgaaccggataagtcgcgcgtaacttattcggactccacaccgaaccggataagtcgcgcgtaacttattcggactccacgccgttttcacgcaccggatttttcgaaatgtttccaaaacaaaacaaatccgaatttcctacagcaaaacaaaactgcaaaagaaggctgcatctgcgcaagggtgaggagccaattttgcggaccattcgacgtgtacgtcgtgcacacacggccaagccaagcaagcgagcgagcgtgtgttccccctcttctctccaccacacatgcttcaagtggctaggaggcattcctcccttttaaggaggtccccctctcctagaataagcaaggtggtactaaactccacatgtatgccatctcatgaggtgggcttttgtgatttttcaaaaattaatctttgagtgggctttagcccatccattaattccaacaagttaattgttacactgatcggcatgcagacaaccactttgaatagagctcaatatccgcaggagaaacatacgcatcttcctcacctacagcttccaaaaagtcgcatatagcaacctgaaacttccagttctctccacttttgagcaaagctctgttttcaagcattgttcatagctttgtcgcaaaccttgctatgtgtttttttacaaaaattttctataggaaagttgctttaaaaatcatattaatctatttttgaaatttataatagttaatactcaattaattatacgctaatggctcaccttgttttacgtatcttcccaatccccttctctccaaactcagtcgggcacctctactacaaccgtatgttttttaagcaatttcatccaggttaacattggttggtacctttgaagaagacaaccaaaatatacgatgtgaattaaaataatgagtcaattatatattatagcactagaacatgattactcaagacacataccacaaatcttctaactttatcctcaatcaatgctctccgacatgaaaaatcaggaagctgcacatatctctcaaacctttgcctaaacaaaacaatagagttaatattaagaagtgcaatgcatacattgataaagaaacatttactattcgtacttacgagttgtaacattattaagtaaacatagtattgacttctgagaatgtttgaaagctactatcactgaatatgcgcagtactttcgtgcttatcccgaaaattgagcaacctatggaacttcgggattttcgtcccattagtctttgtaacgtcatttacaaagttgtatcgaaatgtctcgtcaatagactgagacctatcctggatgagttagtttcgccttgccaaagtgcgtttgttccgggtcggatgatcacagataatgcgattttggcttttgaatgttttcactccatacaaaagaatagaaagcctgagaacgctgcttgtgcttataagcttgatatttcaaaggcttatgatcgggtggactggggttttttggaggtataagctgggtttcgctcatcgctgggttagatggataatagtttgtataaccacggtgagatactctgttaaattcaatggaactctgctctctacttttgctccatcacgcggtctttgtcagggagtcccgttatccccctttctgtttctgttcatagccgatggactaccattgctgttggaagacaaagtggctcagggagctctctcgccagtgaagatttgtaggcaggccccggggatttcacacctgctttttgctgatgacacgcttttgtttttcaaagctgataacgttcaagcccaggctgtcaaagaggtcattactgattatgctttggcaacaggccaactcataaacccggcaaagtgctcaatcatgtttggggaatcctctccgccgcagactcgggatgttattagagtgaccttgcaaatagctaactctggttttgaggacagatacttgggcttcccaacccctgaaggaagaatgtgcaaagggaaattccaaagtttacaggaaagaatctggaaaaggcttattatctggggcgaaaacctgctgtcgagtggcgggaaggaggtgcttataaaatccgttatccagactattccggtatatgtgatgggcatctttaacctaccggagtcagtatgtgaggagttaaccaagttaacacggaatttttggtggggtgtagaaaaggggaaaaggaaaacacattggaaatcctgggagtgtttaactcgtccgaagagcaatgggggcctaggttttagagattttcgtctcttcaaccaagcacttctagcacggcaggcctggcggctcattgttaatcctgacagtctatgtgcaagggtactcaaggcaaaatattttccaaatggttcccttgtggatacaagttttggaggaaatgcttccccggtgtggaaagcaattgagtatgggctgtcacttcttaaggaaggaattatatggagaatcgggaatgggaagtcagtgcgcatttggagagacccctggttgccaagggatttttccagacggccaatcacgcgtaaaggtaactgcagactaaaatgggtctcggaactgctgtcagaaaatggtgcctgggatgaaaccagagtaaaccaggtgttcttacctgttgatgctgaagcaatatgcagtatccgggtctcctcacggcaagaagatgactttgtagcatggcacccggataaacatggcaaattttcagtgagaagcgcatatgggctcgcatgtaaccttgttaatatggagaccagttctagttcttcttccgcaagatgcaaaagaatgtggaatcttatatggcagaccaatgccccccaaaaggtcagaatttttgcatggagagcagccaccaattgtctagccacaatggagaataaagcaaagcggaagctggagcaatctgatatatgtttagtgtgtggtttagaaaaggaagacaccaagcatgtgttgtgcagatgtcctgacgccaggaacctatggggggccatgtgtgaggcgggtaatatatctctaaatgggggtaatctgtgcaatgacccgggttggatttttgatcaactggaaatcctgttggattatgagcgaactgtgttcctgctgattctttggaggatttggtttgtccggaatgagatcgtccatgggaagcaaccaccccctatagaagcttccaagcgtttcctggagagctatgtaaagtcactgttggagatccggcaacatcctcaagcgaatgtagagaaggggaagcatgttatttcctttgttaatgggaaaaccaatccagccaggcgacctcctgaggataaaaatcaaaaatggaggaaaccgtgtgaggggtggatgaaagttaatgttgatggctcctttgatgcgcagactgggagtggaggcattggcgtggttatgcgggactggagcgggaaggtaattttcgcctgctgcaaacacctgcctcgatgtggtagtgctctggaatcagagattttagcttgcaaggagggcattctcgtgggactccaatggtcgcttagacagtttgtagtggagacggactgcttgatggtggtgcagatgctcgaatcaaaggagagggaaatgtctgaggtagcttttttggtgaaagaagctacagaactgttatccggtgatagggagattcagctcccgaaaattcatcgcagccaaaattcagtcagtcatttattagcaaataaaggccgttgtgagggcctgtctgtcttttggttagatcatgaatgctcttgtatttctcgtcttgttttggacgatttaagtcctgagtaatatatccctttccccacaaaaaagtttgtaacttgtttagtccgataatataggagtaaaaaaaacaatacaggattagtcaacaaaaccaatccataaaacataggattactcgattgcatttttggatgtttcgtatgaaaattgcacatttacttgaagagtgaacggctaaaagaaattccaagaaattgaggctcacgctagattttttttttcaaatgcttatggattggcctactccatatacaggagttccaagatattttttcctttttgtttgtttacaagagggtagagataaaaacgatacgaaatatttccagtttctcaagatatgccaagccaaccagtcgatgtgctcatagggtaaaaacagtaaaaaaaataatcttattagtgctcaacctgtgtgttttaaaaaaaagagtgaaaagtataaacacgactacaagcagctttctatattaattaatgtcactaaaaactatcctcctacaatattagagacaataaaatttctaaaccattaatgcataaatattttttttattatacttctttctttttctacaccctcatgcaacaaactttctattaataaatgtcaagagtcaactctgagctgttgtcatgcgtagcaatgtgtttctccatactttcctttttttttccacgtcatcaaatttacttgcatgacaacgaagagaacccgttattagacactgttgtaaaccggcattgccttgatgatccttttatgcacttcctgtcacggtccggcccatcctagctgccggcctgcccccgcaggaccgggaactttgggaatttcctttggatccagcattccagtgattccgtcggaactgagaccgagacgacgcccgcactcctcctgcgggccaggggtgtcagcagcacggcggcggaggagcggagcaaggagggagggagccacctgatccacaggagcgccgcggccaagccgcccccgatgtgtggctctcccggcgcaccccgatttcctcgcccccacctcggtcctcgacgcgacaacgaccagtagcaccgccgcttctccgccgctcgctccgactccgagccttaaacccttctgccccccacttccgcgacctccggaactccaccagcagcagtcacgcacgtctctctctctcgccccgcgtcctccacatggcggcgtccaccacctgccctgctcgctccatggcgtccgtctcccgagccctccgcccgcggccgcacgccgctatcgcctccgccgccgtccgcacggctgctcgtctcggtacggcgctcgttggagcctgtttggaggagacttttgcttcttttttttttcccattccatccctctgagctggatgttggcttgtacgcagggggcggattggggatcgtttgttcgatgccaagctatggtaggaaggagaaggaagaatggggattgaccattgcgtccgcaccggcgaccactgctgctccggctctgaggtacgtgccgtatgagcacctcgtcgatgtttattgggtccggggaattgctttccttaggtcgtggattacccaattacagaagagatcagggtttgacttggtcaacacaaactgcgtttgttgagtgttcactagtcacgttgtgctaattggaagtaggtgctgcaacctttctctgctactttaaccaaaagtcccatctgaagctgcaaaggctgctgattgggggttcaacaactgcagcttattgtaaaaggagaatcctgaatatccttctggtgatgtgctccaaccaaggtcccatgtggtcacagaacttaaagtttttttttcattatgaacacttccctttggaagtataggtatcttaatgttatcatgaaaacacagtaacaactctaaaatactggctttagtcatttagtatgagtaatgcttttgaaggaagtaaaatgtaaactagaagggatgaaattgatgaactattcaataaccatatagaatgggtatgctgcatgtggtgaatttgaagtacatggtatacgctagcaactgatcaattctcaaatttcctctaaacattgctatagatgcaaaaaaaaaaaacttttaaaagagtgactttgtaagtaatcacggtggccaaaagttcttgctctaccattttcagctgtcccaactagattaactcagtggattagttgtgtgagttgtgtttactttagtcatgcaatctgttgaacttcattgtatgcttttaagcaaggtggcatgtgtgcctatccttctaagctttgcatttcgatgtttaagggaaaattcatcattaccttctatattttgagtatcttctggactatatttgcatgcctcagaacaagatagaaagtgaattgattggaacttctcatagtattatgttctgtctctgtagtcagtcgaagtatttgctgttctgtttagtgcaatcatgacccattcttcaatcccctaatctgattgttttcaccatttttctgttgcaccttatgttttagtgttatggcatttctaatctgtagttcagtagtttatatttgagaaaaaaagcccagtaccttttgcaattaaattttctactaattagaccaaaaatttcaaggcgtgatagctagcatacttgctttccttacaggccacatagttatatttttaaatagtgcaatttcatccacatgattaatgatcctacagatcagcaaaactatattgctggcctttcttgaataatctcattattaaacacttgttgctctgattttaattacttatggtaatgatgaaatgatctgttgtttcctcagaagctgtcaactattgtgcaaggctgaagctaacatatccagtaatctgccagagagcattcctagtgaagcaaaccagtacgagaaaatagttgagctgcttaccactcttttccctgtctgggtaagttgatttgggagcatttgaggattttatctgcccttttttagcttctagttctgttacatttggtggtttgtaaagcaaatattaaaaaatgtactaaggcagagctcaccttttgcaggtcatattaggtaccattattggcatctacaagccatcgatggtaaaatttctaacttgacaatacccattactgtctgtactcaacagcaaatgccacagaaactgactttatagttttcttggaaaactttcaggttacctggttggagactgatcttttcactgtgggcctaggattcctaatgctatcaatgggactaacattgaccttcgaagatttcaggagatgcatgaggaatccatggactgtatgtttctgctcctgaacgtcttctcttaaagaaatagtgattatttttctgtacttgaggcctccaacttgatataggtttactaatgcaattgcctgttgcaggtgggtgtgggatttcttgcgcagtatttgatcaaacctatgctgggatttgctattgccatggtaatgctaggccatgccttcctattatttctaatgaaagaacaaaaaaatgaaataaacacaatctgttattcctttgtttggatatgctgctatggcagctatgctaggctttcctttcatgcgaaacaggcttgttaaagattctcatgtaaactctgggaaatattaaattgaaaggttggtgccttgctcaaagaaataattgatttgacaagcccttccctgaaaagatgcacatgccattatgctacggtttcttttcatgagatttttcatgcaaatgttaattgtaattaaattaaaaaggttgatgtcttgattaaatcaataatcaataaactgatctgacaaagcaaccttaaagatttgaaggttcaagatcaacatcaaagatttttttaaaggttcaagattgttctctggtttcatttttaggaccttttcctttcatttcctgtgtcttggatactttgagcatgtcacgtatctcaagtttcttttgtttttccatttaattttacctttttcccttgtaaggtgatatctcatctcattgcaatttttatgtgaagaaagttaatctatgtagggtagccgatacaattttatcatatcaaatgtaaactctacccgttatctgcattctttgttttccattgctgtctatttgaatccatagaatacaatttcagtggtatagtgtttctctttggttattgcaaaaaaagtttgaacctaaaattccttctagtgcattttttttcactaagatatctgcacaaatttgacgtctatatttaggtgcaacctaatatggatgtttattttacagaccttgaagttatctgctcctcttgcaactggtcttattttagtgtcatgttgccctggtggacaagcatcaaatgttgctacttatatatccaaaggaaatgtcgcactttcagttcttatgacaacgtaagcttcagatttgcttgagaagaaatttctttggtgcttgttctgatctacttgttatacatgtaccttcatctttcttgaggttctttatccctaattagagtgacagcctttataattgatttctgttgtgctcttatcattctgttatcatggtaaattacccgtttttttcttggaagacacattttcatgctagccagtctcaaaaatattgaatacattggtttagattgtttgtatgtgttaccagtttcgcaagttttaaccggcatatttatttgatgccaacacttttgtattgtctgtactcgcatgcgtagaaaatatctgcatatcatggttacacactcaacaagctttctattgagacatcaaatttggacacactatttacgattccaaagatttagttcacagattgcttttagcatgccaattcaatttgacatgcttccagccatgaagcgtttaaagaatgttactaccttgtaccttttctagtaggttttcatggcaggcttcatacataaactctttttttggatgataggaccatgttccaaaactattatagtttgatgtaattattatctgaatgaatgttgacacaattttgtttagtcgtgtaagcaaaacaacctaatatgcatggcttgattggacaaagtatagtttaagggctggaattgagggcatacggtgctattttgcctatgtgctattattctgctattttgttgtgccatttgattttaatacagaaaccacttaggatgtgttcaattgtgctggttcgtaactcattctccccgcacggaaaatgaggtagctcatgattaaggctgcgttcgacaccgatggttcagaacctctctccggcatgaaaaaagggatgactcattagcacataattaattaagtattagctaaaaaaactttaaatttgattaatatgatttttgaaaactattttcctaaagaatttttttctgaaaaacacatcgtttagcaggttaggaagcatgcgcacggagaacgagagagtagaagttgggaaaggtgagtatagaacacaccctaattaagtattagcttaaaaaaaacttgaaaaatggattaatatgattttttaaagcaacttttctatagaatttttttgcgaaatacgcaccgtttagcaattcaggaagcgtgagcgcggaaaaagagggagtagaagttgggaaagtgcagtatagaacacaccctagatactctgttttcttcctgagtgtcatgctcccaattctactctgactaattgtgattatctttacatttcagttgttcgactattggtgctatagtgatgacaccactccttactaaactcctagctggtcaactggttcctgtcgatgctgcagtaagggcaccatgattcatatttaaaaccaactaataatccatttttatttatcaagtgtccatcagtataagaaaattacatctgtccagggattggccatcagtacttttcaggttgttttactgccaactattgtcggaggtactaaagaagcccaatggatacctgttgtgctgtactttgggatcttatctttgacagatttactgactttatttccattattttgcagtcttggcgcatgagtattttcctaagtttactgagcgcattatatccataacaccattgattggggttctcctcaccactttgctttgtgctagtcctgtaagtctgaaaacaactccgtgttctgtttcacttccatacattgctgattgtttaggctctccacaaattttgcaaatttatctgattatgatgtattatcgtctgttctttattttgagtaaattgctgctctcttcattttcattttgaatattgtaaatggctagatgaggctagatgaaacataacttagttacaatgtttacttgaatttactgtttctttccagatcggacaagtctcagaggtgttgaaagctcaaggtggtcaacttataattcccgttgctctgctgcatgttgctgcctttgcacttgggtattggttatcaaaagtttcctcttttggggaatcaacttctaggactatctctattgaatgcgggatgcaggtaaataaatgctgaaatgtcttagatataatctgttattgtccagaacctgcggtttgtacagtctttggttatttaatggttcttatcgttgctatggatgcctcatgccagaaaggcataatcaagtcaacatgcctgtttcatgcagtctattgtgctggtgttgtttagatgtagtttctcatttacttatgcagtaatttcagcactctgcagcattctgttgccacctaattaggctaacatgtttcctctgtttaattatggtgaatattagaaggccccaagataacaggatgaatatgtctagttttacactattgagcttcgagcaatgaaacgaggctgttgacaagcttgaatcttgatgatgttataagtactagtagtttagtagtatgcaaagtaatttttaatagagcgctgtaatttttaatgacatttgtgcttaacaatgtctcttcctgtttccagagttctgcacttggatttttacttgcccaaaagcacttcacgaatccactcgtagctgttccatctgctgtcagtgttgtatgcatggcggtacgtttcatttctattttctcctaatgctacaagcatgcacatcaatagcaaataccatctcatatttatataatgagtgctggagttcgtgaatgtctaatttaaggcgttctattgtaacagcttggagggagtgctcttgcagttttttggaggaacagagggcttccagcaaatgacaaagacgatttcaaggaatgaaacaccaacaccctccagtttctagtcattacctagtgttgttttttagttcagtggagttatcacagcatttttcttgttacccatattttagcaagttgattatcagtaggacttgcctacttggtaggtctgttgtattgcactcttatcttccaaataagctgcaggtgcttctctgcaaagcactcaatttatagtccgttgccaagtgaatgcattgtaatattatgcgcggtgagtaaatagatttccaagaattgctattccaatctattgaaaggtcaataagctttgtatgtattcttgctgaatgcagtttttcctttaagaaaatgggaaaagagtgaagttcaccatcagtccttaaacttgtcatgatgtgtcatctagttcttttaactttgaaaatatatagatctaagttcttattttaaatgtgtcatcccgatccaaagttgccatgtcctctttgttatcttacgtggagccaatgtggctgccacctcccctcctctctcttctttcccactctcccataagtggcccacattttttttcctttttctctttttatcagagtatgcagattagatcagatcagcaagtttagagatctaaaacagcattttcagagtatagggatctggataacagtttagagaactttactatttattatgtgcgtccactaagatttagtaatgcttggccttgttttcggttaataagaagattgaaggaggccttgttcggttaatcaaagaagattgaaggagatttaacaggagtaattccatacttatttaggttgaagttaatccctctcaatcttctctaattgcttcctcctaatgattaaccgaagtcctagaagtatctctatggtagttgcatgtttactttgctcaagatctgataggtcattaggttatcggatcaaatcctagtcgttctttttctttccttcttttattaattatttcctcttttgtacgtcgttttcgaatatatatacgactaaacttagaaatgtttggacactacatattcacaaatactccataaaattattgctatgtgaaagtaacaatatgatagattcatatgaaaaataaggaagattaaaaacattatgattcggtagctttttgcggatttattatgttgggagtgtctaagatttcaggtgcctgaaatttttaataatttcaataacttttctcatcccttgatgacaatctagtggttctcaccattcccttattacttatacttatcagtccctaatggttgaataataaattatagcaaatagaaaagtacaaaattatatgaattaagcctatagctcataaagatatactacaaaattacatgaaaaaaaagctcaaacttagatataaataaagtaaaaccatatactacctccatcccaaaatgtttgacgccgttgactttttaaaaatatttgaccgttcgtcttattcaaaaaatttaagtaattgttaattctttttctatcatttgatttattgttaaatatatttttatgtatacatatagttttacacatatcacaaaagtttttgaataaaacgacggtcaaacatgtttaaaaaagtcaacggtgtcaaacatttagggaaggagggagtatatagtagcaaactgcagttaaagtaaacaaaaaaaaatgcaaattgtgtagcattgcaatttcaggcttcgcaatgcaagtttaggtgactgaaacgtctaaaacctaacaaatctctattatattgttagaagagttgaagatcaaaagtacagaactgagatcattcacaatgtcaaaagagactacaggagttaatatataagagagagatatgttcatttatttaattgagcgtaaaacttgtacattgcgtataaaatcacgggcttcttagaggtaaacagagagcttctctaaaagctcatccaacaatattcgttttgacatctaccttctgtccaatctaccatgcacctatacgttttaacttgtgtcataactcataacatatatatactgatgggcttttagagaggccctcaggttaccttaagaagcccataattttatacacgatcgtagttttatgataaactgtatcaatatttatacgatattatatcaatatttatggttaacgtggaagctataaaatattcaattagtataggcatgaatatttcgtatcaactttttaagaatgatagctagatttatcttcaaattagtttttgaatattataattttactatataattgatgtgtgtcatacacgtattaatgatcaaattagtatcttagttagtgactgtgtcgttataaaatgctactcctacttgcgacaggagacagtactaggagacaattaagcctacagtcacactcctccaatcggagctcgatcgggactccggaggacgcggtacatttcgatttaaaggcagggagaagtcgatgtaaaactacagcgtttatgtaccctgcagcatcggcatagctcctgtgtatcttcctgccgtcctcgtagctgcttagtactgccaaagcacgcatgaattgaatagaactgccacggcgcagcgtcgtcatgcatcttgcacatgatgtcactggcaactgtgcacgacgtacgtgaggtcactggcaactataaaaaattgagtctcgctccggtactggcacgatcgcgtacggagtacactccagtgctcctcggcataacgcgcgatgtcagtcaatgcaatgcaagcacctcatgtcgatcagctccatggccggatcggccggatctccggggatcgaagaacgtacgcccgtcgatcgcacgacggacaactcgagaagcacacgcgacgcgaccgctagcgtctagcgagtgatatttgcatgcatgcaatgcatatatgaacggcgtggcacggcatgcagctagctgtagtagcgtggatgtggcatcttttctctttttcactccggttttgacgacgggagagccacgcctatcatggtgccatcattagcccgcgtccacgcaacgtcaaatcgacacgttgctgatcttgaccctacggaggttgaagcagctagcagagtggcgatatcagattgcgacgtacccgcctctggctcatggaggcatataagagcaagcaggctataagctgtctaaacggatgagagaaaaaaggagagagaggagaagcggactgtagacttacagctggcttggacataagaacctctgtgagagagataagtgggtcctatattaattgtaaagagctaactattatatgggtaggctgagagaatgataaaaagaatcttatagccaacaggtcggctgtattattagccttactctgagcagaaagatatccggagcgtatttcccgttgatctcaacgttgggcggtggctctctatatgatgccttgatcactttgatttgtcaatgcatgtttgcaaatcgcaaccgatcgatactaatgcggctagatcggaccctacactaatcggtcctttagtggcgaacgttaacggtcccaagctccctcagacaacccaaatgtaaactgtaagtgctgtgactgtgagtaaacaaaaaaaaaaaaaggtacacaggcgccctgcaccttgctgcgcgttccatccgttttgccaggctgtgcgtacgcagagagagcgagcagaggggatactacaggtcggtagatgcatacgaatggatggctcgcctttcccgtcacgcgttcctcggcgggaaacgctcgtctcgtcacgcgagcggggagagagagaggatgcgaatgcgatggaatatcccggtaattgtgtggagccgtcgatccatccatccgttctccgttctgcgctcgctcgcgccgcggcctcggcgctcgagagagtatgctgcctgcctgcctgccaactgccgtcgtcacgcgcgtgcatgccatgccatcccgcctgcgaggctgcgaccgacgtgcagcaatgcacggtgcaaaaacgcccccgcccgcccgcctgtcacgtgacctcaccgcggcgccccacgcgacgaagcgcagaacaccggccccaccgagcgcatgcagctagtactacggctttgtgtgcctcgcaatttgcgtgctcgcatgcggccggagtagctgctagccgtatgcccgtatgtagcgtggaccatcgcgcgcgccccgccggcggagatgacctgcggctgacgccacgccttcctcgtctctgcactccacgcacctcgtctctgcgtgtacgtcgtactcctacatctgtccgccccgtcacgtcccaacgaacggtgaatgattgagacgatgatgatatctttttcttctccatttctctatactccgtggagtagctcgcaacaggggagagcagggcacggagattgcgtgcgtaacagcgtaaggaagggtcgtcgctcctttgccgttcttggcaagtactagtactacacttgagtgtggagggtctctcgactcttgagtgaccaatagccttttcaccgaacgattccgcgaatccccccggtgcacggagcctgctggatgacgttatacatacgtgtgtgtacaacacggaatcggattttaactgtggcaacaaatgcgtcgtgagcagtcttatgttgggtgaagaagaaccaaacaaaacacaaacttgcatgcccagcttagagagagtacccctacgtgccattttctcccagcgcgagaggcgcttccataactacagtgccaaagatggactcaccctggacctacgtagagtacctcctttgttgcatgcatgcatgtggtagagactggctcaccccacgattgctcgatcgcaatcactcaatctcaattgccagaagattcgggatcctgtactgtgagcatgcatgcatgatctatcgcaggagcatcaactgcattgcattgtttagtccggtctcttcttgcatcgctcgttgctcaacaaatgcttcactgtggcgcacacagtcgcacactacggtccaagctactagttcaatagctaggctgatccatcttccaactaccccatggtccaagcctaaagcctacaaacaatatactcgatatagggatcaatattaatcgagcctcaaaaaaatttcatatttagggagtgaaagaataaggcgagagagagagagagagagagagagagagagagagagagagagagctagagctagctggtatttgcatgctttgtggcgatcgagagaccattggatatatatatatatatatatataaaatgcttctgaggtggtaccgttccattggatttttcttccatttgcggtaagctggcgtaacacctcttcgatggtctggaccagagtaactactcccacaatactacaccaccctacgtgccaggccagctagcctttatctgctactacgtttttacttatcgggcactgcatcacttgcttggaattttaattgcccctacctcgaaagagaatttttaggttctaaaatgagtactatcccaatcgatgtaaaagttcacatgcacgcagttaccctctttttgacttgtctgacttatttttcacctttttttttcgatttggggtctccaattcacccacttaattttggtactctttgcagtaggattattctaccacctcctggacaattcactaattggaagtaggaatatatgcaaactgttatgtgaaatgaaggtgggacagctaaaacatataaaaacaaaatggacggattgagtttttttgaatgaaaatggagagaaacccataactgtttcgaattgaaaaaccatcactttctaggacacaattagattgaccaaactttcacggaactccaagttagccatctctcttgtggctgttccaatcgtcgcggcaatcctcatttcattttgtataacggtcaacgactcgatcctagccccacccgttagtgctcaaatcgtacaaactgccatggtattgagacataccgttcgcctctcatttggcccttaccagtcagcacccctattgtatggtggccctgtctcccattgtgccacaacccacacggccatatatataccaccgtacgttgaacacgtaccatcgatcgatcagccatttgttgcaactcttatccgacggtttggaaatagaacttggcgatcgaacaacgtaacggagcgcacgagacatataacggcgcggtgttggtggcagacgtacgccgagaagaagcgccgagccgagcgtgatcgatcgatcgatggcagtggccgtggccgggtggtccacgtacgccactccgcgcgattaggacgtacacgccgggggggcccacggcgcagtgggcagagaatcatcaatgattgagagcaaatcgagagacggggcccacgcgcgtactggtgttggtacacatgcatgctgccctagacccagggaacttgttgccaaggcacggcgcatggagctcaactagcgagcgtagcatgcgtgcgtatgtacgtacgtacgtgaccagactcaccagactgtggtggtcacgtacccatctatccatgatcgatcgatcgatcgggcaggcatgcgtgcttcgagttgggagggagtgtgcatgctcacggtcacggctttgtctcttgcgctccggccacattcctacacttgtctgcttatggaagctatggttcctacgttatgtatgcatgcatcctgtaggcatacttttggttaaagggttgggatgagtcaggttagattaaacctatttttttagtgtgcttgtttgagaataggtgagataggatggtctctgacaggaaatattctcctaaaattcgggttagtatggtcccttaaaaatgagtaaatttcataaaactatatatactttgcacgatttatcataaaactacagatttaagaacttatttcacaaaacttcagattcaatgtctttgtttatcacaaaactacatgcactttgcataatatatcataaaactactgatttaagaatttgtttcacaaaactacaaatttaatatcttcatttatcataaaactacaggtttagtgtcttcattatcacaaaactacatgttttagcattgttaaacctgtgataatggagacactaaatatgtagttttgtgataattaaattaatacattaaatgcgtagttctgtgataaacgaatacactaaatctatagtgttgtgaaacaagttcttcaatctgtagttttgtgatagattgtataaaatacatgtagttttgtgataaacagacatactaaatctgtagttttgtaaaacaaactcttaaatctgtagttttgtaacaaattgtgcaaaatacatgtagttttgtgaaatttactcaaaaattggcgaaccaatccaacccactttttttctcactgacacatgagccattacttcaaaagtgggatcatcccatcccttatgccaaactaataatagggatgagtccaatccatcccaccttatccccaaaccaaacacatgctaggagtaattgctgccgcaaataaaaacataggaaaagcaaaggaaaattcaacgaaggaggatcataaggtatatcgtataaactatacctcaataaaaagtttatcgcttttaaactgtggctgataagctagccgtgaaaaataaaatgaatgtagcaactaaaaataatttacggatgcaatttttatatgatattaaccgatgttttctgaaatatatgttagaaaataaaccatgatgaaaacggctcaaaataaactctaaacttaaggggggttttttttctgcaactggtaaatcaacaagcatagaactattagagttataacttcaattcagtaacggcaagacatacacatctatatacttgcaagtgcatcacttatattccgtgtttactgcattgggacacccgatcttccgttaggtgaagaaactattgatttagcggaaacttgacaaacataatttggcttccgatcaaaatgatctaaaccctgcaatcgcagcatcatgtctcctctagttatcaaccgtgtcgaaacctgatggatctcgccgagaaggctaattcctatgcaaatctcgaagaacacaaattagaactagaaagataacaactttattacagatgaatgattaattaagaacacaaagttggggttccacaaatcgatctagcggcgaaactgctatgacagaaataatctaaacaaaacctgaccttaactcaacgacgactattgaatatatatatataggttttagagtcgaccttggacccctgagcgcatccctattggactacaacacgatacatgactcaatgggcccaaagacgatgatgcaatacccgaatagattctggacgtcttcttgttttgtgattcccattgacttgtaaggaactttacatgagactagatccattggaaatgtgatcttgttacctttccataccgttgatgcgaaacacggcggcatgggagatctgcttaactccagtgcaggtccaaggctagccttgtgtgtgtcaagagcgtgccagctgatttgatcctgcaatcagcaagaaagataaaagcagagttagtcagctgatagcgtatcgttagtggtctaagccgatgtagttagaccaaatcgcctatggaccggatagattaaagaataaaagaccctaaacatgtctcgtctgctatagtgttgttgttaacaacggaattttgcatcagattcggagaagaaggtagaagattgaagcgaatttggtgtgaaatcgagttggatttggagtcggactacacatcggctggataccgtatcagctagaaacagagtgcgagttgataaaggttgatgaggcagatggctgatacagccgatatggtatgatttgggctcggtctgggcctagattggaataaccatatttgccaactagagatggagcttgattaaggcaattgtatctattaattggatagttgagtcaattcaactttggcgcatcgccaccctttttgtctttactttccaacgagttcgctttgcaagaggtaacacgtctcgatggcctgtgatattggggctattatgtcgttttagaaattttagtcctcgtatcatgaccattttttttgaccgggaaatagtgggggaagccccacggtacttttcattaatttaaaaggaactgtacaaagatttataaggtgtcaatccatgattgaaaggggctcgtatcatgaccattgttatcatatgtctatgttaatctagtcttagaatatcgatttagttctatcggctgcttctcgctttagattttctgctggtatcggctaaatcgacttgctagattagattaatttagacatctaccatcttgaaaatcagtcaacggcttgattgtctagatattgtgtttcttttcatacttagtgctgcatcaatgcattttcgacctagtaagtcgtgtttagaaccatgatccatagcaagcttcttgatcactaataggggtagtatcggggttttagccgatcttacctaatatacatgtttctttcaggtggcaagcaagccatccatattgtattgagcactttgtgcttgactgcttgaagaaagaactgcattacgcatctaccctatccatcctataaaataacatcctactactagatatatcacatcctagtacaatgaatctgaatatgtctttatccagattcgttctattaagatatgtcgcgtccagttctagatttgttttttttaagatggatggagtagttgttgacggctgttaagtaccaagttaacaccgtcaatacctgcataaaaccacatatataaaacatccaacatagtggtaggatttatttctaacaatttccacgagtgttggtgtatatttgtacgcaggtgacgaaccaccaaagttgagacaaaagatacaaagaggaggtggtgaattaaacttccatattcaagcctatggagttttggacccacaaacctaatgaaacacattcaaatgggccaattgcaagtacatttgggctgaggggttctccaccaaagcccacgagaaaattcggagcaaaacgggccaacaagggtttggccgaaccacttggttcggtcgaacccgtagctgcgccgttcggccccaaacttcacaggccggcaattaccgacttgctatgacggtttctaccgactttacctgaataaccgtcattagctggacacatggcactaggaggatgaagatgctcattggatgcttggaggatctccactctctcaactcacctccacactataaatacccctctcctctccctcattcacacacaccaaagcatgagctgaattacaagaggctctagtgtattttattgtatattagaacagggagagagtaaagtaatggaagtcggaggaattccggagttatcggtaaccctctcttatctcttgtactttgtttattattctgctttaatagaaatatcattctgagtaattaaggtttacttagtgagaattacttcttggttagttcctaattagcatactggatcattgttcactatagtctatttatttatagtgattgctttagtgtttgatcggcactagagtagttattaattgcgtagacgcggtgtctgggtaattaatttccagtggttgctgcgtatcccacagtacgtttgaggtgggtgtagaggtggtgacagccctcaagagtacttaagtcctcactgtccggatacgtagtagagcgacatctgggaacagcgggttggcagtgcctgaagtattgcgttaggattaaacttaagctttccctggacactgcttctcattaggaaatcctctctgccctctgcccaccttagctttgtgtccttagatgaacctgacgaggagataatcacacacgttccttggattcgatacccttggaatactccgtaggggaagtgctacatcggtatatccgtgcacttatggatcttatctgtgatcgtaagaaataccaacagtagttacacttacagtgcttgatccaacggcttgcgagctgccacacacatccatgcggccatgcgcggtaactactccctccgtttcatattataatataagtcgtttgactttttttctaataaaatttctttaagtttaaccaagtttattaaaaaaatataatagtgtttttaacagaaacaaatatatttaatgttaaatttaatgaaacaaatttaatatattttagatgttgctaatttttttttacaaacttgatcaaacttaataaagtttgactagaaaaagtcaaatgacgtactacctctgtcaaaaaaaactatagttttacaccgtttatgtctaacgtttgaccattcgttttatttgaaaattttttatggttagcatttttattgttattaggtaataaaacataaataatattttatgtgtaactatttttgtaaaaaaatatattttttaaataagatggacaatcaaatattggatatggaaacttatatcagtatttaaaatgagacgaagacactgtaatataaaatataaaacggagcgagtagctcgtacgtgcagtgcagtgaatcctcgtcctagctagccatagtaaagtacaagtacgtagcaagatggactcgctgtcacctgcacactcaccaggctgatcaccataaataatatttccagcgagaaccttgactgtggctttcaaggtgatgatcctcagacgtacagtacaggtcgatcacttggagttgagtcgtacccgtccatcgacgtcttcgcagttacaccattaattgctctgtcgcaattggacctctaatccacaccattgaagagtggatctgtgctacatcctgcgcctagagcgcgtcacggcaataaggtgcaagagtagagcaccagtgcacggctcgccgctcgccgctcgctgctgcctgtctctgtgcccatttaattcgatccccctaggctcctctaacctcttcgcgtctctgtgtacacgtcacatttcccctgctgcacagcacgactactcatcttttcaaaacagatacggtttaggaggagctgaaattgtacgatttggactactaaatataaattttggtgtgcaaaaaacaacctagtttcatatatttatatttatgtccctatataaaatcatttgccattcaaatagcaaacccgaatcccaacgaaatttgaaggaagaaggcaaaactcttgcatttttctttttttttacagtaacacaacaggggaggcctccctgttaaagagattttattaaaaaaaattaaaggtcaaaaaaagttacaacgaaagagtccaatctttagcaacatctctatttatttcatttagcctaaacaagagaagaatgaggtctcccttgaggagttgcctccacgaagataatgaaagaggtttatggaaaaaataaatcaattttttttgcttccaaatgttccatgcatctgtaagaaattgctccataaaacatcttcgattataaatggctttggcttccaatatcatgctctgaagagcaatggaggtattccatactatacccaatctgttccagcaatcaacaatcaatttttcgttttgttgcatttttcttcaaattgcaacgaaatgaacaatgaaaaaaaagaattatgtaaaaggaaatcgacacgtaagcactcaaaatttgattgtatatgtatcttccaatagagaagagaaatgtggtaatatggtatggatgcaataattattccaatacatattccacaccctagtgtgcctacacccactttgaaatttgaacttgtgctctttgggaaattataagaaacatggtatacatgtaaagaagcagatactgagtttttattaaagttaaataaaacaaagacaatttttttctagtacattttttatttttagatactttccatgtaaacattttatggcatgcattacatgtagtatatttatttagaatttttttagtgtgcattgcatgagcaaactgagaataagtatagctagctagctagaaccattgttcacaaaaccattcgtaaattaaaacgtgagttacaaatcgctcgttcaatcagtcaatttttttaaaaaaactaatactaaatttgaattttttaatatactttattttaattccagccgttctcactagttctccaatggtttcaacgaaaagaaaaaattaaagctaattaaggagatctggtaaaggcttttagaaatcagaacattggctaaaactttgctacacaatctctgtgttctaatatacaacgcattattgttttccataaagtctacatttgaaaaaatggactaacaattaaataaaaatatgtgtttagtgccatgcaagtagcatttttgtatttgtatttgaaaacattttttatgatgttgattttgtagtagatggtaatatattacgaaagagattaatgatcaaagtataatgttggaacaatatgaaaggtttaatataaaaggtttattataagcctagccacttattagcgactaaaataatttatggtaaaactattatataaatgtttttagcaactacctatgcttaaaaaataaactaaaattcaaaatttaactatgacagatgagaatacaaatcatgtgttgtttggtttgtgcaagcatatcaagggggagaaatcagttatatactacctctgtgacaggaagatcgcagttttgtttatatatatataacgtttgactgtccgttttatttgaaaattttttataattagtatttttattgttattagctaataaaacatgaacaatactttatgtgtactatttttctttatttttttataaattttttagataagatgaatagtcaaatgctaaacacgaaaacccacagctgtattttaaaatgagacggagatgtaatcgatcactcccaatccatatgtaagtgacacaggcatcccaatgcgcatactatatgtggcaaggcattcttggtgctgggctagtggccctctctggattatgttggattttcaatccgctcggcttgcgtgattaagagggcacaagtggtcttccaaatttgcatcccaaagacaaggacctagctcccacctacaaaagcgtatactagtgtggaccaaaaccccttaccacggggcacgggccctcaccaagtttcattcttcgtacgaaactactccatgaattcgcattgcagggctccaaaaaaaacaagcgaaatcctacagcagcagtattgctcgcgctgcacctctactctagtctgccaccggcgaagcgcgccgctcgagccttctctccaaaaacccctataaaaccaccgcttcgcacagtaaaacctccacctagttggcagtaaaaaaagcgccgctacctacacacacaaccgctctgcacaaggggccatggacaacaagccggcgcaagaacgccgcgagacgtgggtcccgggcgccgtcatcgtcggcgcgggcccgtcggggctcgccgcggcggcgtgcctcgcggcgcggggcgttccggcgacggtgcttgagcggtccgactcgctggcgtccacgtggcgccaccgcatgtacgaccgcctcgctctccacctgcccaagcgcttctgcgagctgccgctcctcccgttcccggaggagtacccgacgtacccgtccaaggaccagttcgtggcgtacatggaggcgtacgccgcggcggcgggcgtcgcgccgcgcttcggcgccaccgtcgaggaggccgcgttcgacgcggccgtcggcgcatggagggtgcgtctcgacggcggggaggtgctcatggcgcggtggctcgtcgtcgcgacgggggagaacgccgagccgcgggtgccggactttcccggcatgcagaagttcgccgggtgtgccatgcatacttccgagtacaagtccggcgagcagtttgccggtaagaaggtgttggtcgtgggatgcgggaattctggcatggaagtgagcttggatttgtgccggcatggcgcgaagccctccatggtggtgcgcaacacggtaagaaactagttaaactgagcttatgctttagaacctatctatcatgctctgtttttcccctgttttttttgtctgtatttgatttatctttctgtgtgtcacatcttattgtcattggacatattattgtcatcttaaatccgttttcattgtgcatggctgtattggatcatattcaggaaggagaaattagacctgttaacatcttccattccacacaactttatatgtcgggtgtcttgtcctatcaacagccgtttctttcttccattttgcctccccctgccctccgataattacgcgtgtcattttcattacattattatgatgacgggttacacaaatctaagcgccgtggtgatgtttcgtccaggtgcatgtcctaccaagggaaatgttcggtctatccacgttcggcatcgccatggcgctgctgcgatggctaccggttcagctcgtcgaccggttccttctcacggcggctcacctcatcctcggtaacacggggcagttcggcctaaggcggcccaaaacagggcccatcgagctcaagaacctcaccggcaggacacccgtactggacgttgggacgctagaccacatcaaatccggcaaaattaaggttagtgccaaccattcagctagcctagctcctttcaagaaccagtagtagaaactgagaccagtcaaactgtcgagctgtacatgtgagctgctgggcgtctacttcctaatgtggcacatcagctattcgcacatgcagcatgtacatttctcttgtggaaaatggttctcatatggagattcatttattttatccctgtgggttttctcctgtgctttgattgatgaggcgctgatgggaatcatgcatcactaggtagtgggagcagtgaaggagatgacgaggcaaggggtcaggttcacggatggcaaggaggagcaattcgacacaataatcctcgccacaggctacaggagcaacgtgccatcttggctcaaggtaaagcagagtgtgactcactcttgttcgttttatttttctttctgtccgcactgcactatactactactagtgatatatatctcgagatgatacggattatatggtcaactgtcaagcccaaggatgttaattatatgtctatatgtacgtgtgctttatgtgttgtaggatgccggtgacttgttcacgagggagggcatttccaaggtccccttccctaacagctggagagggcggaatggtctctacaccgtcggattcactcagcgggggctcctcggcacgtcatcggacgccctcaacgtcgccaaagacatacattgccaatggagagaaagggaccgatctgctattaatgtacttgaaataagcaactcttccttttgatttgactggaaatgtacagtgttttgattaggaatattgtattgtgtgcatataacaccatgttctatctcccttttcaacaaagactgataatcttgctctgccttatgtcgattacttgcctattgagcatcttttgggcaaactgttattatgacaagaatttagaatttatatcaatactcctttaaatgggcgtaatggtagccaccaacttcctattttctttgaaaagaaaaaaaaatacagtgtgaaaaaggaaaaataatgattaagtgggttactaataattttcttgaattaaaaccctgtcgcaatacacggaaagacaacatgctagttagcatactgttgttaacgccgaatatacttttgtgcatatatggtcagcgggtgaaaagcatcacatatttgtgctgatctgataaaaacccatttagacaaatatggttctgatccaacccatcttgctcaccgaggttcggcgttgggccgcaagcccacaatccaggagatctacaactttataattaatatattttttcatttcagatcgtttaataatccaaatattccttacaaaatctctaatctacgttacaaacgacttccaatatagacaaacttatacaaatgttgtagatcttgacgagatctacaactttgttgtttaccagcttttatttaggctgtgttcggaatcggacgttcccagcgtgcacagtaagtaccgaaaacttagcggtctattagcgcatgattaattaagaattagctattttgtttaaaaaatggattaatataattttttaagcaactttcgtatagaaactttttgcaaaaagtatacattttaatagtttgaaaagcgtgcgcgcggaatacgatggagaggggctgggaaccttcagttccaaacacagccttaaaattgtttagagtatcaaataagcattattagtttttttagcaattaaaaccgacaagaagatctaaatgcaaaaaaaaaaaaaacatgtagaacccttctcactaggggtggcagcagggccgggttggacagaaacgctcccccctcctcacattcctccccaccccgcattgcaaaccgggtaacccaatgcacccgagcccctgtgaggacccagcgggagagcagccctcgcatttggcgacgttgacggcttgggggctacagcgaggagtcgaacgttagaggcaccgatgacagctgagggcggcgagccgacgatgaaagctctaggaggcgatgacggatagaagcaggtgaactttagcgcgtcgccatctagttggggatgcagcaactggcgagactaaggggacaaggcaaggttggcatggatgaagacaatggagtcgggacagagtcacgagatcggagaagactgcaattcgcacggtgacacggagcagagatgtgtgacgatgtgcggcggctgtggaatagggaacaaaactcagggttttttttttccaatatatccaaactctttctctattgggcctgttgtgccaatatgttataggtgggttgtgggcttaaattctcagaattggctacttttagaagagtaattcacagccttgagccctgtcaggtcttccgttggtaacttagcatccctgcctttttcttttctccgttcttttatttttcggggccccacccccctgcccccaccccataagagtggtcccatcgcgtcctcagccctaacgagaaaattaccatccctacttctcgcactctagaagggtcaatttttttttaaaaaaacacccttccgaagggcgcaaggggaatacatatgtaaatttataaaagagaaaattatttgttaaatattttagctaaagagtaaaaagaattcttcaagctcaaccgcattaaccagccgaaagaactgaccgctgaatggcgactaacacaaatcatgagcattgtcttgatcatgcaattttgtacgcaaaatattagttagtagaaaaaacaaaaaaaagaagttgtcgtgcggtcgtggccgctcacgcactggtatgtggcaacatgtattttggtgccacaactctggaacaatacataaagaaaaaaaacctgtaccaattaatggaacattggcgatgattctaactaagaaaacgtgagggctaaccacaatcgtatttagctttattttttaaaaatatgtaagtaggatggtgcaaattaattaccttttgcattcaaacaatgcgaatttgcactaagaccttaaagtttgatggactagtatactctcgcaaggttttccccagattagcggcgaaaacggggcgagtatttcccgatcacccgctcgaccagaaaattatgggaagaatatatgggagagaaaatgggatacccgatattttcaggtttaaacctgaatccgtaaaaaatatgggttaggatacgagaaaagtttgatccgcctgtatgttctatattataaaacatatgtgaaaatctattataaattcacctataaacatgataaaagattagttaatcactatttttatgatcttacgtgtaatattatatactttgttccttgatgtatctttttttaacactttaattgcattcttatagtaaatatctattgaattagatatacaaataaatatccgttcccgaatcagatttgaagaaaaaattaatatgggatataatacaggatgagtgatatattattcaacattacctgtacccggttccgaaattaaaggaagatatgggaatgctatgatctgctcgtaccaggcccgttttcacccctaccccagatgaaatgttctacttttttaagtttttttatccgtactccataaaagacaatgcatcatttgcaatggtgactatgtagatatatagacttgataatcttaaaaaaagtaaatttcataaaaccctacctacataatggattttggcggttataagacagcgctacttcggatagataatggatatatagacttgatatctatccattatctattcaggttgcacacaatcacatatatttttgctatgtggcacataacctcagatattagggtatgtttcacaaaaccaaactattgatctttttaacttttatctaccatatttttaagttttacaatcacatcttaaaatttatgggcattgtatccatcatataaatcctacacccactttttaaaaattttgatataagagtacgtcaaaagtgttaacggtttggtttttatgaaactttagtatcataatacccaaagttacgtgacacgtgattggatcataataggtggggttttattaaatttactcaaaaaattatttgcaatggtaacaataccagtaatagaattaatctaaatcatcataaacatatattgtcaatacatttttctatagagaagtatttgaattttgacatattgtaaactatacagagaaattaggagcagatctagcatggaggcggcggggtctcgagcccctactactatcacaagtatcatgggagtttccatggatccccactaaaactttttgttatatagatggaaagggggaggtagttttatttagttttatttggtttcctacagatagcacatacggtactgcctggcagtggtaaaaaaggtccggctaatggacaaagtctcgtaactcccgcgaggaaaaaacacaaaatcgtttgcatggattgccgaacttccccgaccttgcagcacacgagtggaagcacgcccgggagacatcctccggacgtgctggcttcatctcaaccgccaactccagttccccgacgtgcatgtcgacagccatggcttcacgcagccgctgaggcagggacacgccttctcgcgacatggcgacgttcaggtcgaccgctgacaacttgtccacgcagaaggccggcacctcaccccatcggccgaccacgacgcggttgtagtacagcgctacgtcggcggcctgcagaatcgccgtacgtccttgcggttgtccacgtggacggtgagttggaggccggcgaggagatggtcgtcgggccgcgcagcgggtcgagcccctcgacgccagtgagctgaacggtgaaacggggaggaaataagttcatctgaggtccctaaacttatccacgaattcgattttcatccttcaaaaaaaaaaacagatacaacgggtccctcaactatgaaaatcgatactaagtccctcggcggtttggacggcggttttcactgacgtggtgcctacgtggctaatttgactcaatcttcatctgacgtggcatttcgatccgaaaaaatattaaaccctgtgggacctacatgttagtttcacacaattaattaaaaaatagaggccccacataggccccgcatgtcattcttacccctacctcctctttctcctccatccccatctcccctctccggccacggtcacagcggtgcaggggacaacgacctcaagaaggcagacaaggccggtcttgactcttgacgcccttcccatgtcctccgccactcacctcggcggtacgctcggccggtggagagaagaagcgcagtggaggtggcccaagcggtgagagtggagatcggagggagttgggggcgccgccggcagattgctaccgctctgccccaccggcttcgcgcgccgccaccgccccactccaccccgtcgctctgccgggctccccgacggctgcgcccgctgcgcaccagaagacgacgatgacgaggctggcgccctccgcttggctccacagccccgctggctttggacgccgcccaaaacaatggcgttaatcatgttaggattccacattcagagagtgagctggagcacaacattgatttttgtgcagagatcgatggatcgattgattctgtcgccaacgactccaccaattctgtccagggtaagagcaggtacaatagcatattattaaccagctataaatatattttaatgagatgatgagctgcagaccaatctgtttattgacaaccacaaaactaaaggagttgttttgcagataatgaacttgaaaaccatttggatcaccacccaaacaagcacaaagtgctaaagccaccgaatcaacattcaaacgaaacttgaggtgggaaaaacataccaccaacttaaaagaagacgatctagcgaaccttggaatgaaatgcacaggggaagagaatcgaggcctgatttcttttgcaaactccaaacctggagagaaatcccagccatcgacaaaagagagatccgccatgaagaatcatgcgaagctcagaatcgccctcccgatcgccagtccgaacattccggatcgcatacccgtaaattttagtttggatttcttccttatcctttccgctagttgaccgttaaattcttatgaaaaagccaattttaccatttcctataaagaaacataataaattaatggagtatattgtcggagcgtagaaatttgttagctgggctattatatttatgtgttagctatcaccgtattatttgcaataaatatgcttttagatataacataaaaattaatacttatttattaattagttattaaaggttgtttatgaagcatataaatatatttgtcttataaaaaaaatctgttgtattactatcaaaacacatggtgcataaaaaacttttattaaataataaataagtattaattttttatatcatatctaaaagtatatttgtcacaaataatatggtgcataacgaactcataaatataatagtcccacccaataaatttctacactctaacaatgtagtccattaatttattatgtttcttcatagcaaagggcaaaatagactttttcataagaatttaacggtcaactagcggaaagggtatgaaagagatccaaactaaaattcatgggtatgtgagggaatgagcaaagtttaagggtgtagacaactgttaagtaccaaattaacaccgtcaataccagcataaaaccataaaagtaaaacatccaatgtagtggtagggtttatttctaaccatttccacgagtgttggtgtatatttggatgcaggtgacgagccaccaaagttgagacaaaagatacatgatgaggtgaattaaactcccatattcaagcgtaatgaaacacattcaaatgggccaattgcaagtacatttgggctgaggggttctccaccagagcccacgagaaaattcggagcaaaataggccagcaagggtttggcgaacccgtagttgtgccattcgaccccatacttcacaggtcggcaattaccgacttgctatgacggtttctaccgactttacctgaacaaccgtcatcagctggacacatagcaagatgagagtgaagatgccatttagatgcttagcatctccacaatcccaaggcatctctccacctataaatacccatctctccctcattcacaacacacaccaagatgtagagctgaattacaagaggctctaagtatactttaggttctttatatgttctatagtatacttaaaatagggagagagtaaagtaaaagaagttggaggaatcccggagttgtcggtagtcctctcattattcttgtactttgttaattaccctggttcaaattaagatttgtttagtgagaattaattcttggttgtccacccggacgttgtcaagtcgagttgcgcattgagaatattggtgccgctcaatacttttgctaaaacctgcatatagtatgtttagaacaaaaatccactctaacccaacacctgaaacattggtatgcttcaagaccataaaatttttatgtaaaatgatactatatatgatctgatagtctccaacacaacacaccgtgtatgtatcactagttatagtgacaagtgagtaactgacaactactccatgcgattgcaagaccaaatgaggtgcaaaccgtgtatgtatctactggaaggtcagagcatctatagtagtaatacctgaggaatgttaaaggggcagattgcaatcaaccacacatagggggaggaggtgatcgatcctctttgtagctctcggggacaaagcacgacactggcataacatcgaacgggtcgcgagtgaggaggtgatcgacccaccaggactccactgtcatgagaccacgctgtggctgtcccatgggcgacctgggaggggtagtcgatatcctgctcagcacacccccctcttcgacgagaaacagagtagcgtgccgcgtcgctgccgatgatggggttgaactcggggaccaggtatctgccgccgccgggggcgatggccaagctgaggttatctgtgtgggcgatggtcatctcggggggccaggaggcggagagcgctcgcagaaatggaaaggtggagcgtgggaaccatgtgaagtagcccttaagtagggattccacagaacgagcccgcgccccaacttgtcgatgatgagcgggcctgtgtggcggtgctgcgaggtgaagaagaggagacagggggatgtcggcggcgaggacggaggggaagttgtgtattgtggtcggggttggcgcattgtggggccacgacgaagatggcgacccatggcggcgtggagggtgtgagggagagctctgcactgccgagctcggcgtcggtttgtagcggcgagcatggcccacggcgctcccggcgaggatcccattggaggcgtgtggggttttggtggaagaaagtggagaggccagggtttgatgtctgtactattttgaaatcaagatgcgcaggcgtagcggagcaggcagagttaggcaaggcccccgcaaccgcaactccgcaagcctcaattttgcccatttcggccctttgcataaatttattttatgaattattccttcgaaaaacttttcttgttcggtttagaggggactgaaaagaattggagagtattgaggggaaataattccacatctaaaataaatctccttcaatccgtccctcacagggattaatcgaacatgtaaaccctcacagggattaatcgaacacgcccttacatgggaggaaatttgtgtagaactagtgggattcattacaaatgaaaaaactcatataaaagcccgttaagtgcagaaattggtttgaaggaattttgaatgatagaaaatattccttcatatctcggaggaattctaacatgtggtctcatctcatgtttacacatatctttgagaactctaaaataatatataaatcttactccctccatttcataatataagacacaactattttttttatattccataatactccctccatccacaagaattagatatatttcacatttgagtttttccaaataagttgtttctatttatagtctttatacatccaagacttagggtgtgttcgggagtgagggttaggaacccaagttgcctagcacgcaaaacgaagcagcatttagtgcatgattgattaagtattagctaaaataaatttgaaaaatcgattgatatgattttctaaagtaactttcatatagtttttttcgaaaaaaatgtaatgtttaacagattaaaaaacgtgcgcacggaaaacgatgaaggtgagttgggaaagtagagagaagaactcagccttaaattgagaggtaaattatatgtttgattaaaacccaacaagccatgtaaatattcattggttccatgtttgtattcattctttgatctttattacatgcaagatgagttaatttctcattgatcttggtgacaaaagtaataggtgtaactttttttgaaaggaatgagtataaggcatgcatgcatgcatgcatacaattaactaagacctcttctccattaaattattactcatttttttaaaatcatctaccctcgagatctctaattctatttaatgcatgcattacatttattaggatgatccaaactatgagatgataagaattgtttcttggtctctaggttagagcaatttgaatagtatagccaactacaggctccaaatcatctatagttattttaatagccatggagtaattcatacccggtatgttgacctacaagtagtgaaactactaggtaggtccgtcggtttggcacgcaaactaagaccaaagcaatttatgtgtacttaatgcaactttgcaagcaaaacaatcaagatttaaattataagagcaatatggtcaaggcctcaagggtgacttttcttgctcaaggtgttcacgacacttctcgaaatctgcactcgaacataattccgataaagtagtgaaaatattcaaaatcatacacaaagaccaataagaagaccttatttaggactaataatagtgccaatagatagatcacgattaggggtgaaaatggtcggaaacgatcggaatcagtagcatctcttcagaaatgatgctcgatcggccggtaattgatcatatttatcatttaaactactcattatcgatattaatacgatgaaaaaagaattgtgaaaaaaaaaaatttaaaaatagccaaaaaaggttacggtcggaaacggtactcatatacggaaacggcgctcggtcgataaggaatttccgccaccattttcacccctaatcacgattttagaggattactggaagtggaatgaagtcaatcggagctacgtatatgaatttctagagattaatttattttgaggaacaacagaaatgatttttggatttggaaaataaatattccaaaggaatattcatttcgggctgacaggtgggacctgatgtgagagggattgaggcttatgcctctagggttcctgtagacttttgacttacattgaccaaaggatgtaggaatcgataccgttaacttttgacatacattaaccattcgtcttcttaaaatatagaaaacaatataaaccatgctcaaagtatctttaataataaaataaatcatacaaaaataaattataattacataaatctattatatactaaaagtcatttaagcttcctacaaatactcttaggatgcgctctaaaaaattagagaaaatccaagcaattctgagaaaaaaaaagcaaaacatcttgcctttaattttaatttaatacagtggacccattttttaaaccattggattacatctattaaaaataaaccacctaatctctcgtctgtacatacaacagaaaaaatatgtaattattcaacagagagaaaaatctcttgtgttatgtacatacgaaaaaagaatcaccgaagaaaaactacgtacgtatgattgggaaaaaaaacacgattaatccttcacccctaatcctcacattaaatatattttgattaaaaacatgtcacatagaactaaagtctatccttttttcatttcattctcatcctaatagtgttacaatattagtgtccaaatgaattaaaaataatagattattccataatatattaacccatgcatgaaccatcaacaggtaaattagatctataatacagaggaaaaaatatcaacacccatattaacccatatgtttttgaaggattattggtcgaacaaatattgttttcacgtgattctcgccaccgaatctattagattttttaaggcagattgtaattaatgtggacaatgtgatcaaatgaagtgtcaaatttttcttaaaaaccatatcaactactatgttttgatttaaaaataatgacatgtaggatcacattctagccttttacatgttgtccaaataattataaaaagaacatagattataacatatattactaataagttataagtgctcaaagttggaaccttaatagtactctaagctgagattaaactttttaattttggctataaatgactttaaaatagagttaatttaatccatgatattgcaaacatgttatttcagataaatgctattacaatttgtctatttgtagttgtgccattgaaattttacaaaattagaaccgtgccactgtcgtcacgtttgtacgatcaaacacaagtaaccaagtctaccagagggggtgaatggtagataccgtagattacgtcagcggaagtcaaataatcgaatcttgacagatcaaaacacaccccaacctcaaaagccaatgaaacacatgtaatccagtctatccgacctactagagtcagtctgaccgagcctggctggtctgaccgcaggtcactcggcggtctgaccgtcagccctaaaaacagcacgacagcgtttctgtaaaaacacgatttctcttaaaccaaccgttggatcgagttgcaaacttgatagaataaactagacaaactaaggaaaaactccactggagggatttgaaaaataataaacggtttaagagaaaacaccctcgaaagtcagttgtctcagagtttcagcaaatctgaaccctaaaactgaagcaaattcaaatctaacaataagccaagtttgtgaaattagatagggtttcgtgagaaacttgtaaggggtgcattgttaaatatatgatccgaattttgggcccacaatatatttggataagttttctaatagaacttgactattatgattagtttcctagtttgactcataagtctttccccactaggactgttagatttatactatatatattccttgtaagccacacggggagggtgcgatagcccaatgtatcccatgcgtatgtatccaactcctcaatagtgatcattgccggtcaacgcccatggtttttcccgcaagggttttccatgtaaaatttgtgtttcggtttcgggttgttttattgtatatctgtggatagttcatgtttatggcttctagatggatactatgcgtatgtaatactgtagttttctaataatgagtcacgttggagatagtttggaatcggaatatggtttctttgtttgattcatgtgtaggtgtctaaatgcctcgggagagtattgccggtgatgaatcgggagtcaacttggagataaggtgacgtccggatggtcagatatcatgcgggattcttaggctaaagatcaatgcacgtgattggtgaatattccatatggcatatgatggagatattgtgtgcgtatgggatgtggagtcgaatttggaaggagtccaaatttggtataattggagtttgtaaagttggtttcttgtactggaaggtttcctaggtggattaggacttcttgtatgagtttggttcgtggctttaggcagcctacctcatgtataaatagagagggagggtgtggattcccggtatcactttagagagcattgagttgagagattaattagggtttcgagtttggtcgagatttttgtgaggtgtgctgctgttgcactttgtaaacatagagagaagtaataaagttgtcatctactttgagatatcttcaatttgtgtttgcacgggttcggcggtccaaccggcgggataccggcggtcaggccggcggcattgcagcggtcagaccagcggcgacaacaggcatcggcgacaagttttggcggttagaccgggagatcaataccggtcagaccggcggctatggttcggtcagactggttaatctactccggttagaccgcaattcatcgattcaagggtaacttttatttccgctaaaagttttggtttttgggtacaccaaccattcacccgtctctggttggcttagttcctgctgttcggtcatgcaacgttctccatccattttctcatttgcacgggggcccacttatcagattcctcttcttccttccccatctcagcgtcatggcgaggagagagctcctagaagtagttctgtgcgttgttgtggtggaacccctggtcctgttgccccaagagggaaagcgagagctagagcgaggtgagcgggtcatcgtcgacgtccccggcactaatggcatagaagccgcgagggcgtggaacacctgcgcacttccgcaccccatggataaaaggcagtctcggttctggttggtttttttaataggtgacgattttttaaaagaatcggcactatatctatattataggtgtcaattctttttacaaaccggcatctacagtattggtatcggttttttatctagaaccgacacctataatgtaagcaagcataggtgccgattattttaaaaaaccgacgtctatagtattagtaccggtttttttaaaaaccgacacctatattgtttaaaagtgtcggttctgtattttttcattgaggcagaagtgggagaaggtttaaaaccagcacatgtgagccgacaccaatgaaggtttttgttagctgaacggaaggcccatgcacaaatatccaatacggcatgagttgtggatatacacgttgcctagcaccatgccaatcggacggcataaaaatttgattgaatcagccataaaatctgtcgactgatttttagcaacaccatacttttatactcttcttgcgtgtttatatattttcttaaataaatgagcggtgaaaagtttaggatataatacgaaattatttgaagacagagtgagtactaattacagcaacccgtgcagtggtacatcatgtgaaaaaaatagaaatgctagatgttgtatacagatcgctcggtctcggtgactcaagagaatttagaaccaagagaccagcctttgtcaccctatggatctggcatgcggaatggacaccagagccatctgtaggtggttttgtaaggaagaacgtcgtcattcataaacaagtcggcgacgagtcgcatgtcgatctgcacctctagctctgccaaggattcgccacttgccatatgttcgtgcacgtcctgtgccagcccaaccagctcgcttgacgtggctcctgttactgtgtcacgagtcatcttcttcaagcagaagctgccggggatggaaccccggccaagcggggtccctgcatgccagacggagaactgccactctgaggtatacgcgtaagtttatatacgcatatgcaaactttgtatacgtgtattttttggattttatatatatgtaatactaattttttattcacgtatacaaagtttgtataaagttgtttatatacgtgcattttttggatttttatacgtacatataccaattattttttatacgcgtatacaaagtttgtatacacgtatttttttagatgtttatacatacacacaaactttatatacatgtgtatatatttttttacattaaaatagggtaagacttattctatacccccagtccactcctccccgtccctccctctcgctccccctccctcttctctcgctccccctccctcctctgatctctctctcttttttttattttttttctgttttttttggctcgctgaaacattttttccctcttttctagaaaaataaaaaataaactgccaaatttaagacttgaacccatgacctcatagttcaaagcacattcgtctaaccaattcatctaatgatgctatttatttcaaaaattttgtgagaaagtaatatgattatcaattcctatatatttcactattgaaactcatagcatgttactatgctccaataataacattgttgtaaaagtacagtaacacgtgatgttactgtataacacataggacattattgcacttatggcagtaatatcatagtgaaattgtagtagaccaggaatcgaaacaaaaatatatgggttaaagcctcacatgctaaccatatatttgttactgcacaaaagtagaagtgttagtacataataggtacatgttaccactttcaagtagctgtgttactgcacgataattgtagttttactatgtcatttttacaagatgaagatcgaataggtgggctataggtaaagtctgtaggtggctttgagcgaggtatgattgatgtaagagtgttttgaacaattttatacatttggtaaaactatgttactgcatgtatatacacatgttactacaaattacatactatgttactgcatatggagtgttaaagttcaaaatgccaatatttgaaaagcaatatctcacaagttatgtattattttttaaaaccgttttcacaatgatgctatagtgttactgcatgtggaggtttaaacttcaaaatgcatctacgtactcccctcctcaagaaaccgttcttcctccctcttttcaagaaaaccgatctcctccctccaatatagtgttactgcatgtatatgacgttactgcacttttgacaataatattatggtgaattacagtaaatcaggattgaaacaaaaatatataggttaaaagtctttgatgctaaccatatacttattaatgtacaaaagtaaaagtgttactgcacggaaggtacacgttaccacgtgtttatgcagtaacactacccaaaaatacagtaaaacgcattgtattaacatcgtgatatgattgtagtacatacaacagacaagtagtaacataatagtatacatacaacagacaagtagtaacataatagtatagtattaccgcttatggagagacaaattgcaaaaaagtcaagctttgaagaacaatatctcccaagtgatgtaaggttttttaaaaccgtttgcactatgatgctagaataaaagagcttatcaaaagtagatccgtcatgactatatttcaactatactttaacgctgttactacacgtaagacacaatattactacacagtggtcgtcgtattactgcactgtcttgggacgagagctgagaagaggtgggtggtggggggagttagtaggcgggtttgaccggtgggaggggcctttgaccaaggtgggaggtgggttttgggccttggtaaggagggggaagtgggtgtgacccttgggagggaggggggtatagaataggttatatatatatatatatatatatatatagacacacactagcaatgatgcccgtgcgttgcaacgggtaaaggtaattttaatcatgtatactggttgaaaaaaatataaaggaatcataatcataataataatactaatgaaataaaattgcagtgacctttggtcaaaaagataaaaatatataattaattttccattaattccattggctaaaaataatataatacgaagtagaaaaagttattctcaaattttagcaattttcaaaaagcttaaatagagcaaactaattatataaatgaaaacaaatttaatcacctaaataaaacaattagacctgtaaatgaaaatctgttgccagttcagttaaacatgagcctgcgggtgtgtgtggggtatatatctctcactcgtatgtcgtggtcttttttttgacatagaaaaaatgcccgtgcattgcgacgggtaattaaaattataacaaatataaaaatattatatgattaaggtttagttttacatgatatgagcactttaagaaaatatatttataatgaaataaaaaagttcagctgaagtgacctaacgtgaacttgttacatacggagcgtacacgtggtccatgaggtggcccaataatgtgggcatcctgggattagaatcggggaggaacaacttaagcgacctaaagtgaacgtattccgtgtgggcggcctgggaatggcgttcggcctaacgcgggagaagccagagccgtccgatctgatagacgatcatctcgacctatataaaagttcaacagcccaaaccctaaccctaaaatcatttcccctccctccccccctctctcaaaacaatgtggcggtggcccgacataccgacatccctacgacggcggtggcggttcagcagcgacggcgacaccctcctcttccagcgtcggtgtttcttagtgttcttgaatctgatcttgtattcttgttgtagtgttctgtttagaatttaggtccaaatttgatgtggtctctcatttttttcttttttttttcttttttgccatcggagagggattaaagcgggatcgatcacacgtgcgatggaattttttttatggacgaaaactataacccataagccatataatttttttaattaggtatatatagatattgaatcggactttccttttttttcattttttcgcccttttttcgttactacggatgtcagaaacatctttaatttgttttaccgtgtcacatatatcgattttttttgcccggtttctttttcacgtttttttcacggatagacgacggaaacacttttttatttttaagttgtacatatagagatagagatagagaaagagaaacggaaaacttttttcgcaacttttttttttggaatcggacagaaaaaaaattttacgcttgttttttaccgcgtcgatggagtcggattcgatttgtttttttaccacaccgtgtcacatataataggattcggttttctttggaatcggacagataccttttttctttttggcccttttctttaccgcgtcgatagagtcggattcgttttgatttttttcctttattttttttgccttttttaccctgtagaccgagtcagattcgtttctttttttttcttttttttgcctcaacttttttggatcggacttattatttttttttcttttttcccggtttttttcccttcttttgccttttttatcggagtttttttttcacacggttttttttcgccagcggatttttttcatttgtttcgtcctttttttatcggacatagtttttttttcgtccggttttttcgcccggttttttctcccacggttttttaacgaacgatggaagcacctcttttttctaaaagtagtatatatatatatatatatatatatatatatatatatatataactatacgtatacgtatatatgtatatgcatgtgccgtagagaagagagactaataaaggaaaagtggccgcgcgcggcgcggggggcgcgactggtcgctaaccagcgccccccccccccaccctctcatcccttcctcctccccttattctatttcctactacactataaatttaaaaaagataaaaaaaacaaagttgaaaaaaattatatatagaaatactatatataaaaaatatttgaattcaaattcaaatttgaaacgggtatgtaaacttttgaattatagattttaggtctatacactaatatttgaatttgaatcgggtatgtaaacttttgacttataaactttgggtctataaactttaggtgtataaactttagatgtatagaaatactaaatataaaaaatatttgaattcaaattcaaatttgaatcggatatgacggagctcgtggctcctcaccgggagaccgcacaggcccccctttgccagttcgtccgggggcttagggtgaaatcccaagctctcgctgtatgtagaaagatcgcgagccaggaagaaacgcgagacacgggcaatgtatacaggttcgggccgctgggaagcgtaataccctactcctgtgtttttgtggatctgtgtatggacaagttacaaagtgtcatccagccctcagtcccctccctaggtgggcaaggtcctccttttatatctcaaggggataccacatgcacctttccctttccaaaccggactgttcttctcttcataaatggacggagatcggtacgattgctgtccgagtgcccttctgacgagacggcccatacctacccccacttccgccggaaacaggtgcgacgtgggattatggctgtctgtggatgacgcgaccagtgtcagaccggtcacagatcagtcatccttgtctaccacgcgtcagcttagcaacgtgcatgtttgcccttcttcatgtaacatcttgcatgtaatggttgggatgaagcctggtataaatctaaccagggctaacgtgccatctctaagagataacccgctagctccggcttgagacaagtgcctagaggctttcgtcttgacgggatggggcaaggcgtgcgtcagaccgccagtcgccacctaacccgtgatctgaccggtctgtgaccagtcacagaccggataaaagaacgcgctgcactgcgctgcatgcagtgtgacacgcttgaccagaccacaataaatgcgggtaggtgagcactggcgtgttcacctatcccatatatgtggcgcaaactccctcaaggggtcggggtgcctcggccctcggggccggggcaggagcaacccgaccccccttcggggggaaatcaggagaagggcggacacctcaccctcggggccgacgtcccggagggtgccaggccacgtgggcgattgtgtctgcctcaagcctctggtcacgatacccccggtcccatatcaccgacagtagcccccggcgttatgccagggcgatcgcccttctcaagggaagcggtcgggcgtaatgccactcctaaagcctggtgacaggtgggaccggtttccatggttgcgcagaaacccaacggtctcaaaccatgcacatatggtaacttggctgtccataatgggcggtctcttcaagactgccacatcacttaagcagcgcacgaatctgggtgagctgatttgcttcgcctggagatatggtaacgtcgcttcggccggcgagcgtaattaacgcgcgcacgatacgatctatctcgactgccacaaccgcatatccacctcatgcgccgcaagcgggcgaatgggattagtggaagcgagggcacgagaaacgagggagcgagatagtgagaaacgagggagcgagatagtgggcgcgagaaacgaggagccgggcccagcgatggcaagggtataaaaacaccgaggaaaagttttgctcccttcctttcgccattatccctcttgccttcgccgcttgagccctccctctttctctgctgcgccctaccttcgccacacgcgctcgctttcaatcacctcttcctccggcgccatggcacggggctccgctctgctcgatggtagcgttctaccgccttcccgcatcgtgagcgagaggcacgccgggctgccgcgccgcttcatgccggaatccgccaccggtcgggagatagtgatgctgggcgggggacgcccggcaccagactacccggggcggtccgtcttcttcctccccttcgcaatggcggggctggttccgccattttcttgcttctttatggacgttctggagttctacgatctccagatggcgcacctcacccccaatgcggtgatgacattggccatcttcgcgcacctgtgcgagatgttcattggggtgcgcccatctcttcggctgttccggtggttcttcaccgtgcagtcggtgtcgccaccgtcggtggttggtggttgctacttccagccgcgggggccggtgctgaaccgctacatcccctgcgccctccgcaagaagtgggacgactggaagagcgactggttctacacccccctcgccaacgaagcgcgcctccgacttccaagccagcccccggcgcaggtctccagctggcgggcgccggtagatctgggggatgactatgacgccgtcctcgaccgcctggcgggcctgcgctcccaggggctcacaggggccatggtgtacggcgactacctccgtcgccggattgcgccgctccagcggcgcgcccggagcgcttgggagtacactgggtccgaagactacatgcggacccaccagggagccagatgggattgggctcccgaggacttcaagatcgtggtccaaagggtgctgaatctcagctccgtggaggcgtctcttattcctcgaggaatcctccccctctgcagcgatcccgaccgcgcctctattctgaccattatgataggggtcggggcctcagaggaggaaactcctaagggccacgacggcgcgggcgagagccgccggggggatcaatctaccccaggagggggtcgtgcttctgggcctcgcgtcgggggctcggggagcagccgccctgccgacgcccaggggaagaggaagctgggaggaacacctcccccatctcctccccgagggggcggggcggcgcgtgccagcaatctgcgcccggagggggccgcgccgtcatcgcaacccgagggggagcgcaagaagaagcggctccgcaagatgggggagacggaaccatcccggggaaacctgatttcccctccaaggtggtcatttaaccgaccccctcgcaggttcgtcccactctccttgcgaccgtctttctcctatcccaaaagcaaattttctcttacccatcttgttcgtcttctggttttttcttctgcttcagcgatgtcccgtcgcgttcctcccgccaccccaagtccggccagtccgaggccgaagatccggcggccgcagaggaacggaggcgagaaaatgaccggcgagaggccgcagatcgccttcgggaagctgaagaggccgcccgggaggccgctcgggttcgtcaagcggaggaaaccgctcgggaggaggccgcccgggctcgccaggctgaggcgatggcgtcttccgaggcagctcacgacaaagctgctggcgtgtcgcttgggcccactccctcgggcgacgctcaagcgacggcctccggggcggctcgtgacgaggccgcgggcgcatcgcctgggcccacttctccgggcgacgcccaggaccaaacgggtccgggggacatccccgagcccagcgcatcctccggcgggccgagccgcgtcgcgttctctccaaggcggctcttctcctcgtcttctgtcgccccgctgagcgccgagccccttctgcaggccttggccgccgcaaacactgcggtgctagatgggttcagcgcccaagtggaggccctgcgagcggaacgagcggagctcgaggccgcatgggcgcgtgtcgaggagggacggcgctcggtggacgtcatggtggaggtgggccgtaaggctcaccgccgtcatgtctcggagcttgaagcccgcaaagcggtgctggcggagatcgcccgagaggtggaggaggagcgggaggccgccctcatcgccaccaccgcgatggtcgaggcgcaggacaccctccgccttcaacacgcaaactgggaggcggagctaaagaaaaagctcgacgctgcccaaggggtccttgacaccgccgctgcccgagagcggcgggcaacggagactgaagcggcatcccggcggcgcgaggaggtccttgaggcccgtgccatggcactggaagaacacgccggcgccgtggagaggggcttggcggaccgcgaggccgccgtcgccatccgggaggcaacgctagcggtgcatgaggccgcctgcgccgaagaggagtccgcgctccgcctccgcgaggacgcactcgctgagcgggagcgagctctcgaggaggccgaggccgcggcgcaacggctggcggacagcctgtccctccgcgaggcagcgcaagaggagcaggcgcgccgcaatctggaatgcgtccgcgccgagagagccgcactggagcagcgggctgctgacctcgaggcgcgggaaaaagagctggccgcaagggcgcccatcggtagggcggctgcgggcgaaagcgacttagccgcccgcctcgcagctgccgaacacaccgtcgccgacatgcagcgcgccctcgactcatccgccggggaggccgaggccctccgcttggcgggcgagatagggcccggcactctttgggatgcggtctcccgcctggatcgcgccggtcgacaagcgggcctctggaaaggccaaacaatgctgcactccaccaatctggaaggcctcgctccgcgcctcacgaagatggcctgggctctccaacaactccccgaggagctcgagaagaccatcaagtcatcctcgagggacctcgcccaaggagcggtcgaactcgtattagcgagttaccaggccagggaccccaacttctctccatggatggcgttggatgagttccctcccgggaccgaggacgacgcgcgcgcgcgggtccgggacgccgccgaccacatcgtcaacagcttcgagggctcggcccctcggctcgcgttcgcccccaactccgacgaggagggcgacgccagcggtgcagacgacgatggcgacgaggccggcgacccgggcgcattggaatgagcccccaggcccccgccaatctccaattttttctttttctttcttctaaggccttcatgcctcttttttgtatagatcaacttaatctggaaaaaatgatgaaaaaattcttcgtgtcaattttattttgctatgcgtatgagatgaggatgatctgtgccgtggtcctcttttgtgtcttagcttgatttaagggctcgtgcccaagtcccagtcctctaatggctcgggtcggggctagtgcctggggagatccacatgtcgaggctggccagcccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagtcaagattcttcaaaaggaaaaaacggcacagacacaacctttaggaaattgaaactgcttttattgaaatgctgaaataagagaaataagaatgtgcatgcgtggtagcccccggccaatcctgcacacccgaggggggtgcggggttggcccgagccaagacctgacactcgacccccccctcaggggtagaagcgacgaaggtgttcgatgttccacgggttaggcagctccgtgccgtcgcccgtggccagccgtacggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccatagacgaggaagaaaggcgtttccccggttgctcggcttggtgtggttcggtttgcccagagcaccgctggcaactcctcgatccacgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcggcggacgggtaccgagctcgaat

SEQ ID NO: 821 - DNA, 5614 bp, Oryza sativa
accagatcgactgcatcattgagagctgtcggccaatagaatccttgacgaaaggccttgccaaccagtgtgcgcgaggcagaatgggctccgcactcgccttcatggatatcggcaagaagctcaacgccttgttcccgaggaatgcacttcaagaggattccattagccgcgcgccgatagagggtcccttctaccagcacgtagcgtttggaaatgcgttggatgtgttcactcccttcgcggtcctcgggtagagtcttatctgtgaggtatgcttggatctcagagatccatgcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaaatcgagacggaccaagtatctgaggatgtctccgttcggagaggtcaacgtgacccccgcaccggcgccctggagagacagagaaccgtcgaactgcatcacccagtgggcggtgtgaggcagccgtgaggggtccgtgctggcctcgggaattgagacggtctctggagtcggggtccactctgccacaaaatcggcgagggcctggctcttgatagcgtggcgtggttcaaagtgcagatcgaactcagaaagctcgattgcccattttaccacccgtcctgtaccctctcgattacgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacccttcggtggggccgatcctcttcgctaggggccgtatccccggggcgttcttcgtccaaatggcctctcggggcgcactcgtcttctgtgccgatgacctcggggtcggaggatgacaggagcggccttcccacagtggcctcggggccgtcctgagggtcgggggctcctggcgtcgtcggacaagcgggcaaagggacaactccggtcgtcaggggcctcaggcctccgttcggctcgggggcctctcctccctgctctctcccgggtcgagtcagcacagggttagcctcggggccaaagggcgataggtgcggccttcccgcagtggcctcggggccttcctgagggtcgggggcacccagcaccgtctgacaagcgggtagagggccgactccggtcgtcaggggccttaggccgccgttcgactcgggggcctctcctccctgcttgctcccgggccaagtcggcacagggtgggggtgcgcggaatgaggattgtcctcatcgcgctccacaaccaacgctgcactaactacttggggggtcgccgctaagtaaagtagcaggggctcatttggctccggggcaacgagaaccggaggagagctgagatacgccttcaactgagcgagggcattttcagcttcctccgtccaagtaaacggccccgagcgcttgaggagcttaaataagggtagcgccttctctcccagcctcgatatgaaacgacttagggcggccatgcaaccggtgacgcactgcacatccctaagtttgctgggggggcgcatccgctctatagctcgtatcttctcggggttggcctcgatgcctcgggcagagaccaagaacccgagaagcttgcccgcaggtacaccaaacacgcacttatcggggttcagttttatgcgggcggagcggaggttttcaaaagtttccgctagatctgagagtaaagtctcttggttgcgcgtctttacaaccaagtcatcaacataagcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaagggtccttaggacatgccttgttaaggtcggtgtagtcgatacacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggcctcgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatggaccgtcgcccagggcaacctcctttgaccgggacctcgtcgcatgtgacaatccgccgcctcgggccggtggggccgaaggtgccaagcctctcgtcaccaccttcgggcttggacgcagcagcgaggtggtccgcgcgctgctccatgcaagcgagcgcgactttcaggtcgccatggacagagatggggccgccggggcccgacatcttcatctggaggtaggcgtagtggaccgccgccatgaacttcaccaacgcgggcctccccaggaccgcattgtagggcagactgaggtccgccacatcgaagttcacccgctccgtgcggaaattggcggatccaccgaaggtgaccggcaggtcgatgtgacctaacggccatgtgtgccccggcgtcacaccgataatcggttgagacggccggagcaccatccccggagccttgatggcatcataggccgcgggggaaaggatgttgagggcggctcccccatcaatgaggactcgccccaacttcacattgcaaacggtgggggaaaccaccatcgcaatctgccctccccgggcaacgcacggtgggtggtcggtctggtcaaaggtgagggcaacctccgaccaccgcgcccgacgcgtcgcctcatgagtaggggccgcggcgagaagctctcgcttcatagccttgaagctccggcgagagatgtgagcacacgctcccccatcgacagtggcaatggtggccccaggttcttggaaacctaggtcatcatcaccgtcatcgatgtcaacagcgggggccttctgtttggcctcacttcgccgtttgccggaaggaaccgccggggacttaccttcccggcgctcctgcctcctgtcctcctcccacttcctcgttcgctctgccaaatttttgactgcatggcagtccgcgagatcatggagggaggtgttgtggacggagcaccacttgccggctgagcgctccctgctgggagtaccagcctctttctttttgtcgctcgcaggcctcccctttcgggtggcccgtggagcgccctcgacggcgaggacatgaccctcgtcgccggaatggaccgacctcttcttcctcctcctgtcacgccgccctgtttgagcggcggatccgggggcggccgaagctgccacaccggaaccggaggggttccaggtccaagcctcctccttacgagccactcggtccgcgagctgaaaaagctctgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcgcctgggcgcggatatgtgccttgaaagttcatggtgaactgttggcacaaatcttcccaggagtggaccgacgcgggtggcaggttcattagccaaccccgcgcctgtcccttcaggaccatgggaaagaaattcgccataaccctgtcgtcacccccagcggcctcaatcccggtcgtgtagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggcgacactctggacgaagaggcgccctccgttgcgcggggagtacgccggttattacgccggcgctcgatgtcgaggcgggcatccggctctccatgctgatcctcccgagtcgggggtgtcgacgagggagtggcagccgaatgacgtgcaaccgccgccgctcgccgcgccctccgccttgatgacacggagccggtggtggcggcgccggaggtcttggtggtggcggaccgtccaccagcacccaggcgctgctgtgccgtcatgaccaagttggccacgtcgtccagccatcgctgggctggagactccgggtcaggaacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctatggatttatcaaccctctcgagcgcctccccctgcttaggactttggtgtggagaaggtgggggagtacgagctcgacggcgtgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagactgcgcaggcccccctttgccagttcgtccgggggcttagggtgaaatcccaagctctcgctgtatgtagaaagatcgcgagccaggaagaaacgcgagacacgggcaatgtatacaggttcgggccgctgggaagcgtaataccctactcctgtgtttttgtggatctgtgtatggacaagttacaaagtgtcatccagccctcagtcccctccctaggtgggcaaggtcctccttttatatctcaaggggataccacatgcacctttccctttccaaac

SEQ ID NO: 822 - DNA, 9294 bp, Oryza sativa
acgggatggggcaaggcgtgcgtcagaccgccagtcgccacctaacccgtgatctgaccggtctgtgaccagtcacagaccggataaaagaacgcgctgcactgcgctgcatgcagtgtgacacgcttgaccagaccacaataaatgcggttaggtgagcactgtcgtgttcacctatcccatatatgtggcgcaaactccctcaaggggtcggggtgcctcggccctcggggccggggcaggagcaacccgaccccccctcgggggggaaatcaggaggagggcggacacctcaccctcgggcccgacgtccccgaaggtgccaggccacgtgggcgattgtgtctgcctcaagcctctggtcacgatacccccggtcccatatcaccgacaggatataattcaaattcaaatttgaatcgggtatttaaacttttgacttataaactttgggtctataaactttagatgtatagaaatactatatataaaaaatatttaaattcaaattcaaattcaaatttgaatccgatacaattcaaatttgaatcgggtatataaacttttgacttataaacttgggtctataaactttaggtgtataaactttagatgtatagaaatactatatataaaaaatatttggatttaaatttaaatttaaatcagatatataaacttttgatttaagggcctgtaaactttagatgtgtaaacttgaagtgtacaaactttaggtgcataaatttactaaaatagaaaagtaatgtggtgctaaaaaaaaccacgtggagggtggaggaaaagagggaggagacccgatcgcccctggcgatcaatcgtacatatatgcccgcagcttgagaatctgtctatatatgcggggtgactgttgtagtttgcgagttggaaatggatgtgtgaacgttttagccgcgcgatcgaatcggatccgtcctgaacaagctgtaactgattactaacggaattccattagtttaagtggtgcgagccgaaaccgaatctgtccccaacttcccatgcatgcgaaatcgatggcaaataaaaacgccgggcggcgtacgtgagccaaagctgagcgccggagtcaagttgagcaatggcgaggttggtacgcctcatccatgcaaagtacatttttgtttttatagttgatcagctttggcataatcacattgtaacgaacgaatttaagatgtactccctccgtccaaaaaaaaaaagcaaatcctgggtttccgtgtccaactttaactgtccgtcttatatgaattttttttataattcgtattttcattgttgttagatgataaaacatgattaatattttatgcgtgacttgtcttttaattttttttaaataagacggacggtcaaacgttgggcacagaaaccagggtttatctttttttgggacggagggagtactcatttcggcacagagatagtatttttaatgagaatggattctaatttctcaatgtgttgtccccacgtttaaccttttttttctcaaaatccgatgcaaataattgtgaaaattcttaaataaattggtaatgtagagtatatacatatctatcagttttccaaaaatcaagttaaaattcaacctacacaaaaagagaaaaagaaaagataaattcaggtatgagcaatgcgctactagctactattaatacgttgaatttgtttatttatatctcaaaactaggtaacccacgtatatgcgcggacctcttctttaatgtgattaaaatttattatgaatgtttatgtgtggcagaatttttattaaaaattttgtactatattttaaactaaaatttcatttagtgtgctttgaacgctgatcataattttcttctaattatccataattaaaagaaaattatgaccagcgttcaaagcacattaaataagattaatgagatatttttggatattttgagttttgaatttagcagttaggagaaaatattcaaaacaatggatggggttccctcttagaaaattttgggtatttcgagtcctagaaggatatcttaccccaaaaatttgccaaaaatgtcaaattctttgtttgattctatttgaaattttagatatttttgttccgaaagtccttctaaaattttttattgtttctatttagaaagggtttttaaatccaacaacatttgttcaatcttcaatttaggccacgtccatttttgtaaaaaaaattggagacttccactctataaatcatccttgaaatgatatgatctttgtaatttggcacaaaaatataagtaggttgaacatacaacctggcatggggcaaaagcatccgtctaaatttctctctccaatcaagtaagaaatattaaaataattaccatagtatttttcattagcaaattaccactaaattgtagttgctcataacaaatacatgtttttaaattgttttatggtaaatgtcaggaatttacaattaactgtagcatgttctagcaaaatgaaaaaaaatggatatggtctttaattaaattccatgtggaagtgacttgatagattgatgaggccacctcatggttgttttactgctaagattcctggtgcaactcatacttggtacgatcggtatgatgttcaactaaccatacttttattttgaaccagttgtctataaaaaattaacactataaggaatacacgttatggaaaaaatatatcatttaaatatttttctctaatttcttagtgacatcatcttaagatcatttatcatgtgtgtaatttagatgctattatcatcttaagatcatttatttatctattaaaaagatcatttatttataaaaatataatggtcaatttgtataggtaaatggccgcatatacatgttgagagaaattaattaagttggtagaaaatcatcagatatttaatgtcatacaggtaatacggaggtcttttttggtcttcctttttttccccattaggatagtgttaattttaattgttatggagttgaaaagaaaagagaaaaggaacggacggcggatgctgcataggggcagggatggagggaggttttggatattttttaaaaaaaagattgatgtaatgatctaaaataatatgtctaggatattttctctaatttgagagaatgacgttacagtttggaagtcacagtccaaagctaacatggtcaacatgtggctgccaacttggaccggcaagccaaccccgagccaccgaggcacagcgttggcgggccaggcaagccgtaggcagcccccgtggcctggcatgcttcagccctttcatccttccctaatggacaggaaataggaataagttcacaagaggtccctcaacttaacaacgagattttttaaggtcccttaaccacaaaaccagaaatgtttacccctaaactcatataaaccgtgcactcaaggtcctatggcagtatatataggtggtttcgctgacgtggcatcctagtcagcaaaaatattaaaaaaaagtatgtggggtccacatgtcagttgtacatatcttttcttcttgttttcttctcctcttctgtattctctcttcgctcttctcttattcaggccggcagagagcggagagccggcgggcaagcgcggatgtgggcggcgggctactctccgaccaccgcgcgcccttgttctccctcctccgccgctgggacgacgagcttcggaccaagatcaagaaccacctcctcgcgctcggatggaccatcacctccaagcccaacctccctggcctcgcgcccaggctccactacgtctcccccgccagaagcaagtcctactactccctccgccgcctcatccagaccatccacctccaccaccaccatgctgctacccaatcctaatctcaatctcaatctgagtcttgggcccctcttcttgaggaatcggatgacgaccaataccaacaagaagcagatgaagatgccatcgcggggtacattgccttcatggaggagcagaatgccaggcgcggccgcgggcagggaaatgatgaggagcagaggtccatggccaaggagcttcggatcaaggctaaggaccagctcaggtcgttgtggtggacattctcgatgaaggtcaagtacaacggtcgcgaggaactgtgctacacagagccgcgtggccgctcccacatctccctcatcaccgcctgcaaagcctaccttcttcaccacacgccctcgacaacaatgcagacttcaagcataaacaaaaaaaaagagatggtgaaatgcagacttcaccacatgcatgtgcggcggctgcaacaataagagggccgcagcagagtacacggtggccgagttcgctgtgcacggcgacggtgatggtccctccacctccggccacctccgccgcccgcggcctgccgactccccctcccccccaccgctcccgccgccgacgacgccctccccttctttgcgtcgccgccaccggcagtcgaacctctcgtgacccgtgggtcgtggctccgcgcacgcccgccgctctgtcgtccgcagcccgccgccgcgctcgcccaccgccgctccgccggtgaagagaaaagtgaagaggagaagaagaaaagcgaagaggaggagaagaaaacatctatgaagctgacatatgggcctcatatattttttttaatttttttttctaactaggatgccacgtcggcgaaaccacccacgtatgttgtcatgggaccttaagtgcacggtttgtgtaagtttaggggtacatatttctgtttttgtggttaaaggatttaaaaaaatctgttgttaagttaagggaccttcgtgagcttattcccaggaaatatcaacccacaaatccgaggcctctccctctctccttcgctccaaggcctaggtcgatggaccggcccaacttcccaagctcactggcgctttttccctcagttgagtctacagtgcctcccgtatcccatttcaacttaccttttggcccacctgtcatagaataataaattgtgttcctctgtttacaattgacatctcaacatcatttttaaaaatttgagatttcaactttttttaaaaagaaaaaatggactgtttacattaagatttaaagttcttgcaagctgtcataaaaattaaaaatatttttaaactttggtaatgataatgatgttaaaaataaagttttagcttaaaatacaacttgtataaatagtaaaataaagagaaaaaaatattaaggtgcaaagtgaaccatttacaacttgtataaataccttttgttttttggtataatagtactccctccgtccctaaatgtttgacgccgttgacttttttaaacatgtttgaccgttcgtcttattcaaaaaatttaagtaattattaattcttttcctatcatttgattcattgttaaatataattttatatatacatatagttttacatattttacaagagtttttgaataagacgaacgatcaaacatatttaaaaaagccaacggcgtcaaacatttaagatgtttaaggacagagggagtagttggtttgaaagtttgggcgattatgtggagttactccattcagaaattcaatcactcgtggctatccgctatgcatgttgatactatatatattcgctcgaacaattcacaccacactcaaaatctcaaatcaacagatgttctcaagatttcgatcaagcatctccagccccatcttcattggcctcgttggtcgattgccgccgtcccgcggcccagcgaccgagcagtcctctgatatcccactccaaatccctcaggcgtagcaacaggtacagcacgattccggagatgaagcccagcgcggcgctcgagcctgtgagcgacacgccggcgcagaccagcatgacgaacgactcctgcttgctccccatgtcgcgcgacgccatggcgagctcgatcccggagaagagcagcatgacgcccagtatcccgatcgggaactgccccaggatcgtcacgaacgagttgccgaacaccagcccgagcgccagcttgccgatggccaggaacaccacggacgcgccggtccggccgccgaaccggtactgccccgccagcccgcccgcgccgtggcagcacggcatggcgccgaaccagcaccccacgaaattcatgagccccacgctcaccgacacccgcgccggcgagagctcggcccgttccgggaacaggtccgacgacagcttgcacacggcgatcaccgagttcagcacggacagcgggagctgcggcacggcgccctcccagaacccgatcttgaaatcgtcccaggttatcttgaccagccccaacggcgccggcccaaagcggagatcctgcaggatggacggatcacgaacgaagcagagcaccaagccgagcgcgaacacgattagcgccgccgggacgcggctgcaggagcgacggcgacggctcgtgccgtccctgttgacgtcctcgtcgtcgccggagccggtggcgaggattatgaacagtagcgcggcgagcgcgaggacaaggccgtcgaggccgaggagggggcgcggcacggaggtggaagcagaggaggaacgggagaagtcctgcacgtagcggatgtacttgacggcggtgaaggcgaaggagaggccctgcgagagctggacgccgcgcacgacggggagcgggaggagccggtagagggtggtcatgaggccggtgacgccgaggaagaggaggatggcggcgacggcgaggccagcggacatgatctgcgggatggtgaggtgcgcggaggagagcgcgacggcggcgatggacttcatgggctggacgggcatggggatgccgaagaggagcccggtggcgaagttgtagagcgcggtgaagatgagcgtggtgccgaggtcgaggtgggacgcgagcgacagcgccagcacgatggggatgtaggtgcccagatcgcccaccgcgccgcccagctccgaccacaccgacgtcttgagccgtatggtggacgggacgaacctgcggcggccgtcgccggcctcgccggagaggagcgggtcgccggcggaggatgccatgggtgggaaactcgaaagcaacgacttccttttgcctagcgatgttgttagcttgcacacgtttctgaccggtggaatgagcgaataaaaatactaatgtctctctcgaggcttaattaagatgcgatccagatttccgtagtggcagagtccagtgaactcaagtttgatccacactatccgtaattgggcgttaattcctacctaaccttaaatagtcgatgtcactgtcagggatggtatatgcttaaagattatggaggccagctactgcacgagataccacccaaagatctcagttcagattgggtaatttaccgtgtttaaatattcttgaaactgcgaagtgcgaaccatatggctttggcttttacttgaccaaaaacataatgatggtcaaatattatccattattttagaatatattctgaaactatgaaccttgattcaattgggctttagttgacggaaattacactcgcttatagccaaatattgccagttttatatcgagaataacttcttttttctttccaaactatctttactgtgtttttgttgtgacttttggcgtgatgtagggacgggacaaacaatatcatggatgatgcattctgcacgtacgtcttcgcaagatggatagcttccaacgagaataatggccgcgacaaggatgtcaagtgacattctggccttctgggtgacgacggggtatgaggatatttccctcttcggcccatgataaaggtggacacttcagcggacaacattgtttgcgtggtcacttggaaaccttttgtactaccatacaaatcacaaatgcttttgtaaagaaatgatgtagacacggtgaaaatatctttcacaaacctgcttatctcaaacgattccgcggtatccagtactcccttccgtttcacaatgtaagtcattctagtattttccacattcatattgatgctaataaatctagacatatatatctatttagattcattagtattaatataaatgtggaaaatggtagaatgacttatattgtgaaacggaggaagtaccattttgttacgaaaatatatctattgcggaataacttggcatctaaaaacttgctatattgttaacactacttgttgtaagtaatctgttgagtttctttctccttgtaatgaaataggtaatctatagcaatagtccattcaataatatatgtttatccggtttgaggattctggaaatgtggaaggctgttatcaatggcaaacccaacactaaattttagctatgacggattaatatactaggatgaggcgtattatactttcagttagtgaaatatttttttatgcgcaaactatactacaatcgtgctttccattggtgaaatatttttttatacacaaactatactacaattgtactacaatgaacaactataatggaaaattttgcatgtaatatttttaccaataaagtaattttcgtgagagtgttatacaggtgtgtttgctcgtatttctattattttctttagtccggctgtgcctttggtttagaacattagaaaattaggccgataaaggcattaaattagtgtccaactaacctattaatcaaattactagcatctgaaatcaacgcccaaatgtccaacgccaggtcgcaaactcaccttggttgtggggcatagctatggacagtgccttggcaatggccacgagaagatccgtcactggatgttattggagctaacggggtaaatcagactactccaatagttcagaaactggagtaattcggttagcaaattatatttctttaattaataacatggaaatagaaggggtcatatatgtagaacaagaaatacaagatttttcagaatcgatgcaaaaagcccctaaaaaggccaaaacgatcagccgagctctcctttccgcgctgtaactgcaatgcagcgttcaggctatcttctttcgggccttcccactatcctaactcacaagccgttggtagttcccttgatcgcttccaatagtcgcgggctgctagctccgtcaagcgtcaaccaaccgctgtttagtctgctcctcatgccatgcgttacctctacttccacggcaacgcaagccaggct

SEQ ID NO: 823 - DNA, 19894 bp, Oryza sativa
  unsure (1)..(19894): unsure at all n locations
atgcattggcggtgttcagggaaatgcgtcggaggggagtctctcctgataattacactatggcagcggtcgtgtcggcgagtgctgcctttgctggcttgaagtggcggtcaaatggggacgcaattcatgcgctggttcggaggattgggtttacatcggatgtgttcgtcatgtcaggtcttgttaattattatggtgcctttagaagtgttgaggaagcaagcaaggttttcgaggaaatgtatgagagggacgtggtgtcttggacgtcaatgatatcagcttgtgcacagtgtggtcactgggacaaagtgctaaagatgctttctgagatgcaagcagaaggaattattcctaacaaggtcacgattataagcctgctttctgcttgtggccaaacacaggctgttgatgaaggccggtgggtgtacaatcaggttggtaaatttggtatcgaggcagatgtggatatcaggaatgctctcataagcatgtacacgaaatgtggatgcttgtctgatgctttagaagcatttcaagccatgcctgcaagatatactaaatcatggaatacgttgatcgatggctttgtgcaaaatcatgagcacaaagaagcgctaagaatatttgaagagatgctgttgcatggcgtaactccagatggtataacgcttgtaagtgtcttatcagcatgtgctcaacttggtgagttgcggaaaggcatgcatgttcacagttatatcaaagataatgggatctgttgtgacaatatccttacaaattctttgatcaacatgtatgccaaatgtggtgatatggctgcagctgaaagggtttttcaaactatgacaaaaaaggatgttgtttcctggacagttatggtttgtggttatgtgaagggacatcaatttacaatggccttcaacctatttgaagaaatgaagattgcagaagtcgtggcacatgaaatggcactggttagtctactttctgcttgttcacagctgggagcacttgataaaggaagagagatacactcttatatagaagagatgaatgtagccaaagatttgtgcctagaaagtgccctggtggatatgtatgcaaaatgtggctgcattgacactgcttctgaaatatttagaaaaatgcagcataagcagaccctctcatggaatgccatgattggaggtcttgcaagcaatggttatggaaaagaagcagtggagctctttgatcaaatgctggagttacaggatccaaaaccggacggcattactcttaaggcagttcttggtgcctgtgcacatgtaggaatggttgatgaaggtctccgttacttctatttgatgtcaagccttggtgttgtccctgatactgagcactatggttgcatagtagacctcctggggagagctggtatgttagacgaggcatttcactttatcaagaagatgccaatagaacccaatcctgtaatttggggatcacttcttgctgcttgtagagttcatcacagaatggatctaggaaaggtaattggacagcatatcgttaacgtagctcctaatgatgtgggagtgcatgtgctcgtttcaaacttacatgctgaagaaagtcaatgggatgatgtcgaacatgttagaggactaatgggaagcagaggtatagagaagacacctggacacagttctgtccaggtataaaccttcagagttcagactatgtaaacttcacttgaatacatgatctaccattgagtaaaatatagaaagtttgcaggagcaaatgtaagtatgtaactattcagtttcagttttcttcaaaaaaaataaataaagaagtaaactattcagtttcagttttacaagatgtcaggcatggcatgaccaaacttcactatctacaggacatgatttctgtctcaatatcaaatgtctaaagcaggatctaaaagttctcaggttaacttctgctgttgagcatagtctatagcatggcctacagaatgtttggttgcattactgaactgtgctttacaaaccctgtgtgatactatctgttctggcgtcaaaggtcataccaacattttagttgcccactgaaggcttatgaaattgtgctaactggtactcatcagtctttatacttcatatgtttgcgaactcatctattgtcttttcctagctaccatttctaactgaatggctaactggtagattacttgcagggccacggctgtagccgggtaagacaataatgcctacatgtgggtatgctgcgtgcctgcgtgactgctgatctccgtgctgaatccttggccagccagccacaggtgaaaaagagaggcacaaatgtgcatttaagtagctgtagttactaacgtatatcgggagagaaacaacaacaaagccagtatttaatttctgcatccatataatcacattttctctactcttgcacactggtgatagttctgcttttaaaactgttgaaggcaaatttcagcaaatgttcagaatattggacgatagtaaatcagcactagccactaacccagtttttacatagagaactttttcagtatttgaagaatgattgaacgaagaagttcaaacatagagaacttattaattactacctccttttcaaaatgtgtgatgccgttgacttttcgcataacgtttgtccattcgtcttattaaaaaaaattgtataaatatcatttgtcttattgtgactcaattataacttatacttttacatatcaatggcatcatacattttgaaatgaaggagatatttgaagaatgactgaacgaagcagtttaatgtgaactcgcattttctagatggagtcatacgaagaaacaaaataatatacttagtagaaaatatggcccatttaattaactgtatttactgaagtgtactgtacctgtagagaaacaacagcaaagtcaggatttaccttctgcatccattttctctaatcttgcacactggccataattctacttttacctgttagagtgagaagtgctgctgaaggcaaaattacaggaaatgttcataatattggataatagctcgtcagtaccagtataaaacattttaggtttgtcctaagttaaactttttgatcaattctatagaaaaatatagcagcattccattattccatataataaaacaaatataatatcaaaatatattcaatggtgaacttatatgacaaaaccaaaatgtcttaatttctttgatgtagtttgaatggtgataattctacttttatctgtttagtggaaagcgctgcatgaggcgaattttagcaatgttaagaacattggacaatagtactgggaaatagctcacaaactagttttgacattctttttagatggagtttgaatgcagccatacgattcagatggattttaaatgcagtcatacgaaaaataagaaaatggatggaatttaaatgtggttatcggaaaaaatggagtttgaatgcagccatacgattcagatggattttaaatgcagtcatacgaaaaataagaaaatagatggaatttaaatgtggttatcggaaaaaggaaaaacatacgattcagatggattttaaatgcagtcatacgaaaaataagaaaatagatggaatttatatgtggttatcggaaaaaggaaaaggtatgattttaaatgcagtcatacgaaaaataagaaaatagatggaattttgtggttatcggaaaaaggaaaaagtatgattttaaatgcagtcatacgaaaaataagaaaatagatggaatttaaatgtggttatcggaaaaaggaaaaagtaagaaaatagatggaatttaaatgtggttatcggaaaaaggaaaaagtatggcccatgcaggtctcgaacctgcgaccttcgcgttattagcacgacgctctaaccagctgagctaataggccatctgatcaaaacgtctttaacacagtagaaataaatatgtactccctcgaaatgttgacattattgactttttagcgttcatcttattaaaaaaataagtaattattaattctttttctatcatttgattcattgttaaatatatttttatgtaggcatataattttacatatttcacaaaagtttttaaataaaatgaacggttaaacatgtgctaaaaagtcaacggcgtcgagcattttaaaacggaaggagtaattaatttctagcatgcctcatgattgcctaaaatttctcctccgccacgcctgccgcctgggctcattccactagtgatactggattactagcctgaacgcaggagatcggcggtcaccccgatttgtttcgatacctacaaacttacaatggtggatcacccacttcgtactttcccgatctcttctcaccatgtcgagcgagtttcctatttcaccgcaacacctactatcgaaaagcaatcgtttttcctacccgaaggttcccgcagcaatcccatccgcgctgcgaaccagcgactgcggacgcgcgccacgcgcccacgcttcaacaacgtacccgcgatcacacgggcggccggccgcgcgacacagcacgtgccgcccggtggtccgcactccgcgcgggcggagcacgtgacgtgagagcgcgcgcgggggagggacaccggcctcggctgacatgcgcacgcgctgcgccgagccaagccacccgtccgtccgccatgcgcctgccggtcggggagcgcagctcgctgatcgccccctcgctcgggcacgtgaactcgtacgccgcggtggactggtggtccgtccgctgactcctgccgacgccaactagcttgcctcctcgctgcaggactgcagcatagtagtcggtaggctgctacgagcaagtcgcgatgttgtcgagtcgtggtaatgcagacgtgcacgtcggtttgcctagttgagctgacaggttttatacgactctctctctctctctctctctctctctctctctctctctctctccacacggttgtgactagtgtgcatccaatggtacagtagtttggagtggagacccatacaccgaggaatatacgattccttttcacgtaaccccacgccacgtcgccacagcccccgtactgtgtatccgcgaaagctagcaaaatgtatcttttgccgaactggcagcagcagctccaattaaaccttgtattcaattgttcttcttactaagggaaaagtacgcagaagatactcaacttatcatcgggataaaaaacgtccttaaaccataaaatcagatatatagggtcccttaactatataaaaccggttacccgagatccttcggtggttttgaccccggttttgatctacgtggcagctgagtcagcgtgggacccacgtgggccccacatgtcaggtgaccacaccaccccctctctctctctttcccctttctctttctttttttctgtttctctccttccttcctctcgctctctgctctcacactcgcagggcatggggatgccgacgctagggcgcccacagtggcgcgcgcgggcagaggatggtgcggccggcgacggcggctcctagggcggctcgagcttccccctggcggcacacaagctcagggagggagcatcgagaaccaatcccgcagcagcctccacctgctcatggtccagcacgacgacgtcctcgccgcggatctcctcgccgtgctcgctgtggacctccccgcctagcgccgccacacctctttgtcatgggccgctacctcggcggcgtcgacgcgtacaccaagctcgccgagagcggcaagctgccggtgatggcgaataggttggggggaggggctgatgcaggagctcgctagtggggtccggctgctcatggaccccgcatggacaacgccgcggaggtggccaagagggagaagcgggggcattctgtcgatgcggcggtggaagaggaagaggacgccagccaccacaacgcggcgggatccggcggggatgagggggacgaggagaagaggatctcgtcgggaggaatgggcgcgaggcacgccgacgaccaccgggagaagcggggaacaccgacgccgacgaccaccatgcccgtcgctagggggctgccacctccacaacctccgcctccgccatcgccgcctactggctgccgctccctatccgtcgcccgccgcgcgctcgcccgcctgccgccaccgccactccgcgcctccactccactccgcttcgtcggctcctgcactcgcacactgcctccgtcggccgccctcgtggcgccgcccttcttctctcccgcctcggccccgccagcttgcagagaagtgtgagagagagagatgaggaagggagagaagaggcgaaagagggagaggaggctaacgtggataaacctgacatgtggggggggcacgataactcaaccgccacgtagaccaaaactggggtcaaatccaccaaaggacctcaggtgaccggttttgtatagttaagggacatcgcatatctggttttgcggttcgaggatgttttttatcccgatgacaagttgagggacctgcggtgtactttttcctcttactaacgaggcctacgcccagtcctggcccagcatcagaatagcaagcccgatacctttgccagcccagacttatgtgtgaatttaggcccaaaacaagtcagtcttttcgcccgctgaaattgctcaggtctactagcaacttgggaagggcgtcattagatcgaggatggtggcagtattaacaagggttttgacggcgccttctcttatgtctctttgtataattgtactcctactattaacaaagatatgccaagtatattaattaatcagttggaatatccaaattgcatctgaaaaatatatgccaagtatactcccatatcggcgagagagatagatggacaggaaactcttcatcagatggtaagttcaaaagttccatgccattcagattttcatatttgcgatttacgatcgatccccttaatcaaactaaccctcccgcgatttacaaacacacgctgctaccatcccgagccccactgcttttaccattgctgctgccgctgttgttactgtcactgccgctgctaccgctaacgttgctgttactgttgttgttattgtcgccgccgccgtccccggcggcttcccaggcggacgccgagaacagcggccgcccgtgccagccgagggtgaggcacccgtcggcctcctcgacgctgtgcccctcgccggagaacagcccgaccagcatcctcgcctgccgcagcgcgttcgaaccgagcggcacggcgctcaggccggcgcgcgtgagcctgtcccgccaccgagacagcggctcgtgccgttccctccgggcggcgccctccccgcacacgatgtcgcagatctccctctggaggtacgcctccgccatcgcgttgcccgcgccgccgctggcgctcgccgcgtccagcgagtcgaacaccgcggagtagtagaacagcgcctccgtgaacctgtcgaggaagcccgtcttgttgtggtcggcctcttgctcgatgaccgtgaagatcttgggccggacggaggcgacacagtcgagaacggcgtcgatgggcgcctgatcggccgggtcgccgaggaggcggtggagctgcagcacggagttgaacgcgacggcctccccgggcgcgatctggagcatccacgggcggacctcgtcgaggctgttcgcagcgaccccgcggaaggagaagcggacgcggacggagcgcgcgaggtcggcgagtcggaggccgacatcgcgcagctcgtcgcggccggtaggtgagggcgggccaatgccggtgatccggaggaacggcgggccgcctggtcggagggcgagggcttggatcaaggccggccactgcaggccctgcatgaggctgaagtcgatgacatggacgtggtcccacccatggaaggcctcgaggatggcctggttcgccgtgaagtgcgcgaacttgaggtaaggacacgcctcgtaaaagtgatggtagaggaaggcgtgctcggcgtccgtggtaggcggagcgacgggcgaaaggaacaatctccgggagagcgcggtggtgaagtggacggcaacgcggccgatgccggaggcggncgagacggccgcaagcgcggcgtgcgagtcngcgagctgcgcggacgctagcgcgtggtcaccagcctcgatggcgcccgcgcagctcatcagaagatgaaccaagcggatgcccgcgaccttcttcttcttcccgcgcatggccaacacagcagcgcaagcatcaggcgcgcacggcgggaagcccgcggcgaactccggcagagcagcggcgtccacatccgcccccgcaggcgggtcgtagtaccccacgccgtcgtcgggcgccacagccgctggaggcggcagaaacccagcgtcgaggccggatgacgcggctggatccatgggccactggaacgggaaggtatccatggccatactaactcaaagagtagtctagtctcaccgcttcgcactcggcgagcggtgcgtgtgcagcggggggaattgtagcggtggatacaagagtatagagcggagcgtcagctagaagggagtaggagtcggtcggaggagggagaggagggggaagaggttgagggcgagtgacgttggcggggggtgcacacgtggagatgcgggaggggacacgtaggcctcgggaaggaaggattccgggtgcaaggcggggcgggaggcccgaggaaccgccgtggggtggggatgctgccccccgccttctgtcaattcctgttttctgattttgtccgtgggggggatctcggagtttggaatcctgtacaaaactacagaaaacttcgtgacggagagagagcgaggcaggaataggccattcaagcacgaactttgttgagattttgtagtgaaaccactcgaattttacatacaaacaggatcctatgtccatgtctgacgtgaaatgttcaatcgctagcagtaatttcttggtagcgttagagtgtttcaaatgaagtgctatttttttttttacgtgccatggagcttattcatggcgcggtagcaatccaacagaatatgttagtcaagctaccaaacgatacggtagcctgaaggtaattgtctgagacaaaaaaaaactagtactgcctctatctaaaagtttaatacatatttcattttttagtttttaaataaattggacatatttactctgtgtgctgaattaaattgttagtcgaaatctaatgagttggcttaatactcatcggttacatgtatgtatatagttcgttggttttgtcacattgatgaatgagttaatttcttcttaattttgattataaaagaaatactccctccgtactcgtaaagaaagttgtttagtacaatgtttaagtcaaaccttaggaatataaatcatgaataactctcaaattgttgagtttgaaaatgtaaaaattatataaatagatttgtcttgaaaaatactttcaaaaaagaatacatatatcacttttaaataaatatttttataggaaaaagatgttaaagttgtgttttggagaccgtgtcgctgtccaaaacgacttcctttacgagtacggagggagtataccttaaacttttgggtagggtttgcgtgcgtgcgtccataggggtgagtgcgcgtgcgttgtgagtgtctgcgttgtactgtgtaattctcataaaaaatatttgtggagaaatggtgctaaatacttgtatgaggaaattacaccatggggctggaatatgcctcatgcgaatcataaactggatatttggatagctaacaagtgtaaggagaagtgttcagcctcaaattatttatttataaagcttagatatttttgtcacaggatgttattagtacacacctagtatatctgattgttaggactatacatttttgttcttgtgatgagactttggcttggagttgtcagtccactgattaaattgtacacaatatgtacctttccataggaaacgcaactgattgatcaattcaattgtatgtgttgtccttttcatgctacataatcgacatctcaaacaacttgatcgtagttctatcaaacaactaactaaaaaaagaaatcacacactctacatttgtgaaaaaatatcggcccggcgaaaacttttgtgaaaaaatatgtatatacatagtacacaataatttacctttccttgtcaattgtggcccattaccatcatttttttttctagttagacatttgcactttcccgtatgacataataatatgccaatttcttcgaaataacttcatcgcattttaattgtgccatatttttcttttacagatgtcccataatatatataaaacggcgatcaaagttgtcataaaatgctcctacttttggctggatgagtgcacatatctttctgtgtacataaatacatcatttcagaaaacgaaagtaagactgcaacattacgaacctcaaatggaagtttgaagactacacaaggcagttgctggagcccccacacctgtgttgatagtgagatatgtaagcaaagagtatggttttacctcattaagcacagacaaaaattgctgggtgccccacggttgctaccccggagaaatttccttgttgctgtaacggtcgaagccgtgccatgtgttatcacccatcggtgacatagggggaggtcccccacggataacttctgtagcaaaatcagtgggtaaatgcgtcgcgcccacgagaaatgcacccagatttacccccagagcattgcttggtgggccggcgtgtacaagagtaggagaactggggataaggcctgacgttttgtagattccgctgctctttggcgaaaagtcgttttcagttgtgccccccaaaacaggcgatcgtacatcggcggcacaccaccgtcgctcgcacgccgctctgtagccagccggcagccgcccggcgctcgtcacaagaaaagtttcctcggatccatgcacgcatcaactttcaagcaagacttgttgctgaaacgacgacgggctttctgcaaaatttgacacaagttcttgtggaaaccttagtctcagctagctgctgaacttgatttcacaattcacagccgagtttgctcttaaccatggcaattttgaggctctttgtgccgtgtactggaacatgcgcagcagagcatgtgcgcaactgtgtaccgaagtgacgtgcgagcgagtcgtcaacctcggttgcatgcttgcggccatggccctacagtctacagaggcaggggcacgcaaattaaaacggaaatcggggctggacccgtcgacctggcggatggtcctgatgcgtcatgcggttgcacggtaccaccacgacgttcgtaacaagaatttgctgggtgggagacgcgcgcccgtacttaccctttgcatcctagtatgaccgattcgatcggattagcccatgcgcaagcgaatcagcggcggcgaaagcgccaccacacctaattaagcgcttgcagatttgtcatctgccatatcgcacccagaggcacatgacatcgaccagcgtactcaccaaccgttgccgtttctcctcgcgaacgagcatcgtaggcgaatttcgggctgcagcaggtagcagagctttacagtaatgcagtgtaggagtacgtttgccacttgctggaattcttttagacattgactaagcaatgaaatggactatgaacgcggcgccttttcttttctctttttttttttaaaaaaaaactctttttttggttggagtatcaggcgtagggtgatgtgccgaacagtatttggtatttctttcttcccatcttctcccgtgcgatttatatcttctaaaaatacactccttccgtcctaaaataagtgtaattttacactattcacgttcaacatttgaccgttcgtcttatttgaattttttttagattaatatttttattgctattagatgataaaacatgaataatactttatgtgtgactaaatatttttaaattttttaaataagacggacggtcaaatattagacacgaatatttacggctgtacttattttgggacggagttagtacagagttgggactcggatagcgagtcggaagatgctcctgtctggatcaatagtacaaaacatggtcccggaattgcgtgctacacggtcagataaatggtcctagcaggctcggtcagttgcagcttgctttctttaaaccggttgaattcacccagatacttctcattttcaatcattgcaagccaactgactttgtaaaactcttggttttaaaatttgcggagaaaatcctttgctataccgatgatctcaattacttacttagtatttgcaagttgtaatttgactaaaacaaccagccatcacttcttgtgacggtgaattgtgctccaaacaagagttagaaagaaaggagaaaaaaaaaaggagaagtaacgatcagaactgtactactgataggaatgcaagtggatagttgcgttaaccatataaaaacttatttgctagtttatttttcatatggtagtataaaatttaaaagaaaaaataaactagaagtaggataaacgggctaaaaaacccgcctgcccgcatcgcttatatttctaactatctctaactactgagcgtgtcacccacggaaaattacagtacttttggcatggttggaactggaaatatatgaaccaaccgatagaaagagatatatgtgattggtgcaacaaaactatattttttataatggcaaaactagagttggatacttggatatcatggttttctagaaattacacatgtgtgcaattatttctaaaaaatgcataaatccacgtgcagaaaatcattccgaccaagatctagtcaaatgcaaagaaaaaatgcaaagaaaacggatccactgaaacataaaaaacaatctaataggagtaggatatagctaccatagtgaaaaagctagaccgtccatgaaattggtgaagctcatagttcaccagctcaccggtagggtttcctaaaccgccgaggtcggggttaccacaccccggcggtaagtacggcagggttcgacttaccgtcagtaaccttgcagttaccgggtttaccgtgggggtacggtaatataaataccgcggtaacctccttaaatttaaataaatttaaaaaataatttaaattattgataaattttgcacggttttttacggttaccacggttattgcgcggtagtcaccggtcgtgcggttcgatcgaagaaccgatgcatttatttggtgtgaatattctttgttaaattgttagccatggtgcaaaagccatttagctcgcttagacggtgagctggtagctaagcaaccatgattcaattccctcgcacactttctttttcatttatttggtaaaattgacgcacgtgtaacttgagcctagtagtctttctagcgtaatccatgtgctcgctagaaccgtcgaaagcaaaccagagttggttccggttcaaccgcatagccattggtcttggtcggtacggtcaatttcccatttccctagtgaccctgagtggccgttgagcttattggcaaaagcaaatgcaatttttgcattattttaggaatcgaaaacgccgttttcttgaaaagcagtttaatattgttagacttgcatagactaatttttaatccaaatatatcacatgagtagtaatcactggtttgaaacatatacatttcggcctccttggaatgtacgaaaattttccaattcgaatccgtttcaaaataaagcaacttctgcattcgtaatttatcatagatataacacatttttcgaactactccgatcttaacaaatcacaatcatcatttattcaatttctctatctctacctactcaccgaaatcaatcataattatctcttatttaatttcacctcttattgattctataattacttatatctaaattataaaaataaagggagttctttgcaagaactaactatccaattttttctcattcaaatatagcagatgcaacacgcgcgggtgttaattggcctaacgtcctaaactggacaacgcgcattggggcgtgtgttgtgcaagttttaactaagagcaggtacaactattagctagctgtaaacatattttaatgagataaagaatgagagagaagatcagcgggctacagatctgtagccaactgcaacgcggactccaagacgcagtgtgtgtatgacaggtgggatcatatattaatagaatagtaagcaactattgtgtgaattaactattagattggctatatatgaattagagttagcagtgactatctcttgtaacgaattccacgcgcattctcggccgattagccccgccatgtggctgtgtgcgattcgagggtctagttcgcgtgcgcgtccgttggattaggaatcaacggcagagatgatgcaagggagtttagcgcgattcgcgaaccgtctccggccgtccggcgtcggccaccgccgctcccgtccctcgtcgatccctctgtgcctccccggcccctcgccgatccccatccctaaaaaccctagcccacagtgccgccatcgtcacttcagctctcctgctcgttcgcatctcggtagccgagcgtcgccacctcctccgatccttgcccctttgctgcccatcgacctccctccttgccgatgcgctggacccgatgggccgcggtcgagcttgctggcgcagcgctcgagttgtacgtcccacctccgctccagttcgccccctccacatgtaagtgcgctacctcctcctcctcctcggcgagctagcggatttggttcggattgccatggcctgacacaagttttgcacggtgtgggtggggtggcagagaagcaggggagcaggtgccggcgacgcggatggcatgagaggagacggaggcgtacgcgcgggactggccggcagtggtaagcaagctacagtctatagtctgatatttgttccatttatttccctggacatgaaggatgtgtggttgctgatttgcaacgcaaactgtgcattcatggtgttcgatgaaatgaccaaaaaagagtatatttccttatttcttagagttgcagttgattagcactcagttaggaatattttgttggatagtatattaattgctctattgctactaccacttctgcagaaatccaggagaaacacgacttgaaattgcaaattttgatgctaattaagttgtcatgtgaaactctatatggattattaatctgttaacttatgcattactgattccatcatagcagcaatcgaattatacatgagttagagatattagtgtatatacaattagcataatctggaatagaaatagtaataagctaaaaaaacataatcaggaatggttcttgacaaaactcaagtttgttttttttttatttctgaataccctttctaatagcacttataatcatgaaaatgatcctgcactgcagcactggtacatactttttttttctttggtctcaatcctgcacaatagtttctttacagagttttcctcctgacaaacgaaaataaatctataaaagtggcacaatttagacatttgcatcataattggttagtgccctaattgcaagtgttctactcaagggaacatcctgagtattaacttaagaaattctgaagttgcgatcgattgcaactgtacatggtgaccacattcttaagttaatacatcatgagtttgttatatttctttccacttctctaaatgtataaaaaatatagtgttctctgaacatgctttttttgcagttatctgacaaatatatagagatgtaatgttttctgaagacatttgtttctctgttttgttgggtggatgttatcactttgatgggcctatcaacaagttatttcattatcatttgaatgcacctataataaaaactaacaattggcaaacaacagttttccttcagaactggggattgttgtttcattctaaaaataaaaatagtcatagtctcttatagcttttgctgctttgccactagcccaccaggacgatctggctttgcaatgcttatgtctcttgctcttgatctccttctatcagtcactctaggtgcagctaatttctgttcgtctcctgacatttctagggatgcaagatatcgaagatgaaaattgctgccgcgtgctcgaaatcatcacctccggcatttaaatgtgtgaaagactggttcttaaatttatttttgctttcactgtaactacattgttgtgcttcttctttgttccatagctagaagctagactggaaacaactgtggctgtttcaggctttttttttatcttggtgaattaatgtaaatatatttagttatggttatatccggttttcgatggtttgttcttacagggcaatagttactatttttagcaggagtgccataggagctaatttagctaaacttgttgcatcagttaataacaccatcgaatatttcatttgccaaccttttataaacctgaattttgaaaaccaattggaaaatatacacaggctataatgagcagaggcgcgctaattttctagtactattaaacttgctctaaaatctgctggcacacagtacaggctacagcaacacagcatgcagcaagcaccacgcaattagtgaataaacaaggacgtgcaaaagggaactagccgaagcagcttgatttgttgacagcgaaaatcctatcatatatgggtagatgtattaggtgtcaagtagcatccaagtgtacagcccgagctgtgagttgccacctaatcttttataacaactttttgtaggctaagcttagtcttatcgcgagaaatctacttagctcaatcagaagcataggtcgttgtccaagtatatcgacaatgtaatttatccccactatcactaattaaacagaaaatcgtgggctttaattatgaagttgaagcagcagcccgagaccagccgttcaagagatcggtattgacggagtgagacagctcgcaaggattagattagctgaagagtaggcatcgattgtacgtacgtatctctgcttgtctgaccgaacgtgtacttgccattgttccctgacacttttcagctttcaggtagagatgtcgatgcagattctctggccaagattatttgttaatgatgcatgggttgttgaccaccctgaagacctgtgcaaaatatggtctttggtgtctgatgcacatataattaatactgatcatgcaatccatattccgtggcgtgatgcgtttgtttcgtagctggtcgtaccgtgcaatgcgctgcagtatgtggaaactgtcggcccgcacgtacaaagcgctacgtttcaggaatcatacgaagccctttttccccattcttttatttatcagttggacacttggagtccagatttggtgaacccaataaaccacatggatgcgtgctatccatctcaaagtttaaaatttgctttaagttccctggtcaagttcaatttgccctgtgatcttgtctgcaggtaggtttctgccatccggtactaaaaactgtatttatcacagtaacctagctagctccagatcgctaacagctaatcagtatctttcagccatggcagggaccagaatgctcgcgctcgtgcagccttgcagatgctcatgctccccgacttaccagtacgtactccatacattatttgaccgaggaatgatgaagcggttcagatcgatccgatccattttttccatccacgaaaaaaaaaaagggaagagcacacgctaatccatttaggatgtcaatggatcggatcggacacgagcataaaaggaacacggctgatcaaagacccaacatctttaatccacgtttgatattcttgaggggcaaaatcagtgcccatgcccgacagtcaggcagccgatgggtaattagtgagcttctttataacttgagttatattttttatagataattaaacagaaaggaacacgattaataacaagctagaaacacaaaactagctcatatacacgcggatagagactaagaatgtaagaacatataagaagcacaagactacctgcacctttaattgatatagatagtactgtactaggatgatgcacgatagatgatcagatagctcaattaattagtagagtatagaactgaaaatccttttatcactcgttcaaatatggttcctggcacaaaaaaaaaaagaaccgaataggtattactctagatggactcaaaataatttggcgaagtgtttgtttcaaaacggaaagtggtcgtctgctctgccaaactccgtcaaggaaggagagagataggtgaggggagagagggaggggggggggggataattgagggcaaatccagctagaattccattttcacatgagctgtgagtaaatgggccaaaattagtacaaattaatatcgaatcaggtttagattagccatgggcaaaataaatgcccatacacatccgctatgatttcagggcaaggttgggtgtgtccagaaaaaaaggtaaattgtattttggatcatcgttttattactaaagttaatatactccatcagacttggacacgggtagtgcattgttgttttttcaactatgctaaggtcaaatctccaacgcaaatatttagtcgttattttttaactgtatattgataagaatgttaagatgtaacggatttttatgataaatctactaatactatttttttatatatcagattatatttcattagagttaagatgttgaattttaacggtgataattccaaaatgcacctatctaacaacataccgtagtaggagaaagtagtcttcggaaaaataatgaagaaagtaacaaccgatcgcgctgattgcaccttttaggcctcctttgattcataggaaaaaatggaggaaaaacataggaacaagaatcctatgggatttggtactgttcatccatttgatttgtaggaattgaagataggaaaagcatgggaaaatttcctataaccatgatttcaagggaattccataggaaaattaacatccaccttgagctcatttttcttctcctatgtgtaggatcgaggcaaaacactattggaagataaggtttaccctagtaaaaccattcaaattttgattgctattaacttaatactcaacattcctatgtttttcctttgtaccaatcaaacgatcattcctataattttcatatgtttttcaatcctctgttttgcatatgatttcctacactattcttgagtttttcctattcctacgttcactgaatcgaaccattccacaagagcatctggtacatgtctctgcaaactagcactgtccatgacaacaacctgtgctgtgcgtgcatggatctccccagaaaaaaagaaagaaagaaaagaagcccctgcccgcggtatcaggtccagcagggctgatcggaatcagcggctgggtttcacattcatggtttcatttcgttcatctgcctgaaagaatgccaggaaagtgagagcagcatgtgggctgatgtggccgaaggcagatgcaacaggactacaggagggcgtacatgtggtctatcacctcagtcctcatagaggaaaccattggtgcatactcctccagagtccagacc

SEQ ID NO: 824 - DNA, 15964 bp, Oryza sativa
tctctttcggttggttgctgcagctgctgtcccgcgcacagttcagtacgaggtgcatctgaacagaggttcacgcggagtgtcacgagaccgatcatggaatcagtggtctgttaatttcttttgaaattcacgatttttctctccttcgtatggaatatccggttttactaagggcttccacgtaaaatatcagctcagagatactgttcatgagggaccgagatcaaattacggataaatcggaggactttttcgtaaaatttccaaccctaacattgttcctatcctacgtggcatcgcccaggagtcgccccatgcgcaccccattttgttctgtaatagcacagtatggagtcgcgacgtggtcaggctacggttgggacaatagattaaatggttttcaattcatatgccttttaacaagaaaaatgcattccatatatccaacttcagggggaaaaacaatgatataccaatacttgcacattttcgattacataaaaagaagtacaccacatacacaacattgtttacaaataattcaaaaaagtcccgggaattaaacagattgtggagatgaaattgtggatgcatgcaccccatccatcagcgttgaaatcctggtggccataatacactcacatggatgcatttttaatacaaaattttttatttatagttggctttctgtttgtttttgttttagaggatgtattcacacatgtgtgggcataatggtgtgcacacgcgtacacgtcttctgtataatagtgatacattgatgataatatttagaggtgacaattttcctttgaaattagatacccatcgtgtccccatatggggtggggtgagtttcccacttgcaggtacatggggttgaatggtgtgttccacccacacgtgactcatgggccctaaaattattcaagacaggagataatgtttacaattaaaaaaggccatcaacccattaagcgaattccaacatgctattattatcagtatcattatgcctaaatcccatactcgtcatcgtacattactaactacttggcttcctcgtaccctgacaagttgcagtcggtatgttcttgaggcctctatcccatgatatcctctccccattctgatgtagcaatatcagcagctggtgtgtgctccttcaacattatatccgcctttatcttctcttcttccatcccaatgtcgtggcggtcgacgctcccccaatacgacaaccggtctctaccttcttcttggtaaagtaatgccccgatagcagctagccttggtattttctccctccatatcgatgtggtggctactggctactagtgctccactaacgtggtagcctcccggacgtcaccttatcttccctgacagggcccggtcgagggttaggacccaccgaccctagggtcgtcgggggaggaatgagaggtcaagggtgaggggtggagctgtctttctccaacctaacccatcctaccctgttattaactctattaatatctgccttgcagatccaaggaaaaaaaaggagtgaaaaaaccattttacttccccaaactctttcacccgattacgtaaacccctaactcattttacccctaaaatattaaaaatgttccactttactacttaattgtatttctcttctttttttttctttatatgagacatattttaagctaaaattttgtagccatagatgacaccattattaaagttttataatattttaattttctcatgattatttgcttgaaatttaaaaccctgatgtttaaatcagccctagtgcttctaacctatgtaaacaatgttaataaaattctaaaaatattaggaggcacttcctctatcaaaaaataagttagcctaatacaatatatatcctagtactacgaatctaaatatgagcttaatttattttaacatggagagagtaggttgtaatgaatctatcaaaagttccaaattttattgcaaaacacaacttatatatagagaaaaaagagaaataccgttaaggagtaacgtgaatcgttttcaatagttctgtcgataaatgaacagagaaattgtttaggggttagtgctccacgaaaatagttcgggggtaaaatggaatttttcaaaagaaaaatatccacgttgccatatgaacttccttcttcctcggccgattgctggataaaactggctgtttcactcgcagaactgggtcgaatcctctaagaaagatctgggccgaggcgttagcccgtgccgcccgcagcctcgcaccgtcgcgccgacgtcgacccagcgacgacaccggcaagaatcacatgaggccgacccacaattctcgtaggccaacttgggtcgtgccaagaaaatcggtacagcgtcgcggcctaggcaaggccaccccacccgcaaacgccgtgcctcctctgcgactgcacggccgccgctggcgccaacaccaccgactgcctagcactgctgacttgcccccaacctcctcatccaacttccaagcctgtctgggtgagcgcggcgcgtgcgacggcaccgtgtgtacatgtgcaccggcttctccggctgtgggatgagttccacacccccaatcatatgagcggagagcagggcagagaagccgagcacgtacgctaattctccccctaattctgcgtcttccggctagcaaagcaggatcacctgctggctgctgccgagccgctccgcgacggcgttgcggtaaaagacgagacgagacgacaaaacgtatttaacatatttgaggttctggagcggagagacaaagcgtggaatattgaagcgaagaactcggtatagattagttttccaattgaaaaatagattatctgaacccatatcgactagtactagtatataagctgacttggcaaaggcatgctttcctctcctcgcacggataaaacgcatgggcccctaaccaaaacctaacccctggcaagaaaacaaaaggtgtcaactcatcctatgtggctaccaaaaaggacaggccgaccaaagaaaaataaaatacaaaggcgatcactaacactaactttggtggatgaaattaggcctcttttggcaccatatctgttggcagcagggggggttaaagcataaacagtacggcaacaagattccacttgagcagtcgacaactcgatattgcccagacgactccttcactttcaaacgatttgctactaactagtagggtgcccgtgcgttgctacggggaattttgttgatcacggaggataaaatctggcgttgaaaagacaaatatagcatcgtaaggaaactacattcaacataatttaattagtgttcagaacaactcgctgactaaaatttaaggagcaggcaacagtaatgctcaaactctttacctaagatgacttcatggttattaccaaatgcatgtacaacatgcaaaaaactttacaagtggtttgacaaactgaaatttgcaattaaataaaatagccagttgagcaaaacatattaatccctgacctaatctgaatccgaagctcctttcacatggagcaaattactgatcaaatgtgctccgttacaaatcagtactcacagttcctggctcctgcttacgtcctcacacaaaacttaacactcactgaagacctgcatattatatgaatattcatgtttcttgattctaaaaataaagacatcactgatttgactctcttgctagaaacatcaaatagtttggcagaagtgagcttagcatgagcagggaaaactcataccaaaataatgatagaaacaaaaattgtataatttttttctttgataaagatcaaagttttatttgatatagtaataggctaatagcatgagctcaaatgttggctttcagttcagatgatctccactcaagtgttattcagtaccccactggaaactggactgccacaacatgattacaagaaatgctaaactgcaattggaaatctgaactaaagcagaacctcataaatctgctaacatcagtactaagctgcaagacatgtacaaaccaactacgattgttttaaaaaagaagaagaaataactgtcagcttacaagtaaggacttcatcttgaatttgttcataacagtgaattgcttcatcctggacctggctgcttctctcctattagcaaagaataagaaataatgagcaagggaagagctgccagggtggttcaccaaggactgatagaaaaatatctttacctgatcacctgcaactcctcggcgagcagccgactacaacggttttggtctctgagtcagccataacgaggaggcggccggagggactgctcggggaaggagtggatgtaggcatatacaggagaaggggcagaccaagaaagtaaatgtttactgctgtccaaggaaaaaaactcaagaaatgttagacatggaatataaaaattacagtaagaatggaatttaagcaagcatattgtggacggttaattagtcacataatataccttttctaatctgtgaggacctctctatacacaatattttttgtgtatgttgcagcttgtttagacaattcctttcctttcttctcattgtccttcacgccagtacgcttagactttttcttttgtttcttgtcttctaccggcatcgatagtatttttatgtttgttctagaggttgctcttgacagtgcaacgtatagttgaccatgggagaagacaggctctggtaagtagacgcctgcatttggaattgtttgaccctgcgccttattgatggtcaatgcaaagctcaatctaaccggaaattgcttcctcttgaagcgaaatgggaacatctcatcatcagaaggacatagaggtatccgaggaaggaaaactctctttccagcatgctgccctacaacaatctccgcgtcaatagcattttttccgaactgacgaaccaccagccttgtcccattgcaaagtccgttggctgttggctgggtcaatgttcctcaaaagcatgatggggcagtttatcttcagcttaagcagatgcggaggtagcccatttggagttagagagttcaagaattttggcgggtaatagttatgagggtcatcctctgctcagtcaaaactatgatatgtcatcacatctcctctaaaccgctcaatcatcttcatgtttattcgatcgacgaactcattccgagtggacaatatggccctacatatgatgtagtttgggtccgtcaggttatcgtttaggttagggaacacggtatcgatgagcctttcgaggtccgtttcattccctttgcactctaagcaaatatccgaaggaaggcctatgtttccttccttgttcacctcctcggttccattcccaactcgaaggaggtagtccgcaaaccacgcgtcgctctgcgccctcatattgcgaacaagctttaattgaaccatacaatcccaaagataggacctgcgtagagtggcttctgttatctgagacctagtgcccttcctaatgaccgggagcacctgcctgaaatcccctccaaacacaatcgtcttccctccaaacggagaacgtggacaacccattatatctctcatgctcatatcgagggcctcaaccgcttgcctctttgtcatggaggcctcatcccatattataagcgatgccatctggagaagctttgccgtcccactttgtttggtgaagctgcaatacgacccttcctcaatgttgagtgggatcttgaaccgcgaatgtgcggtccggcctgctggcattatagaagctgcaacacccgacgtcgcggttgccacctctatatcaccattgccacgcactgtagctagtagcgccctatataggaaagtcttccccgtgcctcctgggccatctacgaagaacacgctcccctgagcactaccaaccgcgttcatgattttattgaatgcagacctttgctcatcattgagctggtctgggaggttcatatcatctctctccacaacaatggaagactcctcaataatctctctgggatctcctcgagtactatcatgtgattcatctatttcagggagcgggaacgatgagatttccttacccattgattgtagcatgccccggatatctatcagcaccatctgttggacagcataagggcatgcgttgttacatctgacatggaatctagatgcttgtcccaaagtgcacggacatcggtaggttcgcagtacaccaatatggtagcgaataacctgcgtagcgacgccggcatttggtagacaccggcctccgtaaggcactcgtcgagggtgttgtctgcctctataagaccccttctttcagctgcagcacggaacgacggcatgagcacaccatcaacagtacgtaggtcttcaaatgaggtggatcctgtcacatggtttagaagcacccgaagatagtagcgctccccctctgccgggtgggcacacacaattctcccgacctggccacctctatctcttttcttccagtacttacctggcgtctgccaagtaaaccacattgggaaatctctataaaggatatctcgagcctagacatgctgcctgttagcctcgaaatacgccgtaagcatcgatctgcctgcgtcttccttatccagaacatcacggagatccttgtctgcatcgaaagccaacatgtgcatgtttggcagatgcaattgcaactgcctcacagacggcgagatgtggcatatgtcaaaaccatatatacgccacaaggcttctggaggggtcacccacctcgcatccctgtagcgctgaatctcatcgatttcaccgtttttatctgcctcgtttatggatatcgaggccttgtcatgtcccttgtaaaggtatttaaagaggtactttactgccttgatgctcgagcaaatctcgacattcatgtgacagttgtacatccgtagaagataaggattgtacggcacaacccacctgttatcgagaggatgtcctctaaccaccttactcttactgtcattacgtctcctatacaacgggtatgaatccttgccttgcgaggttgtggtgttgaactctcgtaggtagttgttcctgcactttccatctcgcatgcattggcacctaccgttgagtcgaccacaagggccatgcatcatatgcttgacaaccatattgtatagctctggatattttttcttgtccggtagctcagctgagacgatgcggtcatattgctctgcagacgttagcttgtatcgaccactcatgatcagcaaaaagtgtgcgtgtggcagacccctcttctggaactcaacaacatatacgtgtgcaatgactttgccaaggatgtgcttctcgaacagctgcttctttaggtcctctaacttggctcgaaagacacggaccacgagatcaagacgatcttgtggtgtctggccaggctcaagttcacgagtaatctcatcctacttggggttgctagtcattgtaaggaatacatctggcttcccgtacttctatactaaagccatggcatccatgtatcgacgcttcatatttcggccaccacagacaaacaaagctggcaacacagttcttttgccaaccgcgcttgctcgactctccccagcctggatgctatccatcaacccttgatacaggtccgcccttatctccttctggttgttcctcacatagtctagacgggagctctcaaccttgatgtacatgtcaacggcaaactgctggaacaggagtccgccgtgaagtataggattgaaaatcccacgacgcatctggaatttatagcagtagtagtcccttacagagactcgtatcctgctgttacaatctacacgtgagaaacatctaggttagtacagtcatgtaacgcacaatgatcaattctctaaggcaacatagtacgaagataaacttaccaggatcatcgccattccgtgcgtttgcatcctccatggttattttgtcctttggaaggctttgatgccaaccattctctctagggaagaaaagagggtacgagaggggatcataacattcgtagaaaggctggatagatttccgcgtacggttgttcctgtatattgtcacgctaggctcgaacttccttctctcatttccctcaacccagatagcagcgacctcagttgtcaccggcacattgtaacgcctttggtgcaacctatgatccagatttagtgtcacgcgataattcgcgaggtcttcagcctgccctagacttctaaatgtctccgagtacgggttgttccgaaggacgtctgcaacagtcctaatcacatcctggtcaaggctaggggaacgttggaatctatgactcaatgttggatcgtcatcgtagaaatacaactcgagatgctctggaccagaatctctaggactgaaagaatgtatattatgatatatctgaccatgagcccgaaaagtgtacacgcccgaactcatgtttgcaaaggccttgtcaaggcttacaccaagggtagtgaatgagaagtggccgttgaagtatctattgttatcacggaaatgcttggcgtctggatccgagcttgtccaaagcctcatcagttcaggaggtgtttcattttgtacaagcttgatcttgccaccccgacaacagaagctcggcggttcgtactggaacctcttggcaccacagtgtttacagtcaggttcaggcttcagaacatttgtgctttgtggaatgttgctgtacatatagtcatacggatcaggaacagaagaggtcggtgattgcgtgtcatcgtcatcagattgtaccatctcgtcatcctcatcgtcgcctggtatggtttagcgcaaaggatttatagtccgcaaaaattatacatgtgaaagagacattaagatatcacgacgacgatacctagcccagcaaacatgtagtattcatcgtcggagtcatcatccatgaaggaatccatatcatctttagtacaatgagatataagaagttagtatcggaaggggtacaaattataggggaatttacctaattgccacttttaggtttggcagttatccaaattcccttgtaacgtttcttaactaatgggcacttttgccatggattgccacatggccaacagtgacaaatagttaagaagccaccatctaagaggggcaaaaaattaagagcaaacttaagaagggcatttggatagttgccaaatctaaaagtggaatatagttaaattcccccaaattgcgagtacgaatgaaaacatatatagatgataccatcattgaatgtgcatgatcgcgcctgatgatctacagcatgctcagtttgcaggctcgatgtagatggcacatcaccggttgtttccaagcaaggcgttggatttagcaacaatgggatagatccctcagggcactctagtgcaatggattcagcgcatggtttgtcacgcctagctgcatagagtgcgttacgtcgtgccagatgagcagatctttccccaggagtaacattttgtcgtcttgatctacggcaagcattcatatcatggatttccacatctggcatagattgccttgcaaccctacgacgggcattcaactctagtctctgttcttttgttagtgattgacgttgtgttctccgttggtccaccttagcttgcttttgctccggtgtaagagttgcatacttctccctagctcgagctagctttgactgcaatcgttcttttgtctcattggttggcgcacgcaccaattcattatctagtgatgtgccaacatcatcatgagtagatttatgggattgtttgctcacttcaaatattaaattgtacaaacatgaatagataataataactaacttagcgcacttctcatatgtaagcaaagaggttttatgtttgacaagtttatataaaaaaaacatgtgatgaagtaaaatgtgttacctagagagatgtcgtcatcgtggtcgcactcattttgatcgctgccttcaaaaaaactggattcatattgattttcacatcctgttgtaacatagtcagtaatatatattgtaatatagaaatttataaatggcaacagcattgtaatcccattaataaaaagatattagcatacctgaattatcaactacaaagtcagaagtattcatgtttaggtactttgagtgaagcgactcattggtacttcgttgggaccatagtgagctacattgttgatgattgtaaatgggagacgtcttggtgtgatattaagatgggaagcttcactttctatttaaacatagaactatcaatttccattcagtcgaataatatattgttcaaccaaactgtacaaacaataaagacattacttccttgatgcagcggggaagaatcagtcacttccaattggcacttcattatatcaacagcgcttatatttgaaatatcgccaagtggggctgttcacacgacgagaatttataatattgtttcgcataattggccagacatattttaatttgtacagataaatattacagttgtacctgaaacttgagtttcctccttctttcttttccttctttcacgtgccttcttgttcctatcatctttttgctctggggtcaatgctgcgtaccggtctctagcacgctttctttttagttcagccacactaaggtgactaacatcttcatgcaaacctgtacacatatgcacattgctgggtgtattgaaggacgcatcgcggttttccgcacatggatgactattaggcgtcaccacaggatgcacaacttcatggccagcatcacaagtttatactcatcacattggtgttggtggatacagattgagattgaattaaaataggaaacaagcaatatgtaaaagataccatttgaagcagttgggagtgttatttgtaaagacatcacaattctcgtcgtatctttcaacggcacgtaacgacttgtttccaaccttgccccgtcaatttgccaaaccggaaccacttatattggttatgtcagcaagagggcctaagaaaggaacacatgggtgaaattagcatgcaaagagtttacattcgagttaataacatgcacatagctaacctgattttgtagttgatgttgtggagcccccaacaatcttatccatttctgaaaaacaaaacacatcagaccgcctaaatgcagtaatcacacttcattgagtctggatgttttcatcagtaacttcacaactcagacacagacatgtaaaaccagtaacttcacaactcagatatatatcgttggagagtgtaatattcctagagtgatggcagtgaaaagtaataggagatatttactgaatccaatataaaacatgtgtggcagtaacagacatatatttggtgcatatgttaaaaaataaattaatcagagacatgacatcccacaagaagcatcagtttataaactgtaaaaccaggttatatactacctgaaattaaagcaacaaaattggattttctcggggaaagtgaacattaggggttaaaatttacctagaaaggatatatatagagaggtgcagcactaaaaacaccaggatggctgtagcctacaagaagataaattagacatagaatgagaaaacagagaatgaaacagcagtgagctagcctagacagtgctgattcttcttaattgatctcacactgcaccccgagagaagaatatggcgatctggggggagggggaaccttgcaattaacgaaggaatgggaaggggagggagagatgtttacctggctagcggcgtgggggcgaggaggcgcgaaggggaccagacgacgagtaatcgacgacgacttgttggaaacccaatgtaagaaattcaatcaaatgctgaaaaattaaatgataaattataaatcagagaaacccagtgtaagatgaagcttcattctgaaatgcaataaaaagggattgccttcatgataagcaaaatgtatataacagtatctgaccaaccggtacgtcctatcactaaacataaaccaaatgtaccttatcctatcctatccaacagccaccaaaatttcaatcccctaaaatattcacccatatagatgtggggaagatgaggccaccggcgtgaaggatcgactcacaaaccaaatgaaacttatcctatcctatccaacaatcacccaaaattcaatcccctaaatattcacccatacagatgtggggaagatgaggccaccggcgtgaaggattgactcacaggcggacgagggtgcaaagaagagcctccaagtaatgcataatgcataataatatggtatataatgcatatatccatgacacacaaaataattcacaatggcgttgatatcaatatttattacatatatttacactgtttctcatcgagattgatacttcttaattgtaatttgtgagaatgttgtaccataggatatcaaacatctagtatttgcccccatttaatatttgctttctctaatctgatagcccaaaaaaaaaaactgccaggatcccacataataacacatttactcctcttcgatgcatgtggccagatccttatattggttcaaaattactttcaggataacagagggaaattatcagtgttttttcaccatccatgtgtgtactgacgttgtgactctcagagcaaacctcttgctattgtgtgttatgcatcaccacgcaatgcagactgaactggagttcttttttttgttttgagaaattcatcgacactgacgtatacttaaaattctcgtgccatttgcaaagcggaaatttcaaaccaggaaaagaagactaatttaaatgagacacacacacctgaaacactgatctgatgttgaggaggccggaagctggcagcaatattctgaagttaaattcaactgcaatataggaacgtcagcacatctactgtcagaaaattagatgagtcaatctgtaattgttgtcatacagatttagtttattagcatctaataagtattggatgtgactcaacagaaaagtgattacatcggatgcaaaagctgaagagcaatttgaagtgtcattagtcattacctgttattagatacaaatcatgagtttagggatcccaacagcgttgtccattgctgtaggccaaggcgtggagatcaataaccacctgcacacatacagtagcatatagtttaaaagaatacggatcgattgctagattccacagcctcagccgtgccgtgggaccgagaaaggatcagtggcagtgagaagcagtcaccgtgtaaggcgtcggcggcgtcctggcgacgggtaccctgacaaaacatgccgttgccagctgtcgaactccaaattaggtgcttacaatttacaagatcaaaactgattgctctatcggaactatggacagcacaaaataatccgtcagtggttgttaaaatgcattttactgggttaaagaagccgatgctggatgagcagggtgtgattcactatatcattggggattttgacactggattctaaagtttttccatgaacagagtggcagattgtttctgcggcattcaatcgaacacctcatgtgcatgggcaaaatagctttactcgttcatcgcaatcaaaatcaattgggtagtataagtcaaaatagtttgctcatcacaatcaaaatcaaatcggaagggagaagagattgaaagacaacaaaagagaaaacttgccgtacagctctactggcctcaaaccacctctccgctcggtctcggcattgtagcggcgtgaatccctttcctcaggcgctcgggaagatgatgtcgatgaccgcggcggaggtggcggctgaggggataagcgtcgaagcagaggaggcgggtcggcgggcgatatagcgcggaggcgaccacgagaagatggatgaaacagcgatgggggaagtggcgccggtgtgggagatccgcttggggtgggggggggggggcgacgacgactcaggcgactccggatcggtggcggcgaagccgtcggcacacgcggaggcggtcgacaagtcggagattggggccggcgcggaggacaccggcgaggtgggagacggcgcggtcggcgattagggtgcgggcgtgcggcgttggaggttgttgagggggagagaaacgctaaaaaaaaacagggtgtgcgaacgatggggatgcggatgcgggggcatgcaaacgacgggaaagacgatatgagccgttggatttagcgatcggatggctcatactccgcgtgtctgccagtgttggagtcaccgccaccactatagaattttaaaatagcagagatagagcacttgcccacaccctatacagtatgccactaacttttaacttgctgtttctggctttcattcggtgacggacggcatgatgcatgcatgtgacccttacttcgctaatgattttcaggcagttcttagatcagctttgcattccacttggttaatctgcaagactacaagagggtttaatctgcaggttaggtcttctacttgctagagggtaggagaaggctctgatttaatattacaagtttttagaggtggggtcttcctcagctcatttgacatcacgatgttccaattaaattggcattttcaccgcacaacgccggccacaggccgcaaatgctctccattgaataatcccaaactttgtgttgcgccgcgcagcgcgtgctttgctttgtcatcaaaattttctgaaatttatcaacttcccgtctcaatcgtcagagtatactactaatataacagccacaggacaataactctgtcttgttcgattggtcttccgctttttgttcttactttcggtaaacaaatgatttgtctccaaagatctggtatgggttaatctggcccttttcttggagtcggaggccatggtttctgactatcggggtggttttgcccctaatccggttattagttgtctcccatgtcttgcagtgtaaatgtttctcatctgaaaatcgggtgattgtttacaacaaccgtgatggtgagttctttattagtagtaattaattattagctgctgtctaggtagcccaagagcgacctgtgaatctatgattagttgttgtttgatggttaagctctgccaatggtagagttttcgtagaggagagggcagccgtctattaactatattcaataggagtacatctccttttagcactaaccttagtacagtacctcgaaagtaaaatcaaattttggatctaaaaatataataattagatcctgagataacgaaatccaagcaaatcaaatcaaactcaggtttgtaggcgtacttaaaggaagttgcaccggcctattccacatgagaacaatatctcggttgcacacaagggatgcgtgagttcttgccactcacgaaagcaattctttggaccccataaaacaagcatctttcaacatcttcacctaatctttggccataatctttcgttcgcttgttttgatttaaccgtatatgaataattattcttgtgcctcaaaaccatccacccaggtcggcataatctgttgatgtctcatcatttgttggtggagcagaagaagaaaggagttttagatgtagcctctgcatgcaaacctcaaatattcagtctgacacgaacctacaactcattaagttattttaatctaactatattcgctttgttcttctctggtttcttggtttatgttggtttggggaggcagttaagtgttgccgtcatctgctagagggacttgcacactattattagggatgagaaatgatgcaccaggacttccgattgactctgcatcac

SEQ ID NO: 825 - DNA, 4558 bp, Oryza sativa
  unsure (1)..(4558): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtgctgaagtgggggtacatcaccttagaccaccttaataccttaaacaccactgcattctacagaccagtaaatggtccctggtacttgcagttgcagtctggtctagcattctgttctgttagtgctatcctcagtaatcttgattgtcagcctatgtcaggtctaatctgtttgactaactcaggcatgtaggatcttgtctggcgattaagttatggttgtgtcctggttccagtattatattttgttgtctgaatggcactgcacttctctatcatctaatgcatgtgcaatgaacatgtgatgttcaaagtttttcatagttgctattccctttttgtttcccagcacaaagaaatgcttctacagatattgcatgatgctcagagatattctgcattccggaaaggtcttgcaatgattgacatttgtcaggtacctgtcagtttatcagattctgatcaattattatgcactattatgctgaacttgtttgtaattagatcaaactttttgcagctgaaaaatgatcctgaagaagtactaaaatggctcaaattttcaactggatggtctgtgctgcacaatagtgagctaagaattggtttaaaggttagagctaccatattacataagctgaacatgtttcataagatgaatctaattttgtcatttaatatatgtacattcttttcacagaggcacatggaccttctgaaggaacacgaggggaataaaatgaacccattgtccatgcctgaggtagaatggcatcttatttggcattaatatgacataaaatacatacatgccatgcctagaatagaatgtgcgtgtgtgtttgtgtgtggattttcatgttttgatgcaattctagattagaatatgtattcaataatttaatgctttggggttatgttgtcatatcagcaggcaaaactggtaaaatattcagacgcttaacataacatctgttgctccccaatgggaactaaatcatatctgtcagccatgtttagttacttgattcttcaaaaataaaaagtaaatgatagttggttcacaaatacctggatctatctagaacaaacggaagacaaatcagtccgatttaaaggaatatgtgatggagttcaaatggtcactaaagttgtgctgcatgcacattttgcactgtaaaaaggtggcatctgctgacagcagcaaataagtagagaaatcaagtttctaatattctttgatagtccctctggtcataagtatttgacagttaggacaagatttggtcaaattttaaaattttgaccatcaacaatttcacagatgcttagcttaaaaataagaagaatggtatgcataggtttgccctgaacaatactgtcgtaaactcatttgatctataaacttattctcatataaaatggaaggtcaaggtatacaaaatgaccgaatcttgtcttaaatgtcaaacatttatgactggaggaagtgttgtttatcttctccctctggtagccagatgtggaaatttccttaatttgtattgaaggcattgaacctccgtttattgtataatgtatcttggagtaaatctgttttcaacgactgttcttgtgatcagctgagattcagataccttctagtgctgtaacccatcttgccagatgttgcatatttagaggaatgctttccccttaaccggcaatgtcatgcaaatttatccttagataaacacttgcatattttattgcatatactgaagaatgaagtgagcacatgatttttccaatagtagactgctgatattttactaacttggcagaattgaggtaactttagagtccttttgggggattcagtttgcaccaagaacttttgacactagttttttcggctacttttgttcagaactattgttgccatgtgatgccatatcaaggtttcatcttctgtgcctgaactggttcccacagtgggatgtgaactacttttaaccagtaataactggtgggacccaccactccgctagaatattgaattgttttggattcccaaatttcaaactcaaaatttaaaatgagttggtgattacattattattcacagatttacttttgatgcattatttgattgcccgatctttatgctagataccttttttctccaattgtccaggatgaaaatttagttttggagaagataaatgcagagctgtgttcagaattggagaaaatgataggtacctttgactgggtaagttttttgatgctaagtgtagcttcctcatatccttatatttcttctttagatgtaaatttttttgtctgcataatttgtaggcacttatgagtcagtattactacaaggcgagatttagcaactttgcaagacaatgtgctattcaagcaagagcgagtggagttattcttgttaagcaggtcagattcatttgtcagccttaaaattggagacattcagtcagcacatgatacctagagatattttgattgcgctgctgcctgtcccatcctcttatatgcaaatgcaatattagttttttccatcctcttatatgccatcctttcatcagcacgttctgtttactacaagtgggggaatgaattataaggccattttattccctccgtgataaactccttgaaaatttgtgaggagccgcaatctttatgtttgcacaagtttgttcaatataaaacagaaagcacctgtctgccaaaacggccacaaaaatgagattccaagcctgtctgattggtctcatgtgaacagttctgaatcatgagttaaccttgtatgttatttttattgcaggctctacctatacgagaaacttggaaggaacagaaacaatccacaagtccaaaagtgtcaaagttgtcgctcgaggattgcttaggctcactacgtcgcccactacgtagaataaatgagcaatttggtagaggtgctgctcgtggtaagccgtggctacttgctgcttttgcttcaatcgcaacggctgcaacagttggcatgtccagcacacgctagagatgaaggttgatatatgtgtagttcatgctctggtagtcgttgatggggccaaagctcaacactcaatttgtttatgttgtgtccctgttcgtagaccgtcggctaaatgattgagccttaatcgaaatggtggagctgcccatttttctttatatttgggccactgtaaatcaacatacaatcattggctactgtttccgcctagaaagtttaacaaagttaaatcatctaacattaatgtattttgataatatgtttattttgtgttgaagatactactacatttttcaaaaacgaattataatatgatgaaatgaaggaagtatttcacaaaatgtgacttttggagaccccactacgttgtgtgccagagttctcaagggactgtatctccgaaatcgtgacttttgtgaggctgaacgtccatgaccttctacatatagttggcatagcattctatttggaagggaactcgtggagaaacggatcagatggccagttggaattggtaacaaaattaggatcttggctgataattggattccagggaagaatgacgaacaatcggcatgtgatagtgatactgttcggagcttcttcgaggaagatatagccaacgcaattcttcaaattcctatcagttctcatggctggggatgatttcatttcctggtcactttcttgtttcggtatttatactgtaagtcagcgtataactaacatctaaaatcaacaaaaatgtgtaatttttttaactttttgcattatgctgatctttgtctgtgttgtgtgttaatactaacacttgtacgacatgctacagaagaaggaaaaagtacacccaaggtccctcaactatatatggggtccattaactatacaaaaccggtcacccgaggtcccttggcggttttgacgccgtttttgtcctacgtggcggctgagtcagcgtgggacccgcgtgggacccacttgggccccacatgtcagggtgccacctcatctctttcctcttatccctttctctctctcacttttcttagccggcgacgggcagcgctgtagagaggaggctgccggggcaaggggagaggaggaggtccggcagccggcgtcgcgccggcggaggcaacgccgtggccgtcagcatcctcgttgccgccgcgcgccgtggcacagcgccgcttggcggtcgcggggggagcaaggcaacggggagaagagcaaggcggcggcgggaggagcaaggcggcggggaggagagcaaggtggctgggagggggggggggg

SEQ ID NO: 826 - DNA, 5180 bp, Oryza sativa
cacgcgggtgggagctcgaagccgccccccgccgcggaggaggaggagaagaccatgacggtcggccgcgccgattgccgtcgagtggaagccgctgctgatcgaggtcccctcgcaggtgatcgacggcttcaactgcgtcggcggcggtggcgacgccacggccacggccacgctcagcgagcagagcaaggaactcgaaatgctgggcaaggagaaggacgttgtgattagcatcccggcgccggtgtacgctccacggtccgtgtcggtgtcggcggcgtacgaacaagagggcgcgtatataccgtactccgtgtcgctgagcatgccggtgtcgccgtcggggttccacttctcgcagttcgggatggcggcggcgaaggcgaaggccgtccaccgcgacgatgcccgcgtggcgtcggcggagaccaggttcgacgacgcgcacccgccggcggtggggagggtggagcgcactccccgcggctgctgatgaagcagacgtggttccactcgcagcccatcctgcacctgtccaagaacgacgagacgacgcggcggtgcgacagcacgcgcgacaagcgcggttcgaccagttcaagaccttctccggccgcctcgagcggcagttctccaccctgtgtggccggccggcgcaggagcagatgaccaacggcgagggcgccctgttgtggcaaaaccctcacacacgcgatcacttggataaacacaagaaaaacaaaagtgtagacgcgcgtgaaagcaacgaacacagatgaacacaagaaaacaggttttggtgccgcgcaacgtcttgtggcttttctggtttttctatctcatttattctccaaatgcataacaaactaacagcttcacctattcagccgctacaggcagccacttcctccgcgccatcccacgaagtgctgatcaacgctgcattctcggcgagccacacgcacacgcactctcggccatgacgcgaactctgcgcgcctctggctcatgcaacatgtaacagagaaactaactcgtgacagaatccaatgacctgccacggatgcacaaacaaatgaataactaaccagctaaatgtgacaggcttagtctaacacgcccccgagccgaacatcgccgaggaggagacggagcaggtccccggcgccgaccgctacttcgacaccctggaaggccccgagctggagacgatgagggcgacagagacgacggtgctgcccaaggacgagaagtggccgttcctgctgcggttccatacctgctcaaggtcgtgttctactttgaggcggtgcggcgggagttctaccacccgatccgcgccgacttcttcgcgccgtggatcgcctgcctcttcctcgtccagggcgtgccccgggcggtgacgaaggtgcaccacggcgtctggtatgcgctcatgacgccatggcggaggcggcggcatcatggtcggggaagcgtgggtgccacgactgggggcggaggcaacgacgaagttggagtaggccgtgggatgccgccggcctcgacggggttctcgcggcggctgcatcgctccccctgcctcgtccccttcagccggcgacgaggatgctgacggtggcggcgttgcctccgccggtgcgacgccggctgccggacctcctcctctcccctccccccgtggcctcctccccacagcgccgcccgtcgccggctgagagaagtgagagagaaagggagaagaggaaagagatgaggtggcaccctgacatgtggggcccacgtggggtcccacgctgactcagccactacgtaggacaaaaccggcgtcaaaaccgccgagggacctcgggtgaccggttttgtatagttaagggatcccatatatctggttttgcggtttgaggatgattttgtatctcgctgacaagatgagggaccttcggtgtactttttccacagaagaatgtgtgtgttgtcgagttgttgggcctgcgagcctagtgcggagtgggcctgaaagccaaagggaagactgtagatgccatcgaaaatggaaacgaaaactttgctactcttattcggttgtggggacttgttatagtggtatgagattcaggttcatggttgcgcttctcacattctctcgatccgaccagtaaaattttcatacgctatggttcgtggatacctttgggtgtggttgcggtaaatctagttatgatttggttggatttggagaagtcaccacaacgcccatgaagcttagtgcactgttgcgacaatctgtggagactatggacactggtggagaaaccatctttcgtcggtcggccgatttccacaatagtcccggatacaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccctggttggtgctaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaaaaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggaattgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataatatcacggctaaggcgtttgttcaggaacaaggggaatgctagaatgttgcgatggcacgctgaagagcgtcaacaggacgggatgctgagacaccccgccgatggttcgcagtggcgaaacatcgacagaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtaccttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgct

SEQ ID NO: 827 - DNA, 933 bp, Oryza sativa
  unsure (1)..(933): unsure at all n locations
attgttgcttcggcgtgcacggttggcttattatccggcctttgttgggggtttaggtcttcaccgaccggcttgccttcgccgccgccgattggtggttccgcctgcacggctggcctttatgccgccgttgttgggcgtatacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggctgccttgtccgccgccgactggtgctttcgcctgcacggctggcctttatgccgccgttgttgggcgtctacgtcttcaccgactggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgncgttgtt

SEQ ID NO: 828 - DNA, 1156 bp, Oryza sativa
gtgtgtccaattccaacataagccacccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagggtgaacaaggtaataataacaataacaacaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctaataaactccatataacaagcagaaacaaagcacaaaaatgggttcttgacttcttaaggaaaaattagagacttgaacggtccaattccgagttcaaatggtcaagttatggccatttgaaggttatatgctctttaaatgaatatttgcgaatttcttcatttaaattttaatttaaaatcggatttattgcgtcagccgaggggagaggagcgcgcggaccgggtccacaggagtggggcccacgcggcagcctctcggtccacggtggaccgggagcacgcggcttacgccggccggcgccgtgggtcccacgcgtcagccgcacctaagggcgcgggcggctgacagccgggccccacacggcagccgcggggcacgcccgaaggcggccacgccggcacagccgacgggaggcgacgcgcccgcgccccgatggtcgccgccggcgaccaccggcgcggcggagcggcgcccgagagaggggagggaagggggaaacgaatcggcggtccacagctcaccccgggtcgacggcgacgacgggaacggcgaccggagcggaggaaggcggcggcgcggctcgggtcgacggggacggcggcgttccggcggtcggcgggcgaaacggaggggtggacgaggtcggcgaggacgcggcggagccgaaggagacggcgccgaagcgggagaag

SEQ ID NO: 829 - DNA, 24395 bp, Oryza sativa
gagccaggccgcctttccccccttttgtgacactgcccagtgggcccgcttgccagccgccccctctccctctcttagtgccgctgaccagtggggcccgcatgtcggcgccgccccaccccttcctgacgtcagccctggggcaatattgcgcaataaattgattaaggcttttctttaatagtaaaaacacagagaatcttctaaaaatcataactaattcatccgagctccgattaagtccattcaagtctcagtaaattcataaaaatgtatagaatccattaaaaatggctttgttctctgtttcagtagtcttatagcatgttttgcttgggtgctttgtttgtcgcatagatttcggccgtttcgtcgattcgcggattctcgaagacgttgctatggtctcatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgcctaccttgggtattaaaatgactaaatgttggtttaggagatgcttagccatgcgtagttcaactagtgcacaaaagggggtcacattaaagcatagactttgattattggcaatagctttggattagtgccaccgcaatggtgttggttaattaaagtacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagtttttctctagccgacgtacccaggcaagggtgggcgtgatggagttgggtcggccggggtgtccggttgatcggcttccggattcaccgtggcacgaaaggggggctgcccgttgcctgctggggacgggggcgaaccctaaggtgtggtgcgatcggttagatagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcatccctagtttagcttaatgaactggtgtagttcaggtggttggttgggcctgttgcaacgtggcgtagcgttggacagtgactggttaatattgcttaattactacaactgtttttactattttcaactactggttttaaatgcctgctttatgcaaatgaaccccgtagcctcctttggttgtatcctgcatcatacctcctcttccggtatgacttgctgagtacagtgggtagtactcagtcttgctctcttttcccccacaccagagttgaagtccttctcagttgaagatgtctcgaagaggttggtttcgtcgctgccatcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccccgccgcgtcgtcaagaccaccgcatcgccttgctgccagacactgctcccgtggtggtccgactgtactgctacccggcgcgccacaaggatgaactggaacgacggtgtcgcgacatggagtctcaaggcatcattcgccgcaagtcgtccgccttctgctcgacggtcctcttggtcaagaaggccgacggctcgtggcgcaggagtaaaccctaattaacaacgtgtctaataatcggaattgtcagggaaattttttttcgaattctctttgctttataccattaacatgatttttaatggaatattcagagcagaggaagcaacagtgttaattaatttgaaatgtcaggatttgaattaataattttttcctctccctcctttggtcctgaaccgttccaggttcactccccgttcgcggttcgtcgcattcaccaacccctttcgccgccttggtttcgttttgtatggcgagccgagtcctattccgtcttcgattatgtttctttttcctttcccgaaaatgcaccgcatttgtttccccctccttcaaatccctcattcgttttgtatggtgagctgagaattattccgtcttcgaatcctttttgccctccccctctccttctgccgagccgcgcgccaccctaccctcctttgccgcgtgcgccctcctctcccccttgtcgaacccacaccggccccaccatatccatctcgatttcctcatataagtcatcataccccctctttttttttcttcttttcacccgccaattcctagccttcacctcctcctctcccgtgcgccaccgccctagccgtcgccgccacccggagttccgccgccgtctcgccggtgagctcacatcgctcctatccatctcgtcggcacagtttaccgcggtggtttttccctaggttttaatctaataatcttgtttgtctagcgttgtcgttgtctctgtgtgttgccgcgggaccttcgccgccccctctccctctccggtcgtcgtcgcttcttggtgaggtccttgtccgttttaggtgtagtcataggttgtggtttttattgatgacattttggtttacacaaagtctgaagatgagcatgagcaacatcttcatttagtgttggaaaaattgaaggaacatcagctttatgccaagttcagcaagtgtgatttctggttgaaagaagtcacgtttctcggacatgttataaccgccaagggtgtagcagtggatccatcaaatgtggaagcagttactaagtggtcaccaccgaagacaataacacagatcataagttttctcggactatcgagtttttaccatcggttcattgagaatttatctagaattgctaagccaattacgtagttgctgaagaaagaagaaaagttactatggactccacattttcagaaaagttttgaggaacttaagaagaggttggtgtttgcttcaattttgatcttgcccgatcagaggaaggattttcaggtgtattgtgatgcatcccgtcaaggattggggtgtgtgcttatgcaagaaggcaaagtggtcgcatacgcttcacgtcagttgcacccgcacaaagataaatatccaacccatgatttggaattagcagcagcagttcatgctttgaagatttgatgacactatttgattggcaaccattgtgagatatattgatcacaacattctgaagtatattttcacgcagcctgatttgaatctccgtcagcgaagatggttagagttgatcaaggattatgatgcaggcatacactatcatcctggtaaagccaacgttgttgctgatgctttaagtagaaaaagttattgcagtgcattgcgtatgaaaggaatgtgtagtcagttgatataagacttagagcgtcttagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactaggtatcctgcggtactggagggttatagtgattctaactggatctctgatgtggatgagatcaaagccactagtggatatgtcttcacactgggtggtgttgctgtttcatggaggtcttgcaaacagaccattttgacgaggtcaaccatggaagcagagctgacggcactggatactgctactgttgaggcagaatggttgcgtgatctattaatggatctgcctattgttgaaaaactggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgaaaaacctggcagatcccttcacgaagggactatcacgaaatgtgatagataatgcatcgaaggagatgggtttgagacccatgtgagttatactatggtggtaacccagtcaatgtgatcggagatcccgtgaattagatcctgggaagaacaaaccattagtaaactagaggagagtaccaatatataccctctccaagtgaagatgcatgtactctcgtgagctacaaggcaggttggctatgccttaatgagttttgttggctttaattagcgaagatgttgtcctgcagagcattcttgaaagaactcacctttgtgagcttgactgttggtcgcagtctatgaagattttgggtgaatcttctaggaagcttactaaagatctaagagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaatcggtctccatcgaaccgctggtatataaacagtacattggaaaagacaaatctagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctcgcctggcagggcaggcggcgagcgtgcacgatgtacacgtcgaatggtccgaaaaattggctcctcacccttgcgcagatgcagcctccttttgcagttttgttttgctgcaaattcggattcgtttttgttttggaaacgttccgaaaaatccggtgcgtgccaacggcgtggagtccggataagttacgcgcgacttatccggttcggttacgcgcagtagagatcgtgcaggcgtttttgttttggaaacgttccgaaaaatccggtgcgtgccaacggcgtggagtccggataagttacgcgcgacttatccggttcggttacgcgcagtagagatcgtgcgggcgccctgatcaagcgacccttctctatataaaccgacccgccgtcttcacgcaacacacgcgaaatcaaaatagggtttgcctcctactctgtactgcgccgtcgctcgtagactactctatcccgctcgccggcgtgcaccggcgatcgggagagcaggtctccggaacctctgccttcgacgtcctgcaccgggagaaggcggcaataaggtttttgggaagcgcttcgcgcgactgctccctattcgttcgcgacggctcgccttcctcttcgctcacgtgtttcgtgcgatcgtagacgcctgcgaaaagtttcgaccaagcaaccggtctttccgtcacctcggtacgtgttcaatatgttgcgcacatttgatctgttcatgttatactgtgtagtttacatgtgtagatctaatgatgcgttcatgctagttttcatctgtaatgtcatgatttatttatggaatagattaaatcattatatgcctataatctcaacagtggcggcggcgtccaggcgatttgtttgagatgatggcagaggcatgggcagcatgggatctgtgattgagtctgtagattgggcatcgagcaaaagattggaacatttttttcggggaattcgattttttcgatagtggttttatctgcatatgttttttctaggggatagtttgtcacttggcttttttgagaaagctggttttctagaagagtctctttacgcatgcatgaagcacctgcagcagttgaggattagtctcctgcacgacagagtagcagaagacagacaacctccccttttagactaagattaattcatataggagggccgaacttagagtatttcacatgctaaatgcagctttactacgcttttccagtgtcgtatatgctaaatgagatatgttattgaaactgatttgattactgcgcctaatgaaatatcttatgccattatgaattaaattctaatatcttcatctactcacttaattcaggtgccgcaagttgttgaaagtgaaagtggccgcttcaccctatcatatgttactttggcaaagctgaagtcttacgtaccatatgcatggggtttgcaacacatagagactgttttggtaaacgtgtggcagttggagaacttgcaaaacgtataatgataagacaaccttcagatgtggttttcaatgtgaaaaatttgatcggaaagcattttaatgactcttgcgtacaagaaatgaggaaaagactccctttcagcattattgaaggaccagaaggagaatcttgtgtagagattcatggaataaaattatctcctgttgaaatcaccacagccatatttacaaaactgaaggatatggttctgatgcaccaatttcatcacaaatttaaagtggtgatatgtgtaccttcctttttcaatgaacagcaaagggaagacatcatgtcagcaggtcgacgagcaggtttagagatattacaattgatagatgaaccgatagccgctgctctttctagcacaacaataaaagaaggtgttgtggttgtttttggcatgggtgctggatcatacagtgttgcggtccttcatgtctctggcatgaacattgaggtatttctttaagttcatttttatcttgtgcatagttttctagatcattctgatgttgctgaaccctgggtcaattgttttgcatgaacagatgatagcacaatgtggtgattcttgtatcagtggggatcagtttgacaatatactactacagttgactattgtgttacgcagatgatcaaacttcattcggtcgatgttcgtggagataaatgtgccatgagacaacttgtggaagttgctgagcaagctaaagtgaaactatcaagccaacctacagctacaatttctatcccttacttgacttcatctggtcaaggtcatggccctgctcatcttaacattaccatttctcgccaagagtttgagaagttagtgaataatttaacagaacaaattcaagagaagtgtcagatcattttgaaagaggctaaaattgctgccaaagatgttgatgaacttgtattgtttggggggatgacaagagtccccaagatacagagaattatttatgaagtttttggcaagcatcagagtgcaaaggtgaacccagaggaagctttggttattggttctgcaatgcaagcagctctaattgtagaagatcagcaggagatgagcaaagacatgattccactgtctataggaattgagtgcgaggaaggaatttttactaaggtcattcctaggcacaccagaatcccaacaaaaaggatggttaagattcctgcatggtgtgctcaaggggagtgcctacatatcagaatttttcttggggagcatgtaatcgttgatcataatacacttttaggagaagtagaattaatcaataatagaagatcatatgaaggtggtgttgattatgaattgacatttgaagtgagtaggaactatttggttgaagtcagtgtcagcaatgctgatgatgggagcaaaacaatcaaggccttcccaatagatgagaaggttgtatgcaagcataatgtgaacagagctgtcagaaatgctttacgtgactggtcaatgtatgcagcagaaatttatgctgacatgagaaacctggcaagacatacaataaacacactaagtgatgccttgtcagccagaaaggatgaacttcctaaggacctttatgaggatgcagtgacagcgttggatgatctgctgaaggcaatgggtaaggatgttagtgtgttacatgataagatacgtgctgccatgtctgttgaagtaactattctgaactggaggccaccatcaaaatctcatcctggtgattatgatgactactcagattatgaaaactaaggtagggtgtgcttagttcacgtcaaaattagaagtttggttgaaattagaacgatgtaaggaaaagttgaaaggttgtgtgtgtaggaaaattttgatgtgataaaaaagttataagtttgaagaaaaagtttggaactaaactcggccgcagtgcgaccgcagaaacttagagcccgtagaatttatgtttaaactagcttgttaagtggtgatgctatttatgcgacatgcaacttgtccttcaaatctataaaatccatacgcggatgggattgaagagaatattccctatcaaatacctcgcaatccacttgtgggtgggattaattgaagaaggccttgtagtttcacggtacattgtgatgtttcttgctgcatgcaccctgctgcaccttgcaacatgattgccgtgtttgatggcacattttggaggttttttttttttcatccagatggtgctttcctccaaagatgaccctgggatattccgtgtcgtgctggatatgagctggaataagtgcttgtctatatattatttcattagaaaaatgctgcgttgcaacccaaaaaaaaactaatgttacgataatgattatatttattttttagttccatgggagttataactgtaagcgacgacggcgcgcatttccctaccgcgggcggtgaaataatagttaattttaataatacaaacatcatttcagcatttatttaaataaaaatctaaatttctctattggccattttcagtccatttaatgtctgagcgcgcaataaagtctaatttacctcctccaactcctctgatttcgtttgttggacctgcccgccttccctcagcccataaagtatgcgtggcccgacaatggtgtcagcccagacggctcggatcgcctccacaccattgaaaagcctaaccctaaccctctactctctcccaagcggcagggtcgtgcgagcagcgtcggcggcgcgcaaacggtggcggcggtgccctccaataccacgtgcgacggcggcgacaccattccccaccacgagcggcgtcggcggtgcgcgaataacggtggcggcgccctctcataccgcatgcgactgcggctacacccttccccaccacaagtggcggcggggtcgcgcgagcggcgtcggcggcgccctcccataccgcgtgcgacggcggcgacctccttccccatcacgagcggcagctgaattgagataagttttgtgcgctttttattatttttcccgttctttttcctttttttttattgtccgattggatttcaaacggatttacggatggaaattgaatgcgacgaaaggaaaaatgctaatcttttaattagttatatatatagagagaggacgtgtctactaactaactaccttaatctcatatctagttgttacacccaaaagtgcatgtatttttttctacttatgaaattttcttttaaattacttatccgattacaccattacgttcgtaacaattaaatctttataaacatttcacattattatatttttatgaaaaaaatacaaattacttttagatttcattaaattattcttagtcataaaactaaatttaataaagcctgagagtaatttacatatattatataagtaacttaaaacaaaagtaaagtaacttgttatggctttaaaagaaatttattgtgggggtaaaaacataagtgtatctagaaattagatttaatcaacaattcaacatatcatagttacccccataacggatttacttctaatgtcatgacaagttactttctttttcttttaagttacttctataatatatgtaaattacttttatgttttattaaaattacttttatatgtctaatatgtaacttaatgaaatataaaagtagtttattaatcatgtgaaatcttgttataaatatttaattgttacgaatacaatggtgtaatcagatcgtagatcgggtgagtaagttaaaaagaaaattttatttgaagcataggttttcttatacattcataatgttgtgggttgtttattctataatcatttttagtcaatgaaataatttgtgctaattaaatttaatttctatatagactcatgtttttacctccgtaacagatttacatttaatgtggtgacaaatttactttctttttgttttaagttacttctataatatatgtaaattacttttaggctttattgaatttacttttatatgtctaagaagtaatttggatatattataaagtaatttataattttcatcaaaatataatcatgtgaaatcttattataaagatttatttcttacgaacacaacggtgtagtcagatcgttgattgttgtgtaatcagatcgtagatcggatgagtagtttaagagaaaattttatttgaagcataggtgaatagggtctctcattagcattaaaatgagaggcctcttgatttagatttttccattctctattctgaccgactcgcccaatcgactaattgccgttcagttggggttggggaggcggcgctgggttgagccgacttggctaatatttcgttcacgtattattttttgagcgtaaagagatattttattaatggcagaacataggattacattcatggttaagcggtacaagaatttctgacggagcctctactttgcttcaactcctgatctcataaccatttgagctaaaatatgagctatgttatttgaatctctctttatcttgtgcacttacacctgcaccagacattgcaccgcagcttttacttcagcaataatacctctccattctgctcttgagtcttgtgttgcattcagtcctgctacgacgtcggcgttgtcggattctaagattattggcatctgtacccaattggcagccaattggacaccctccaggcaagccaaagcttcagcctgagcagctgaactgcatcttgatagtttcttacaagctgcaagcagaaccaaacccctgcaatctctagcgataattccagcgcccgcttcacccatctccttattgaacccagcatctacatttatctttgccactccctctggtggaggttcccatttcattttttgtgcagcattgatttctgctctcgctgggggttcttcaaacatcggtcttttgcccttcttatcttcaacattttgtcagacaggcaacatgcacccctcataattggccaagaagttaactgaagctgctattggactgttctcacttccatgcatcatctcatttcgaaggtgccatgctctccacagcatatatagcgtgtgtgccctttctatctcgttcgattcatccagaagcagcaaaagccaatccggtccagttttaacaaatttattttcgaggggtagtcgccagacatctctcaacaccttcctaagtgctttggctttagtgcattcgaccgttgcatgaaaaccatcctcatcagttaagccgcacatttggcatgtgccctgtctttcaatttttcttctgcatttgttgttccaggttggtaacctgtcaagagcaagtttccaggcaaagatcttgaccttggcctgtacctttgttttccatatggacagacaaagtttcctttcccctaaaattgctctacttgaggtagcttccacaacattcctagacagattccaggccaatctgtaagcgctcttaacagtgaacaggcctgttttttccaagtgccaagcagggaaatcctcaagttggcgagtatataatctaatctttagaatctcatcagcatcttccttcttcattacatggcgaatcagattttcattccaactcctggaatcaacatccatccgctcggcaccgcccgccgccgccgcgtcctccccgcgctccgccaccgcccgcacaccgccgccgcatcctctcctgccgccaccgctgacctgtttgagagagagaggaagagagagagaaaagagagaggatgaggagaattgcaggtgggtagcacatttttttaataactagagtgctgactgggctgtcacgcgtatgccacgtagaccaaaactaccgcggattgggtcgaggggggtaatttgtccggtttgtatagttgggggtgaagaatgcctggttttgtggttcagggggtaattcagacgaccgtgatagttcgggagaggggggtaattcgtactttttcctttttaataaaacaataagttcgcctagtccaaaagtttttacagggcatcaagaccattgcaacgtatgttatctattgcaaagtggactcgggcattgcaagatactcaatctttgcaacacatgttctgcaacacatattatctattgcaaattggactcacccactaataattgctagggtcgcatttcagcaacgcatgtttaatgcattgccaagcatgtattgctagaggggggggtcctgttgtagtgtaacagcttgaaacctaggattatgagcagttttaatgtaattttcaaatgcaccactctcaccaaagtttaagggtaaatcttgtctagcaattaggcggggaagagattcttgagctaccataggatcgtactcccatgtacgtaccaaaccatcaggatttagtagcagttgttgttatcgcaactggatcccttgcttctttgcacaacccttagcatgtcatctcaaagtatcctgttccaccatatgattttgtggataaattatgcttgcatattctacatttcgcgtatgttacctgccttctgtcaggacctgtcaaggcggtcacctcatcaaaatgttgccaaacctccgaagttcgtgatctctttgagacagtgttcgtcgatgtagtcccactcatagttcatgaaactcctgaagccctcagtacctcatccaaaatcggtggttgttaacgaccaaatttggtaatccaagtatcggagatgaagatgggatcgaagcggaattcgagatggagatcactctggaaatagagaagggatcgactgaagttcgaatcggctgcgaccaggatcggccgagtccgagttggacatggttagccgattgagccgaatccgacaatatgacacggcatacattgtcgggttgagttgatgtacttcatgaggattgccacgtatggatagagtcctgagaaggcaattgtatctattaattagatattttatgtaatttccttagagatatgtttgggcaaaagtctgccgcaaagacttatggtatcttagagtttgttagagataagagtcgtatccgacatggacatattttgtaatctcaggtataaatagaccccgagctccatgtaatcaatctaacacacgttcaatacaatctcggcgcatcgccacccttttactttcgttttgtttcgacgagttcttgctttcgggttgagctgcatcggtttcgatcttcaactagaggtaaaacttgttatggcggcttgcgttctcgggattagtgcttccatctttatgatactctaatcttgtttatgtaactcgtcgagttatcatatatcttacataatcttcggcaatatcgctatctaaccttcaatcggttagcgtctgttattagaaggcagccgattaggttatatatcgacgttgatttagattatataggatatctaccactttatgaaacatccaacggtttgattatctagatattgtccttcttttcatacttatagctgcatcagttgagttagaccttataagtcgtgattagaatctcaatctctagtctgcttttggttgccaattagagtagtatcggggtttcagccgatctttcctgatttaactaaatttttcctatatgtttgattgacatattaaatctgccctttatcttaagattttgttgcatttaagtatattaggctttcgtttgatatattttacttgctttgatatcttaatatagagtggtatcggagtattagccgatacatgctagatctatttgatcggctatgctataaacatatatagtcttgttgttaatatatactttgatctaagtgatttatattgtctcggcatggcgaccgatctatcccaatcacttgatttaaatgtatatcgacataaggattatatattattaatatctacagccgatcgagtagatttagttctttcttacttattcatgattgccgatcgatccacatatgacatcggctcaaagataaatgatatgtcatcggcaactagccgatcgactatcgtttatggatttaacagcggtttctttgtctttgtttctcgttgattgcaggatcaaatcaactggcacgctcatacacctaaaggcaagcttttggacctgcactggagttaagcagatctcccaggcctcatgtttttacatcaacagttgtgttggcgccgatctggtggcatcatgcttgctaggtgggaatgaccccaacaggtaagtaggctcgaagccagataacgtgaacaatggataactcaaatcgcccatgctgaaatattacaaccacatgcacaaaaattcagaaactttattcatataacataaaatatgaataatgcaaaagtattatccacttcctttcttacctcctttacaccttgtgcgtgcagctttgttggaaaattgtactccacaaactatttttttatttttgaacataactcagaaaatcgaactagcacacaagaaaacacaaaatggggggtttggatgatccataatgttgacggtgcgtgccatgtccattcttgacggtccttaaatcataatatctgaccgtcaatacctgcatataatgaaataaaacatggtatccaacttagtggtaggtattattactaatcatttccactagtgttggtgaaacatgtgtatgcaggtaatttgaggagaaaacacatccgtcatgtgacaaaatgcacctccgcgcattcaggacgcgtttacacggattggagggccaataagtcagtaaaaaccatttagaattgggccaaaacatagcccaggttgttgggggcccattaagcaacctctcggtcgaaggagaggccgggaggagtgtttttgggtttggccgaacccattagttcggccgaaccattcctggcgcctcccgccatctgcttccacgtggacggcttggattcctcccctatggcagttgcatggtgttttggtcatttcccatacccctaaccgtcatttggagcctatataaggaggtcttcatctcacttcaagaacacacaactttgagctgaattacaagaggctctattgtatcttttgtacattaaaataaggtagagagtgaggggaagctctagaggagtgcccggaagtttggcgctcatccgacttctacctcgacgagtgtagcttcctaggaggaattctggaggaataccggagttgtcggtacactctgctccgggctcagagaaacttcttctattaaataagcattcatgatcctttcttatgttatttaattacttaatctgaataagatatatttccatctttgcgggttcattgtttagtattcatattaagtgctctagtactaggattctggataaagaaggaagttcctgtacaagtattagagtagtaattaataatatagacgtggtgtctaggttagagattacctttgtttgttgtgtatatcccatggatttgttagaggtagacgtcaggtggtgacagccctgaattccgtcccagtaatcctccacgttcagatacatcatagagctatagccggaaccacgctggtaggggtgggcccacttcaattcatgggtattcaaatgaatacccaagattttggaacaaaaaaatacatatatgaactatatattccatatgtatacatagaaacaaaaggaaaaatgcttatatctattcaaaactcgaaagaagcccaaacttaaccctcccaccacccaccatttcaggcccgttggcccaatagcaaaaaaaaaaggcccaattcctctctaaccctatctcatctcctcacctccctccccttcccatcctagccgccacgcccacaccgtagccgcacacgccgacggagccgtcgccgcgccatcccagccacctgcccacgcgcctcgccgtccccccgcgcccacgctccttgcccgtcctcgctgtcgcgacgtcgccgcccgccggtcgtgctacccagccggccagcctactagtcgtctgcgcgcgcgcgcggcgcgcctcgccgtcgcccggtcgccggctgcccacaggccatagccggctccgcacctcgcgcctcctcggccttcgccgcttcgccgagtcgccggacgtcggctcgccgcctccgcgtctccgcatgaccgcacctctcgcctggccggcggtggcacctcgcgcccggtggccgcctgcacgcctcgcgccctcgccgcctccggcctcccatcctccgtccttgagacctcaacagcagtctgcaacggtgagtcggtgcactgaagtgttgattattttagcttcatattttgtgaaatgtgaatgactatctagattactagattaggatttaggaaccaccgaaccactactgctttgctcaattgctctttgataattgatattgttgtttgtatgtttgaaacatgaagagaaaaaaggttcccatggttaatttaaatttgatatgttttgtcaatttatagtttagtaatgtactctaatatgtttaatgcattcaatttatggtaaattctatccatttatgactttatgaactcatacttataccgttacatattatacaactattagaccttgggttagaaaattttctctcttacaatttcgaatacccaagttgcaaaacctgggcccgcccctgcacgctggcagaccagcaggggtcggtgctcgaagcaatagataggaaattacctttaacttagcttaggtaactaaaatacatagaaagtcctctctagcctgcctagcctacctttagttgttgtccttggatagtcttagccttaggtagattacacacgttccctgagttcgatatccttttggggtcacccgaaggtgaagtgctacagcggtatcccgtgcgcttgcggatttatctgtggttgtaagaaataccaacatccataatgctacaatgttcacttttaaatctcgtgcgatttccattgggcaggcggggacgcgtgagcgcgagaggattggcgtgcggcaggcgtgtggcacggcgaccagagcgcaatgagattgggttggggcgcagggcaaggcgccgcgggagcatgcatgcgcggagattgggcgagagaggtgatgccactcgtgctctgtcttggcgggggcttgcaccatgcgcgcccattggtgttgacgggaagtggcatggccgcatgggcttgatgtgacggcctactataggaaccgtgaagtgtcgtgccagcccacgggctgcaacctcggcccaggcacagcacggcccagaaacttccatgaccattccttgcagggccgggtactgtagtggtgtgccagggccgacccattaccgttcagcccatttggtcagctataggctgggataggtaggcccctcttgtcatcctcgacctccagccgccgctagctccaccctatcgaaccctagcaccgccattgccactaatctcatcgctcccgatagtttctacctacgccacatgggggtggaatactcctcgtgactccctctcccatttcccctacttttaccattccatcttgcgctaaatcgctcacattcaatcacgttaatctcgccggtgccattgatggaggccgagatttctatcgtcgtttccctctctccttggcctctttccttcccactaaccgctataaatcgatgtacgcacctctgtcgccccttttcgttcgccattgtagctcctcgcgctcctattttagctcgtaccatcactccctctctttgccacaaccgtcgacctctggtcgggctttgccgccgtccgggacctcatctcaccttggcgtcaatgcctccagcttcgctgcatcgccaccgacattgtctacccattcctcttgcttggagaccgctagaacctcgccgtccctatcgaccagagtttgtctgccatcttcttcctcgccggttgttgttcctccgccaccgtcgcatttgggtgagccatggacctctctggccctttttcctccttcccccatcaccacgcctatggtcgccggtggtgtccataggggcacgggcgccgcctcccaccggctgcgcctcgtggccgcttcacgtggggcccgcccatcagccaccatcgtccgcctcaggtggctgacatgtggggcccgtgagcgcccacccggtggccggtgcgtgcacccgttccaccttggtccgtgagaatgacacataggtcccaccccatggactcgatccatgcaccatctctcctctgctggcacaataaatcatttttttaatcacaaataattcaagaatttggaaatattcatttaaacaacacctaaacttcgaatatccatatcttggtcgtttaggctcagagttgatccgttcaagtctctatttttcccttaagaagtcaagaactcatttttgtgctttgttactgtgtcttatgtggattttattagagtaaaagcatttttcctttccattggtcgtgtagacgctataagttcggaagatccgttttacttttaggaaagcaagcaaggcaagtcacatctcgattgaaaatattgttgtccgatgattttaaaagcattattttaatttaaattattatattactgctttatctaaattcccgtgttataattgttttatttagccattcttactgcttttgttatagctctattattacttagtgaatactactttgttcaccctaggcaaaaacaaaagccccactagtgaggactctatatgtagtacctctagtgaaactagtgaaagtgtaggtagatgcttagcccgctaattggacaattagttatttcacaatcttagattttgggagttgtattaacatcattgagacatcattaaagtgtaggtagatgcttagcaacgcacggggtttctgctagcactaacaagtgagagagtccccataggccacctgaaacaaaggagtaatgggctgaaggggtaaccccagcaaccaagcaaaattgtaatccagaaaactgtgagacctaccagaatcaactaacattagcaacactttgttttgcataagggttctcaaccgaatagctctctgatgactagaacttgacaatacgtacagagaaatactcctttcgttttttaatagatgatgccgttgactttttctcacatatttaaccattcatcttattcaaaaattttattcaaatgtataagatataaatcacacttaaagtactatgagtgataaaacaactcataacaaaataaattataattacgtaaatttttttaaataagacgaatgatcaaacatgtgagaaaaagtcaacggcgtcatttattaaaaaacagaggtagtatgacaatcctcctcatggtcagactcttcctcagctataacagcattcaacaactcatcaggaatcacttaagtaattttcattgatctgatctgaccaatcactgcgtgcatgtgtttaggagaatacttatccccacacttaaagcagagcccattagctcttctctttgaggtttaatggccaatgtttcagctacagcaggtaacccttccaacgtaggaccaaccctcttataagtcagtttcttcacatattgctgagattgttccaacgaaacacattcttgtgtcagagcaacagcggctgcttgctgaattgtatcaggtaattaagtggaccatcactgcatttcagatttcctcgagacccaacacaaaacgacaaaccaaaatcatgccacccactgagggatcaaacaatctcactttgtaaactaatgaatcaaattgttgtttatactcagccacagtgcatgtctgagtcaacatttccagagctagcgttttctccctgtgtgtgttaccctcaaattccagcacgactgcataacgaaaatgagcccaatcgtgcatatcttccaccaccattgcgctgcatttccagtcagatgcaacacagttgtagaaacattaaagttgacaggaattttatacttctcaaaataagtttcacacatcaatccaaatacgcacataatgccgatcaaaacgcgaaaaatccttttttggcaagtaactctttgatcaaatactgccttcatgaggtctacttgattcagcctcaggtggtggtggtgcatcagtgctggccagagaaacaccgaaagaggacccaagaatagtcacttaatcttcaccaacaacatatgtaggtgtggaggcgatctgcttctgcagccgcgcagcttgtgactggtcctgctggctgctgcatcttccccaccgaatccaatgtgagatctactttggtgatcacttgatccaatcgcccctctgctcctccatcttggaatccagcgtatcaatccactgtgtgagtgtgcccaacttctccatgagtttggcctcccactggtggagtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcatcagatctatactacacccggcggattcaaatccccaaacaggagtagggtattacctctcattgagagggcctgaacctgtctaaatccttggtctctgcatccatccacttttaggtctcgtgcgctacccccttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaatgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcctcgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgcggccgactggtgtttccgcctgcacggctggcctttatgccgccattgttgggcgtctacgtcttcaccaaccggcttgccttcgccgccgccgactggtgtttccgcctgcacggctggcctttatgccgccgctgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgcctttgttgggcgtctacgtcttcaccgactggcttgccttcgccgctgccgactggtggttccgcctgcacggctggcctttatgccgccattgttgggcgtctacgtcttcaccgaccggcttgccttcgccgccgccgactggtgtttccgcctgcacagctggcctttatgcc

SEQ ID NO: 830 - DNA, 3993 bp, Oryza sativa
cgatgtcctcgcctgcacggctggcctattatgccgccgttgttgggcgcctacgtcttcaccgaccggcttgcctttgtcgccgacgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttataccgccgttgttgggcgtctacgtcttcaccgaccggccgcctcatctgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgctagtgttgattggccttaccatcttcatcgccggtcgtctcgtctgctgctgactagtgccctcgcctctacatctggtttatacagctaccactaatgatggacatcatcgtcttccgccgccgactcgtgttatgccgccgccgactggtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatctttattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttattccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacctggtctatattacccggaagatttattactcggaagcatgttacatgcgtcatcctttaaagggtgtcgaaggcatattttttggcctaggcctaatatgtctgcagcccatattttcaggtgtgacctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttattcactcggattttacaccacatatgccatatatttccaggtgtggtgaaaccatgtgtcttttagggactaaagcacgtctgttaaagcagtgtgcgcatggcgtatgcccaatactttagaaatttatttattcacaacatacaagcttctttatagctgttttgctatgtgaatttttaatgatgtaaccaactttaggttacactcatcatattttacaaagcggtcggtatatcactcggatcatgttattcagggattcacaccgcatatgctacgtattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcatatttggtaaaagtacttcggagaccatggcgaagataattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcatcagatctatactacacccggcggattcaaatccccaaacaggagtagggtattacctctcattgagagggcctgaacctgtctaaatccttggtctctgcatccatccacttttaggtctcgtgcgctacccccttttattattgccgaaatcatgtttcgacatggagaaaccctttgtagtcccggttcgtaacccccctttagtcccggtttccaaaccgggagtaccaatccgggactaaagatcgagctgacctttttttttttttttgcatggctgtcgcgaccgggaaaattgccttttcccgaacgctagtgtattaatccccgtcccaggaaaagccggggtacaccacacaaacatgatataaaagacacatctttattatatcgataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggagatgcgtaattaat

SEQ ID NO: 831 - DNA, 10915 bp, Oryza sativa
cggaagatccggccgccattgatgcgccggcgaagtttgcgggagcggtttccaaccgaatccgagggagagagggagggaaaattggggggaaagggagagggaatcacggggaataattccccccactttattgcgcgcggggacggcgggaggcggcgggattcgcggcggcagcggcgctagggcgcgggcggggcggcgggagcggcgggaggatagggatgacaggtgggccccacccgtcagcgagagtggcgggcgggcccgcccgtcagcggcgcgcgcgcggggagaggccgagtgggccgcggggagaggagggagaggggagggagatgggccgggctggccagagagagagagggaaggaaaaagagagggagggagagaggactttggccgcgggccgagagagagagagagggaggtctttgagccagacttggcccaaagggaggagggggattatttttagcttttcctttttataaaatcattttaactttgtttatttcttaacaattattatttgtgctctgaaaattccactaaaatttgagggctccttttagaccaaggagaatttaacaaaaattctccgggccacatttgaattcttcttgtacgtattttaatgtttgccaatttcttttcgaattttaattaatactattattccttttagggaatgatttttaattcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaaacttgcctaacaaaacttctccactctaggctgcttggctcgatcccttgttgcagagggaatcttctcttcacctgacttgtccctggttgaacctttagctgacttcgactgggttgcggcacttgaagatggggcttcagttccagaacttcgcatagttcaaatctttggagtcaacctcatacaagttacccacttcatgtcatgcgtcgagatcagctcgtcattactaggataccatgcttgtcatcgggagaataccatgcttggcgtttccttccagcttaccaccatatgctttagactatgatatcccgcttactaagaataacatgattgacaacttgccactaattgtctcatattagctttcctggtctccggtgctagatatttcctctattcaatgtgagggtcgataactttgcctttgaattatgtttcccaagggaaccaaattatcctacttgacatgctttgacgtcttcccaaatgactttactgctggacttgttatggtctgatcgttatcctgccaaatctgaagcttcgttgttagatgcgattttaatctgacctctatagactatcttcgaacatatcacttggttcataactgggaatagctcccatgaacagacaactcggattcactttctttacattcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgtggtcatctctcttactcgtgaattcacctactttaatgacaaggcaactgttgtagggttgtttgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacaattgttgcctttgatccgaagaagacacatctgaaactcttagtccaaacaaatgtctctttggttgatcacttgattttcttcgctatcaatcgctaggttatttgattcctaacagattatgggtttacggaaatgagaccctaggtctccctaatcaacaacaaaatgtacacaactcacagcacttgcaatcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgcatttgctccagtgaccacttggcgattggcatgtctgcttccttaacaggtactacagtttgtaacaggcaataactttcttacgctcgggttcttcatcttgtacttgatttctttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttggttcctctgtcctggcactggagttaggctgaaactgtaatcttggcgaggatttgtgttgccttgatgcttctctccgttggaactggcgggttggttggccatcttcttcgtcagcagaaaactggattgacaatcttttggtacatgatcagttccttcacaaaagaaacaagtgatcctgctcgttggacacctgtcgggtggatggtcttcctcacaatgaaggcagagtgtgagacacatgctagcaacgtgtccaatttctccacaacgggtgcatgcctttgattccatctcttcctcgccgagatgtcggggagactcatcttcatcatccgaggagacttgatcagatactctgccaccatggcttaggaggtgctgggtcaaccgtcgtgcacctcggaaggtatttcctctttgacgtctaggaatagttatccctgctggaggccattcggcgctggtaatagtcatcttacgtacttcttctttagttcgcatcggcgcttttctcttctgactcttactcttcttgcctttggcttgcttagtacgtgaccccacgtggtacgaaaggctaggaggaaagcaattctcgggattcaatggattctctccattgggctctctaccttgcacactaggctgcaagcttgacttggtgcgaggaggcgggtttagcgatgtctgccctgctaaaccaaaggaaggggcttctttggcatatacccatggacaattcagggcatagtgtccttgctctctacaatcatgacaaaaggggacatgctcttctggcattggaagctcattgacctgggtggcaaatgcttgatcaaacacatactgattttggtcttgacttccaaccaatggtagctgtgaaccaagcagcatgctcggaatggaccaagggtgtgcccttgttaactctcttgaggccagtggtggattgagttgaaaacttgagttactggaggcataccctctgacattcttttctttttctctgttaaacatctgttacagggattgaggtgagagaggaaacaagctaggaaagaatagaccagaactagagacaggaccttaaaggaactaactcttcttgttgatgtgttgtttgtttcacttattctgcaagttgattaagcaaacaacctagcatggttacatcacaccccactgatgaaaaccacgcgctacacacacaagcaaggaaacacacgactaacgactctaccctagagggtggcttaggttctgcgacgggttctccaagatcttcactcctgctttacagctggcttcactgcttccttcgcttcgctagcggatcctgcagtcttccggagcttcggcaaacaattggcgacatcttcttcttcgcaaaactaaccatctagtactagtggaaatccgaagaaggaagaagggagtaaaccttttgcaaatagcattaggggaaggagaaaaaaggaactttcgcaaatagttttatttataaaatatgtccttaggttttatccactgggcttatcctacagtcgagatggctctgataccagcttgtcgcgaccgggaaaattgccttttcccgaacgctagtgtattaatccccgtcccaggaaaagccagggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggagatgcgtaattaatgcaagggagtacaaggggataataatattggggttaagttttgcagtaaacagcatttaaaagtcacttagttgcccaaagccattttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggcaggcaggattgagccccctagcagcaggacaccggccttgtgccatgacatctcgactaccgggccgcagctcgtgtagccttcatttgtcctagagatgtccatcgacccccgacttcgtccatctccatccgtgtacttttgtttataaccaaactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagggtgaacaaggtaataataacaataacaacaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctaataaactccatataacacgcagaaacaaagcacaaaaatgggttcttgacgggggaaagggagagggaatcacggggaataattccccccactttattgcgcgtggggacggcgggaggcggccggattcgcggcggcaacggcgctagggcgcgggcggggcggcgggagcggcgggaggatagggatgacaggtgggccccacccgtcagcgagggtggcgggcgggcccgcccgtcagcggcgcgtgcgcggggagaggccgagtgggccgcggggagaggagggagaggggagggagatgggccgggctggccagagagagagagggaaggaaaaagagagggagggagagaggactttggccgcgggccgagagagagagggaggtcgggattatttttagcttttcctttttataaaatcattttaactttgtttatttcttaacaattattatttgtgctctgaaaattccactaaaatttgagggctccttttagaccaaggagaatttaacaaaaattctccgggccacatttcaattcttcttgtacgtattttaatgtttgccaatttcttttcgaattttaattaattctattattccttttagggaatgatttttaattcgggatgaatttatcaggacgtgacaaatggatgtaacaccctagcccaagacataataggattgataggatactcatgctaacaagttgtaacttcttttccggaagcccatctccaaagaactctaaagttaagcgtgcttggcttagagaaatctagggatgggtgaccgaccgggaagtcttcccgggcttcccgggtgcgcacgagtgaggacaaagtgcgcaggcactggacatgggtgtgtcgcagttgcgcaggcatggtgtgcatggctgatgtggacccggtatggtcacacagcatggcacttgcgctggcactggacacacggacgtggccaagagagggagttcctggattggggttgatcgacgaggacgtcgatctcttaagggggtgaggatgtaacaccctagcccaagacataataggattgataggatactcatgctaacaagttgtaacttcttttccggaagcccatctcgggtgcgcacgagtgagcacaaagtgcgcagaaaagactggtgttggtttgtgagggcagtctatgtcctatttaagctgctagatgtaagcgggcccggcctcgtggaggcgggacgttacaatggccctgttgctgcatggtttatatatatataaaccatgcatatatatgtttcaatacatatatatgcatacatatatatatgtatatatatatatatatatacatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggatcggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggattggtttggactttccagaagatgctttcttcagcgttcgctcatagtccgatagcttgatggcctccttgacaggtgcagacatacccctgaagaagttcctgacactggggtctataggaatcttcttttctggacttcgagacttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggccgttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcaactgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatgttacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagca

SEQ ID NO: 832 - DNA, 1064 bp, Oryza sativa
aacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcag

SEQ ID NO: 833 - DNA, 530 bp, Oryza sativa
aggactagaatgtaaaatatagtataaatatagatggaatagagcaagggatggatgtagaagcatcgtgagaaattccccaaaatctccagtctccttctctcttatctcctagccttggtgctaatcgccccccaaaagcctacattaatctctaaaattaggtttaaaaaaaaacattaatctctaaaataatcaacattttatctgttacttttcatgtttattgattaaaattgaacctagtttatgtctagaacttgtgtttgaagtttcacaccaaacatatttgaattggcgaagttctaaagtttttgattaaatgcatcgtgttgttttaactgttcggcactgttgcgctacactgttcggcattgtagcatatggtttctttactgtgctaagccttttgctataaggggggttactttagtgtttatttagtaatattagaataactgtaatattagttgtttttatttccgctgttggttgcttcggtggtttgaaaaagttaccacgattactca

SEQ ID NO: 834 - DNA, 124 bp, Oryza sativa
atatatatatatatatacatatatatatatatatacatacatatatatatatatatatatatatatatatatatatatatatatatatatatatatatatatatatatatatatatatatatat

SEQ ID NO: 835 - DNA, 1506 bp, Oryza sativa
tggtttatatgggctcgggaggggcggacgaggccgggaggcggccggatttctcgccgacgtgggggatggagagagagagagagagattcgaattcgaatccctccgttgcggggtgcacgcgcgagtgggaggagtggggatggtgggtggcgacgtgggcgcggggcgcggagtggggcgcggaaggcgggggaggcgggcggcgtgggcggctcggcggttgccggcttggggagcggcggcgggaggttgaagaaggggccgacaggtgggccccacctgttggtgacccggaggggttagggaggagggaggaaccggcttgggccggcccagccgaggaaaggccggcgcggaaggtgaatggactgggccgacggcccaagaagagaggaaaaaggaggaaaaagaaaaagaaaaagaagaaaggatttttccagagatttaatattgccctttgctcattttaattggttaaaattatttccaaggctctgaaaattccactaaaaatcctgttagcgtattttgacacgtagaatccaagaaaaattccacatgtcgattccgattattatttgcatttattaattagggattcatctctaggttaaattaaacaatttcttcggacgatttattttatgaatttagagcaagggaggggaacttcagggcgtgacagggggcaggccggtgggcgtggcgaagatgtcagcgaactcaaagagtcagagaggaggtcgtccagcaggtcttgagtggtggcggcatgcgccaccagcggcgcaccggtgggcagactgcgccacaacaccatgtggtccttgtgccagaaagacatggtgagttggccaaaatcccacaatatttggcccagggtagacagccactgcatgctgaggacgaggtcgtagctgcccagtggaaggacgtataggtcggtgacgaacacctcggagtcgatggagatgcgggcgtcctggaacatacccggtgaaggcacctagtcaccgttggcgacggtcacatgcaggcccgcgcgttggatgagcggcaagcgcacgcgtgcggcggactcctgtgacaggaaattgtgcgtagaccccatgtccaccagcgcgtggagggtggcgtcgccgagacgaatggagaggtgcatggcgttggacggacgaacacatgtgacagcatgcaggaagatgcgaagcgtctctggatcggcggccggtgtagtgtccccctcgtcctcctcatcatcatcataagccaaatcaagaaggaagaggcatttgcaaaccttgttgtggccgcgtgagtaggtctcgtcgcagttgatgcataagaccttgcgtcggcgttcatcaatctccgacggggtcagacgacggaccgtgcagccagccacctgagtcgacaattggcccaccgaagatgcagtatccgggagcgaaaggatgggcgccaccgaagaagacgctggctcccaggcggcgcgacat

SEQ ID NO: 836 - DNA, 2918 bp, Oryza sativa
atggcgaactctatggtggtgagggtactgcagcagcacgtcgatgctgaggggttcttggagtcccgtggtgaagaggtccaactgctgatcctccatgagaggtccatcgcgagagagcaagtcgaggaagcggtcgatgtaagcggccaccgtcgtcgtgcgccggtaggcgtcgagctcgcccaagggcgcctggcgcaggggcggcccaaagtgtagattgagcatgtcagagaaacgacaccatgtcggggtgcccaagtcgcgttcgacgcgcatgtaccactatcgtgccccgtcgagcaggtgatacgacccgagccagaccttctcctcctccggtgtatgctgtccttggaagaattactcgcaacggtcgaggaaatgaagcgtttgccttggccgtcgaacttgggaaagtcgatctcgtggtagcgcggcggccggtctccgtggcgactgtcacgtcgtggtcatcatcggcgtcgcgacgcggggagcgatcgcggcctacgcattccagccgctggatggcgatgtggtgcgcttgctgctggttatccaggtcagagagcttgccctggatggaatcaaggacctcagcaaggccctttttccaatcttcgccaatgttggtgacggtggacatggcgcggcggcggcgaggtcgagcaggatcgtggaagtctgataccaagatgttaggagggcgaggttgcagtgttgcacacctcgccgccccggagccgtggtggaacgaacaggaattgtgataactttcttgcttgattcattaatctgatcaaatggcatatatagccttacaatgaaactaatctgctacttaaaaggaactaacaaaccggcaacaaacttaatccactaacaaacttgatctaatcactaatcttaacaaacttaatccactagctcatggtgcatgcgccggggccttcctcccgttcccggcgtcgatatgaaattccccacataagagcacggctaataatacagccgacctgctggctataagattctttgtagccttctttcagcctgcccatataatagttagctctttacaattaatacagggcccacttatctctcacacagggtttcttggctcctgtgtctaagccggctataagtttacagtctgcttctcttctctctcctctcttctctcctccacctcagcatttagccggcttatagcctactattatacttgctgtaacacagcctgaagtgaaacaaacagtgatattataagtaatgataaagagcgttaacttgcatagtagtgtgtccttttataagtgaacaaagtgacgaagcctcaaatgacatatttgtttgtacaaatgaaataaagcagcaataaataatcaattgtctgaatctaacacagttcttgcaacaatccctgcaggctagaacaaagagctttcaatacagatgattcaatcaatatgtggattcatttaccatttaaaaaatttccattgggcttataccatagtaacttcaatgcaagcagtacgcctaaatcctaatgtagtgataatattattactggattagtcaactaatgtttggtagccaacccagctcccctgtaaaacagcaaaaagaggaaagaaaataagaagatatcgatgtacaagaccagaaatgcagaacggtggaattgaaaccacaacacaaatatcatttcaaagctaaaacgtgtactaacttctacttgttcatctaaggggtgaacatggaaaaacaagcaggaaaaaaacaaactagctttcattaatgaaaaatccaggcagggatgttccccattcccagtgttgatcatcaaaaaaacaagcaattttagcaatagtatatccaaggttatggaaaaaaagcgttggtatttactctttcgatccggcgcataaggcaaaatacagggattgatgaaaaaataaattcattgctgaaagtgatggaccaaatataaggtgagttgcttgatgcttcatggtgtcactttatctagcttttgtcccccatttagcatttttattgttttagctctgagatagacaaacaaatccagctttagaacccgtcattgggcaagcaattataaagaaaaatagttataagaaattttaattaccttacaaagtagaaatacttgtatactattaaggttctatctagtgatgactgcgcatgtcacagaaggcgagtcccacgaactttgaccaccaatgtaccccgaccaaggtggtaagaacccacagattttgacaacctatctaccccaaccaagaatcttaacatagatacatgtattgcagcaagacatcagtacatgttaaaccagcagtacgacaaattaccatgaaacacgggtggagaagtgctttttactctcggttcatgacccccctgtagtcccggtttttcaaccgggactacgaatccgggactaaagatcgctatctttagtcccggttcaaataaccgggattaaagatggatctttagtcccggttggtgttaccaaccgggaaccgggagtaaagagagaatagcggcagttccagacggtccatttttcttttttttttaattttcttccaaatcaagtgggaagcatatcctcaaatcaaagtaacatcccaaatccacatcacaaataaagtaacatcacaaatcttaaagttacatatacacacaaatcaaatacatcacaaatcctaaaaaattacacacaaatcaaatacatcacaggtcaaatacatcacaaatcctaaaaaattacacacaaatcaaatacatcacaggtcatctcagatccatccaataaatcacaaaattatacatgtgaatcacaaattaaaaaaaaaagagaaaataacgct

SEQ ID NO: 837 - DNA, 3857 bp, Oryza sativa
ggggatcagatgaggaaggggagccggtgcaggggatggatcgggatgaggatggaccgatggaggaagggagtaggaagggagagattcgatctatggaggagaggataagggatagggattatatactacgcttcgaattttaattccggttggtgttcccaacctggactaaagatcggtttgatctttagtcccggttggtgttcccaaccggaactaaagtggtgatctttagtcctggttggtgttaccaaccgggactaaagatcctcggcccccataacatcaatttgacagaggatgaaccgggactaaagatgatttttagtcctggttggtatagaatgtctctgaggttttcaaccgggactaaaaatcatctttagtcccggttctttttagaaccggaattattgtggttttgggtcgacccagcaaagatcatttctccaccagtgaaatctaaaatctccagtttgttcttatcagtttgtgattggtttgagcgaacaaataaagtatctaattgaactagctagatatatgaattaatttaagcaatgtagtgaagtcccagaaaaaaactgtgtcaagaggggcttactcataaggatattgcgcctgccaggcatgggaaagaaagtccccggacagtatcgcatatgctgtaaacctgtttccattggttggagatcacaagggtacgagtagactcgaggtaatcttgtgacaggggtccctctgttgtgtatgctctaatggtgagaagctccttggtgtgctcaggtaaagatgagaattggagagggtcatcgttggaccatgtaaatgaacagaagccaggtctgtcagggaggtgatcgaggaaaataaatctgccagtgctaacaatctcctcctcatcctcaaagttggtcaccattcggatctcaacaattgacaaggacaggcaccctgtaggtgtgatgcttgggcttgcaacggcggaggctggacaggcaccctgtaggtgtgatgcttgggcttgcaacggcggaggctggactgcagagacgactttgatcctgtaagcagtgattgcattggtagtgttcgataagccaagatagagcgttcctgttccctgaagagggacggcacgtccatgaaacggcaggtcattgtcgtcgagtttgcgccattcctccgtctcgacgtcgaacatgtgggtgcccgtctgcccggttatggacagcagaatgtaggaggcaactgctacatgggacttgacggtgaccaccggcgggaagatgtagtcagttggggtgaggtcccaggggaagaatggcgggcgaggcagtggtctccactcgcagcccaccagacggtccgaggcatcgtcgtccacccgagccacggagagatcgagcacctcgaaccaggggacgaaattgacgtcccccgtcacggctggcctgcgcgccagggcgtagatcttgtcgccgaatggtagcaagatcgggcagagcttggtcgacaaaagcttgggtcccgagatctccttgcgcatcacggtgtcgaagacgatggtctcatcagggccgtaattccgggctgagctgccgccgacgccaacgatccacggcgcgtgcctcctcgaccgcacggaaacgaaagacatgtagtgcttgccggtcaggtgagcgaggtagggcaggaggggtagcggggtgtcgccgccgtcgtcagcgttagctggaaggtgtgggttcaccttgaacaaggagtaggaagggcgagtgactccatggccgaccaccaggtacaccgacgacggagactccgtatctctgatacgagcatcttcttcatcttctttggccagtttctgcttcttgctccggcggagcatctccacccgccgccgctggttcgcaagttggggttgaggatcgatctctctgtctctctctcgtgaatagtttttttttttttatcttctctcgtgaatagttagggttggggattgatacgcatggagtgaccagtgtgcttatagatggccaaaaggcccgtccggcacggcccggcccaggcacggctgggatcggcacttcatgccgggccgtgccggcccatgggctgcacctcccgcccaagcatggcccaccagctgtcgggccatgccgtgccggcccgaaggcatgggtggcccatgggcctttttttcaataagtctagctttcgtccctcctcttagggctattacatatgtatagctaaaataagtctatttttcgtccctcctctttgggctgacatatgtatagctaaaataagtctatttttcgtccctcctctttgggctgacatatatagataaaaaaagtctattttgcatccctattctttcatccattgctataatatgtcatttttattcccctagtttcttgtgtatcgggcctggctgccggcccatcgtgccgggccggcccatcgtgctggtggaggggcccaggcacgaccccgacctccgtcaggccgtgccgtgcttgggccgggccaaaatgccgtgccatgggcctggccgtcgggcctcgggccttttggccatctataagtgtgctatgtccaccgtaggtttgcatcaggattcggacgtcctagctaagatgggggttagtattttcatacgtgggctatgtattctcattttatgtagggaaaaagtcctatctaactctccaccatcggtgctagttgagaacccctttggtgtcgattttcccaatcagtaccacggaggcagcatgatgacttcggtcatcggtgccagctttcgaaccagcatctatatggataaagatgtcggttttttatattttaaaactggcacctttaaggtttcacgaataaaaaaagctggaataaaaaaagctggctcgatgcatcagcttgattcgagccgagcagctccctttcacccccaaacaatctcaagattcacatgaacaagaattcttttgcatgaacaagaacaagaacacatgagaaacaacctgaccaacactacaagaaatatgaccttttgtgatgaattcctcgtgacatcggaactattcatcattagcacattccattttatgacgattagtatgagataggatggcttagtgacgaaaaaaaaggtgttcgtcgttaataccaactagaaattgtcataaagtattttaatggaacattgtgacgaatattaatttgttataaggggcaaaaatcaaacgtcacatatttatataatacatttctagaaaaactatattaaaagttaaagcaatttactcaagtgaattaacgaggaaactaaaattttcctttaaaaatcatggtcggaaatatttttgtaatattctatgtggtctaaattattctctaaaattttccgtgaattttcagagctcaataactagttttaataccacaaagttcatttaacctattgaaataaatagaaaacaaattaaaatccctctctttgtgcttgggcatttttcggcccaagtgttactctctccctccctcagcccacagcctctttctctctctcctcgggccggcttccccttcccctcctccctcttcgggtcgtctgcccagcccttttactcctccctcgccgagaagtacattttgcctccctcctctcaattcaaataatttttcgggtagtaaatgatttcaaatgaaaaaattgtcaacaacaaagttgtataactcatcaagatctacaacttttgttttggtcatttttgctatatgactttgtttcaataatttgaatttgaatttcaaattatgacaacttcaaacaa

SEQ ID NO: 838 - DNA, 19266 bp, Oryza sativa
  unsure (1)..(19266): unsure at all n locations
attattaaaacaaagtcatatagcaaaataaccaaaacaaaagagggcgccaccacctccaccgcggcacctcgcgccggtccgacgcctcccctcccgggtgaatctgccgcggctgcctccaccgatgttgggtgttgacggtcgttatcgatcagtttcgaccgtcaatattaccaaaatagaggagaactagtgatgcttgccatgcatatatatgttagaataataatattccactagtattaggtttactaaccttggcagagaatgaccataaagtggacgaaaatcgacatcaacacagaaaataaatcaatcggacgatgtcgagaatcaaacttatgcatgaatgggccaataactcagaattgacacgacaaactgggacaaaattcacaagtctgcagagaagaacaactgaggaggccacctgccgaatttgggccaggttgggcaggcccctggttcggccgaaccccctggcgccgttggatgcagggttgcggctggacagtgtggattagctcccaatgacggttggagggtatttccgaccattccaaccatcacaatcgtcattgggaggctatataaacctgtcaccttctcacttcactcacacacttcaagcaaagctctctcatattctctcaagtttagtttagtagtatcaagctagtggaataggaatagattagaaatcaagagtccggaagtctttggaagagttcgggtatggctctagtagctttcctttcctcttttgaaagctttgtacttttattagaatactcttctatatacatttatggtattgaaatactttccgagtatataaatgcctactttacattatgttcatgttatactgaatatgctgctagcttatctgggagatgctttggtgcgggtataatgtttgcttatgcaattactctatgtcatgacgatgatattagagtagtatctagtagtttagacgtggtgtctagattacgggatatcattatttggggttatatgctgcggatgagaggtgtgccgctgatgatgatagctcagtacgggtattcctccgcgcgtgtatataatcctaagttaattccctggggagggtactcctccgtatttagcctcggtggcttctcgaagtactaggagggcatcggatagagggtattagctagtatatcggataactagaatgtatgtatactatgtatactagaagtataggagtagattatctttctcttttctttccacttagcttagataatatattatgagaatgagtagctactgcttgtgtgtcactctacccttggattatcttaacctctgcttagaatatgattatcacaagtaacatataaattattagtcaagttctctctacatgatcttcccacgggataaaataaatacgatacccttggaatactctcgggtgaaatgctacaatggtatatccgtgcgtttgtggatgaactctgtaaccataatataccaggagtatttctgcgtcattgctgggaattatatttctggtaatgtcattaagaaataccaacactgggtgcgcaagagggctgaggagagggagggatgaggagaagaggtgagaaagagaaggaagaaaatttctattgaacggacgcgtgtgtggcagagagagagagagcagtggatggataaggagagacagagagcgcggtgcgggtggatggataagaatggacgcgctcccccgtgtggcttggctcggttttacgggttgtcggtttttaaaaaactagcacctataatatattatataatatattacaggtgtcagattttttaaaaaaacggcaccttttcctttaccacaaatatgtcggttctttggtaggccccgcgccaactaaaagatgccggatttaataaaaaaccggagctttctttgacaggggtaaaaggacaggggtaaaaggtgccatttttttaggagataaagatgtcggttctcgactttttggcgggttgagataggcactataggtgccggttttaccacttccggcacctatagtgccggcatctatttgatgttttgtagtagcgctcgtcgaatctgatttgtatccctcaatagaaaaattaggtgtaaccgtgtaagggctcctccaactattaaaaccatgcaaaatagcttcctcggtagtgttaacggtggttcttgctcacgtggcagtccagtctcctccaactattaaaaccgagcaaaacggctccctcggttgtattgttagtggtttttactgacgtagcgtccacgtggcagtccaaacatcaagaaattaaaaagaatgtaggctccgcctataaatgacaagagaaaataaaaataaacaacacttgcctatccgctcgtgccgccggcttctggcgagtatgcttagccgcccattcgggtgcacgacggtgtccgtcggcgacctccccaagcgttgagcttccactcctcctgctgcttcgccgctgcctcctttcccctttcccccacgctacacccgtgatcgaggatgacggggcgggaatgaggagtcagctagcacgggcaaaagaggagtcggctagcatggccccaactttgtcgtcgtcgccctcccaacctcatgtcgatgccaccgccctcccaacctcgtgtagccgccacctttggagaagacgaagccgcaacgagtcagagaagcaaaacggcagtggaaaggtagcagcagcggtagaacggcattttggaagagtagcgaccactgcctcatccttttgcgccttccgctccctccccgcctctgatggcctcgccgtgccaaccataggagagaaaggagggaggccgctcctcgccgcggccttccgtgccctccccacctctgatgatcccgccacccaaccatgggagagagaggaggaaggcctctcctcaccgccacctttcgctccctacccgcctctgatgtcccctccaccttgaccataggagagagaaagaagggaggccgctcctcgccgtggccttcatacccacctcgagcatgggcgagggacgcatggacctcatccaccaccacgagcctctcgttgagcctacaaacatgggggagctggactcggagctctagtgataggagaaagagatgagagggaggtagggagagaagaggggaggaggtgctggtgcccttcccagctttggttcgccgttactgcagccaccctcctaggtctcagcctctctgttgtgaaagagggaagagaaaatggagagggaggggggatggggaagaagatgggaagggagacttacatgtgagccccattgtcctttttttattttctttcctgattatagtgccacgcggacaccacatatgataaagactatgttaacacgcgccacgtagaacaaaaccgctgtccaaagcacctgaggaggcaaaatgaaccggtattgatagttaggggagttgctatatccgttttttgcggttgaggaatatgaaatagatccgagctatatttgagggagtcaatttggacattttcctttatgtggctcgcatttagcgtgcgcagggtccactgtgtgtacgacggaatcatgcgctgacctagggatgcacgtggactaggttgacctagcccaggaaatatggggccaaaatcatatggtttacccatcaaatttcatgggtcagcatagatcgacccaccacggcccatggtatgtgggtcgacccacctgcatccgctccactcagtcgtgtgaaactatgttgatatttcttaacgacattattagaaatataagttaccaacaatggcgctagaaatggtcctggtatatatatggttacagaaggaatccgcaagcgcacggatataccattgtagcatttcgcctgagagtattccaaggtatcgtatttatttaattccaagggaggattgtaacagagaactatgctaataatgtatatatgccacttgtatgatcagagcctaagcaggggttaatatatttataaagggtagagtgacacgaagcaaagaactcatatctctcattaatcaatcctaaactatgtggaagaagaaataaaaaagcaatcatttcctataattctaatatacactcaatcttagtttatatatgctagtatactatcatgtagccaatacccctaatagtgccctcctggtgtttcgagagaccacccccggttgccgagttccttacgacaacctgttatggccgaccaaccggagctaaatacggaggagtaccctccctaggaatgtttcttaggaatatatactatcgtggaggaatacccgtactgagctgtcaccatcagcgtcccacctcgactgacctgtagcatatatgcccagataatgatacttgataatctagacaccgcgtctacattatcaaatactactctacatcccccgagatgacatagagcagccgaataatcggagactaaacccacaccactgcatctctctagtaggctaactacatgactgtaccgatacaaatataaagcaaagccgatactcagataaactaaagtaccgagagtatataaagaataacatttcattactttcgaaagtcttacaaaagaaataagaaaagctactagagccatacccgaattcctccgaagactctaaggactccatgagctattctattctactccacttagcactaggatactaaactaaagtgtagagagatatcttgagtttgcttgagtgtgtgaaggagtggaggaggtgaaggccttttatagctgatgaaatgactattatgacggttggaaaggtcggtaataccctccaaccgccattaggagtgaatctccaccgtccatccgaagccctgtatcaaacggcgccgaggggggttcggtcaaacccatggttcggccgaaccatgggttgggccaacctggcccattttcgacagacttactcctcaactgcttctcagtccagaacagtgaattatgggcccatttaatcttgtcatttctgagttgccggcccatttatccacaagtctgattctcgacagcgtctgactaattcttcgagtgttttgctgtcgattctcctccatattatgtatctttctctacaaacaaatagaatccaagtacaagaagaaatagattattctaaaacaaatatgcattgcaagcatagctagttctcctttattttagttatattgactgtcgatattggtctataacgaccatcaacacactagcatagaaatgcagatgcttgctcgcaactgttgccgtcgcagcctgcatccacctcatgcccctgcgctgacaccgccaccttcgtctcgcccctgctcacctcaacctaggggcccacatgttagcctctaggagaaggttgatggagagaggcagtggctctggttcagccgaaccagggtttggctgccctcatccccaccctccacgtgacgcttcctcagccctccctaatgacggtcctcggtgaaccgacttggataactgccttaatcaactgtcattggaggctataaaaggagaagaatgtcacactctcaacacactaatcaagaagcaatccctctatttctcatttgtattactctatagattagtagagtttaggctaagagtagttcttcggtttcctagtcttctcaaatgggtatgtttttagtacttttctctcattgtaagactttgagcatagtaatgaaattatcttctttatttatcggtgtttatagttcatatactgctttggcaattatatgttctatgagtagtttttacttttttggtatgctttacatgtgtaggctagtcgatatatgtcacgatatcggtccaataatcttaacggattgcactagttcttacttgtctatccgaaaagtgggagtcttaggaaaagtaatagtattatttagcaatgtaagcatggtgcttaggttgattaaatgtcattggatgtgggtgtgctccacgggttgtagaggtaggcgacaggtggtgataaacgttgtatgccctttgtaatcatctacgttcaggtttgacgtaagagttcgtaaaatgtcgtaaccacgttggcagaccagtatagggagtgctctctctctcggtagtgtctggatgcatagaactaagtcataacttgtaacttgtacatgtatgtgtttgtttgagtataatcgaagcatcctaaatatataagtatataaacgaaaccatagctctcttttgtctttctcctcaatcaagtttatctttattgagattattcttctatgtcacactacctatgcgtgaaactacgtgtgcatgtcacacaccaagtggtcaaccatgggaggacctaattgccttgtactttcatgcatgacgaaggtgatggtcgaggatttgctgcatgggccatggaattgcactagccagatgtagttaggtgcctgacaggagcaacagtgtcaccacaccggcctccgctcactctgctttgcacgctgacatcaatgcctgaactgctggtcggtggtcaagaccgccaattgatccctagctagcgaatgtgcctaccttggtgtcatcgctggcgccgtagttcttgacattgaacgttgggttaccgtggtacatcgccttagccaatgtcgacgacatgttggtggcggaatatagcgtagcagcaacgatgacgaccaaccgttgctgcgtctccatattcatagctagccctctccacagctcacatctgtgcggcggacatgagagagaaattaggggatcgatggggtttccaaaaatgaagacgtgtttccgtctttgagcgatggggatgtgtgatggagtagccatagtcaatgcgatcttaggtgcaagcgcgatttggcggggacagaatcatggataagttgtgtgcagtggctgatgggaggagggaatgatccagagcgttgtacctggtgttggtgtgaataatattgggcgttggatttgatgaatgaagtatttagtagtagaaggacttgagttggccaactatccggtaataaatactacctctgttatataatagatgacgctgttgactttttgtcatatttttgaccattcgttttattaaaaaaattacgtaattataattattttattgtgagttgttttattactcaaagtatttaagtatcatttatattttatacatttgaataaaacttttgaataagacaaatggtcaaacatgtgttcaaaattcaacgcgtcatctattaaaaaaagaatgtatgggactacctatacatttgtcgacaaatttttccctaaaaatttgacagatgtaattatagtacaatcgtagtgtaattacactgtaacttatatgtaattacactgtaacttgcatgtaactacagtgtaacttatatgtaagtttcacataattttgaatcgttggatctattacaagatttgttttggtgaggaagaaaacaaatcatagcacacacatatgtgaaagaatttgttcccacgacctccattttaccgaaataacatgtaacggagagatttttgaaagttacatacaagttacactatagttacagtgtaattacatgcaagttacagtgtaattacagtacgattgtactgtaattacatctgtcaaattttgggggaaaaatttgtcgacaaatatatagcaaaatcgaaccagaaataacaaaacgagcaaaaagaaggaaaacaacttccttccttccctcctccctcccttctccaacctgaagacctgaccgccagatctgacacctcaagctttggctcgcttcgcttccttttccggcctcccagatcccgatctctccctccccatgcctcctcctcctcctcctcctcgcctcccctaacccccgccgccgccgcgcgccatggcctcgcggcctccgctccgcaccacctccgcctcctcctccaccctctccaccgactcccccacctccgctccccccggcggcgtcccgcagtccatcaccgcgctcctcaacaaccctctcccctccgcctcctcctcctcctactactggctcacctggccccctcccaccccgctccccgacgcgcccccgccgccgccgccccacccctgcgacgtctcccgcgccgacttcgccccctacctcgccgccgtcgccgaccccttcggccgcttcgctgatatccggctccacgcctccgcggaggagctcgcggagtcccaggacggcgccgccgccggccccgcggcctccggcctcgccgcctgcctccgcgaggtccccgcgctcttcttcaaggaggacttcgcgctcgaggacggggccacgttcaaggccgcctgcccgctcggcgacgccgcgctgcaggagcgcctcggccagcacctcgacgtcgtcgaggcgcacctcgtgcgggagatcgcgcgccgctccgagtccttctacgaggcgcagggccggctgcgggggctggacggggagatcgtcgccgcggtcgggaggatccgggagctcagggaggtggtccgggtgctcaccggcgatctcgtgggtgccgcgcgccaggtgcaggagctcaatgcgacgcggggtaacctcgtcgcgctgcagcagaagctcaccgtcatcctctacgtcagccaggcgctcgctgctctaaagctggtgagtgggcaaactgagcattgcgaaacaagatatctcccgcattgcattttctctgctgatcagcaatgtgaatgattccctgaactggttgggaactaagcttagctcagtgatgtgctaatctcttattaatacccaaggcgtgtgcttttgctggcatttccctcacttttctttgagtcagttggcaatttggttagtgcgagaatgagaagtacgatagacaataaaactgcatgcacacgctgttttcttagtttgatagtctgatgccatgcgttatggtttgttcacattattttgttctcggtgatttatatgttgatgaatagtactgtgcatggaacgccagaaaagtgctaggctgtctgtatctcattaattttctggcaacaatctcggtggatttagatcttcctaccttggctgctcaattatgaagtgccaatgtaccttgacacggaaaatgaaacttgatggttctgtatgagagttctagatgagttacgactttaatttggagggcttatagactaacactaggcaagcatatacctaaaagctcaaacaaactcaattattaagggaacaaaactttgatatacttaaggtttagtttattgtgctgagtcctgtaaggcatgtaggttgacatgtgggccaaaagataggctagtcatggtacccaaagataggcttgtgaggctgaaatgaaattgtatgcgccttactggcttccatctcttccattgtctctctattctttgatgatccttctaatttcctctctctcgatacctacatccctttcccaacctctgctcagtagtgaagcagtgtcacaacaaaattcagtaaaggagaggggaggactagaggaggatgttaagggttgagattcacagaccaaacttcagagggtgtctaacaaggtgtttgagattcagtgctttatgctgcctataccatttatgttgcagcctagagcaggttggtgggagactgtgaggaggacgtgcatcagaagttcagagcatgaagcaaaaggatgcaggaggcttcgctagttcaattcttcacaatgtactccatggagtgatggaagatggaagggagagaggacaggacagttgctgggaccaaggagttaggaagaggaggcagctctagacaccatgatatgcgaggaggatccacacagtcgggctgagtggaggtgatgcgctgagtggagtgtgcctgcttgcagttgggaatagttgggattggttcttgtatttgggtacgctgttgcgatgctctgctcatgagcttctattataggggtattgcaccaggagagattgggaagtattggagctttacttatttattttttaaaactgtaattaatggtactcgcttcgatctgtgtccagataccaatttggctcttcacttgacattctagactggaataaatgttttttatactagatcttttagtcattgcgttaaatctttttcttacatttcaagccctttattttatcgattcctaattcagtgctttgatttgttaatcttatatgtgcagcttgtggcagctgcggattgtgctggtgcccttgacgtaattgatgacctgcaaaacttgctagtaagtttcttatacaacaagacgccaatgtttccttttgtattcctctatggcagctttacccttcgtcaaccatcttttttaacattgtgaggtctaaaagtaaagacgtgcagctaaaaagataaagttaattatcatacttctaattcattccatgtcatcaaagctgagatataccctactattattaaatatattacgtgggtctgttggactggggatgcccaaaagttaacttcaattggcaattttaatatctaatgcgtcggtttagaataatttcttagttaacccaacaaaagtgtttagcttctcttttccccttccctaaagtaagtactctggagtacatgcatgcattttggtaaaaatagcaagactgtcagagaatttggcctcatctctatttgcttgctgattgtctgtctctatataaccatgatatattaatggtatgggattacaacgtatcaaattagttgattgaaagatgtgattaacttgtaaatacgcctttttactcccatctacttgctcatgtctgcagcatatgtaacttgtattgttatgataatgttttccttttttcaaacaggatactgatgaactcactgggctttattgctttcgaaatattcgtgatcagttggggacatcactagattctgtcaacaggtactctcttagaacttgagcataggttcctatgatatgagcacaccttttagatttcaggagtattagcacaaaatatctgatattgagataaaaagcctttttgtgcatagaaataaatcatgaatcagtgaattgtgatcaaaagctcgtggcatgttgtagcaatgtaggtaagctgatcaatataaaaaagaaataattagtgattgtactcaaatggcatgtttgttgatactgaaaatgtgcctacacccggagggtaaattttaatgtcgttattaatcttgggctatatcaggatattgatattttgttttttttttcaatattatgcccatcagtaacttgctgtttgacttgataatattcattcttgtagcattctttcagcagaatttgtgcgggctgctgttcctgatggaaaagctgtagacgcattgattcaagcaaatgtgaaaagaaaggcttctgtcccccttaatgggacggagcatgaagtatgtttcagttcacagtttaatctatctcttaattggcttatatttactggattatatatgccgatgcactactatctgtttattccatcgaaatttctactaatctgtattttctatgtgttgtctgttcactgttaacttattctaggttgtcatttgttgtatcagtgcattctcactgaaatgtaaactttcactacaacaaatgaaccagaaaatttgaacattcctgctgtatagagtatttttttatatagcatagtgaatgctgttcactttttggacccttctgttaggttgttaagaacaatgattaatcataaattcataattgaacaatatcaatttagggacttgccatattgaggccaaattgtctgcttttaatgtttgttttgttgatgttaaggttcaatgcatgataggaaagcaatgttatgcggtaggaagtgatcatgaactaattaccatttaatactaattttgtcatggctatagctattcatattcttgtggctactttggccatttctaggcaaattttgttcttttccaatctttgagtgaattgctctgtagcaaacacagtttagcagaatatgtagttatttcgtaaatgtttgacgcgtttaatattttcatcagattgcattaatacaccgtttatgttatttcttccatttggtgttccatgcttacagtactgtggtactttaagtaaaggttttcatcacattttctctaattttcggcatgttcattggtttaccgtaggtaaacatagatgaggaagaaagcttcattctcagagatcggcttctccccctcattatttgcctactgagaacggttagttctgtcatttactttcattaaattgatattgcagcgtgcacaaattggatgcacaaatatatctttttcaatactgaatgcaaacaatgagaggttttagagtgataaatattccccaaacaccttaaaggcatgttcattggtttgtgttgatgaataaaagcttgtattttgggcttattacttgcatccgcatgtctaagtaagatgctgtttcaaacttgtattggatagaatatcaagttccttttttcgcaaaggctgatctcctgtgagtatatttgattagtagcagcatcatgtttctttattcctggatgtaacttgcctttttgagggtatattagttagcagtccatttttttggtggaaactaaatggtatggttcatttttatattttgcaggacaaacttccagcggtgctaagaatttaccgtgacacactaattactgttatgaaagcttcaattaaagccacagtagctgagctgctcccaattttagttgccaggacaatagattctgattcagtaactggagacagagctgctgattctgatggtgtcatgttttctccatttatcactatttctttcccatgctatttcttccactaaaattcttacatagtttgaacttcaattttttcttaactgcagctggaggccagtctttagcaaataagttgcggagtctatcgtctgaagggtttgttcagcttttatcggctatatttaggatagtacaggtaaaatgattataagaattccatttaacctgttcgaagtggaggccatgcatcaaatttaatctcaatgaggatatacttttatagtatttggtagtgtagatattttagccttgcattgatttatttgttagctttagttatccactttttgactgcatttattgtatcagcttaattgttctatgcaattattatcagcattaaaggagccatgaaattggcgcaagtcccttactacatgctctgtatttgctgattctattggttggagaaccaaataaaaccagaatagattgtggagttagctatagaagttatgtactagcatgtagcatcccaacttccaagtccaatttctctttaaaaaaaccttccaagtccaaattgaatcagtgcaaccaattggttcgcctttgccccccgcgggggnngngggggggggggggcaggtggtgaacctgcctgtccgccggttctgctggctaccgtactaggggtcttcttgaagtcatcacctatatttgtatttctatttttgataaaagatatttagcagtggctggctggttgcttgaggatgtggggaaaagagttttgaacattgctatgctacatgtaactaaatgaaaataagagttgttaacttttaactataatttcttgtgccttttcccatctgaaaaccatgtagcattgacctaatatttttcagcatgcttgaaatgtttcttgtctacttaaatcatgtacaatttctgaagatttaaagaaaaaacttgaggtaatcagtattcttttgtcaattcaggtacatctagtgcaagcagctgaagttaaaagaatagttgaatggatcatgggaaacctcgaggggagcttaagttctgatgcttcaaattctgtacaaaagcacagtggctcggtttctgatttttcccaagaaaatgaccacggtgtcacttcacgggtgtctaatactcttaccaggagtaattctaagtttcccttctttcaaggaaaaacgaatgacatgtccagtacaaattcaataaagaatgtccggtaagttaaggtgcaactagttattaaatcttgcattcacatgggctagatatcatatacatccgcatcaaaactctatggaaaaacatatttgaacttttttttaggtttggaataaaaatatttttatgaatagatccaaaattaaaaattaggagctacaaaagttatatatagaatccatccgaatatagtttttgttactttctgtttttctggttattctgaaatttgaaattaataattacaaaatcgtacctgacatggacttttgttgtaatctgaaccactgtaatttcgtcccaccttgaagaatggctagattttatttttcacctttttctgataaatgcgaaaaatacctcagtttgcctaaaagaacctccctttgtcccaaaatatagctagttctaaagtttttcacttctatattttgggacacccttttgtactctagaagtagctatagtttgggacaaaaaattgaatgctagaagtagctatattttgggatggagggagtagatatgctttttatgttatgttagctgatgtcatggtagtgctgtggacagattcaatacaaaattagaatattgggtcaaattctaggctttacctcttttatatcataattatatttgacaacacaattgctctctaatatttgcctttggtacagagctgatgtcttgagagaaaacacagaagctgtttttgctgcatgtgatgctgcccatggacgatgggctaaacttcttggtgttcgtgctgcccttcaccccaaattaagacttcaggagttcttgatcatctataatgtaacagaagaatttgtagctgccactgaaaaggttatttcttttcctgtttgaaaaatatgcacaaacgctcattatgctcatcactgcatacatgcaagttatgactttattgtatcttcttattcctgtagattggaggcaggttgggttacaacatccgtggaattgtacaacaacaatcaaagcaatttgttgactatcagcatactgtccgggtgagtgataaaatttgttgactatcagcatttgttgaattctacaatggtaaacaacttgcatgagtttactgatgatgaaaaattaaaaggccattcttcaaatgtcatctataaggagagaataatattaaatataagactacaaagcatcattgtacacaaacttcaatggataattgtgctattttgaaagaatataaatcactcaactttatccctgacccctcagttatagatatccatcaaattgaatataatgctgtacctttattatgctttttaattggagaatattacttgcggaaagtgcatttcaccatcaaataccctgagtaaaatggtagtgcaaacggagaatgtaaggcttaaacaagtacttcctccggttcacaatgtaagtcattctagcatttcccacattcatattgaaaaatatgaatgtgggaatttcaatatgaatgtgggaaatgctagaatgacttacattgtgaaacggagggagtactactcaacaattgacactatagtttgtgaaacaattaacattattaggtgtcactgctgcttttttttgctactcaacaatcatcataaatacaaatttcaaggttgtgcaaacaactgtgatttggatttcagactgatatgtactttgtctgcagttgatgcacaacttatagtatttttgtgcactaaaacttctaatattcttttgaagatggcaaaaatcaaggcagttcttgaccaagagacatgggttgctattgatgttccagaagagttccaagcaattgttctatcactatcatccacttattccgttgctaatggcatggagatgcctagcactgatgacagctcaaagctccatgaaaatcgggttacaagtcaagaaccagtaaattcagctgaaaataatactgataatggcaacgcagtatctacttctccttcgactgaaaacaatgttgggcatgctagatcaacacagcaaaccattgtgcatgggggtgtaggctatcatatggtaaactggttagtcatctatattttctacttaatagttcaggtcaagttgcattctcttcttgcgcaccttgcagtgttgcaacgtgacacttttatttcccaacattttgatagctagagtcgtaaaccatccctctattgatttgtggtcaaccttgttttatttgttgtgtctttttgttaacttgtgttctcattacgtgagattctcaatttaaatcatgttcacccttgcagtggtttgatattgttgaagatgttatcggaatatgttgacatcagtaaatgcttgccatcattatcttttgaggtggtccaacgtgttgttgaaatattgaagctcttcaacactaggacgtgccaactggttcttggtgcaggtgccatgcaggtagtataactgttacatgcaatttgagtcattaagttgttaacagtataaagtcttttctctatatctgtactcatttaaaagggagtagcggtggtggtgagtctgccaccacccccaccaccaactctatttttttgtgagaaggaaggacaatgtaaggctagaggacccacatgtcagtaacaaatatatccagaaatttagagatatatgcagaaaattatggtaataacaggttaatgataattttctttaatcaaaactagttgaatgcccgtgcattgcaatgggaattaaataagaaaaccacaccgtacactctaaagcctcaaaaattaaaataaaactaccctcattctaaaatcttagggtcatatatttgtcatcattttcacctcacttcaaaagaagtttttcctgtttgatggcttgaggttaggaagggacaaaagtccatccacctcactgtttgggggacccacatggtagtggtggtgggtggtggcagatttaccactcaccaccaccattgaggtctttgaaaagagtatatagatcctgttgtaacgcgagggcgatatgctagtttttttacaacatatgtaaacacaactctcgtgttttcatgggtatgtaacacgggttaaggacactagaagttcttatggatcatctgctcacttaggctgcattcatttctggagattgagagagaaacccattcgttttccacacccacaatacttttttgcaaaaattttctataggaaagttgctttaaaaaatcatattaatccatttttgaaatttaaaatagttaatactcaactctccttgtgggcaagattttaccatcagttatgggttagtgtgctatcaaaagcaagatttgcatgcttttatcaaatgctaaccttgcttggaaaagcatattgccttagcttttagatccatgcacaccttaaggcttggctgggtgtccttggacataagtggtgcagtggcaccatggaaccatctgcgcctaaggcagggagggagatgggattatgagactaatgaacttctgtttgttcttgtttgattaagatataatgatgtccttttaataggatagccttaggctggacatagcacctcgtttactgaatgctgtacctcatagcgtaccatgtttttccattgttttgtgtaatctttatctccattctcgaatagtatgagttgtttatgctcaatgaacaatttgtatcactttgttgcacaaaaaaactatttgtgcaatttgttctacctatatggaaatgctgttgcaaacagttaattattctgtttgaacaatcgtacttcaatgtctgattagtttaaatgcttctgatcctgatcaatctcgatagctgattttgtgtagctactcaacttgttttccactagttcggattggtgagttatattctccattgttttgattttcaggtgtctggtctgaaatcaattacgtctaagcatttagctttggcaagtcagataatcagctttatatattctttaattccaggtaagcactgttttttactcttctataaagcatgatgtgatggtactctgtcctggtgttggctatgtccatgtttgctcactcaacattttcatcatactgcagatatccggcgtgtacttttcctgaaaatacccgaggcacgcaaacaactgttaatgtctgaactggatagagtgactcaggtatgatcattaatttacatactaacattttgttagttcaagcaactcatgaatgctactactatcttttagttgtttttctatcaatgccatttcttacatgtttcaaggaataacaggattacaagattcatcgagatgaaattcacaccaagctagtccagataatgagagagagattactagcaaatctgagaaaattaccgcaaattgtggaaagttggaatgggcctgaagatactgatttgcagccaagtcaatttgccaagtctgttacgaaggtacattgtttaactgttatcgttgtaaataatgttatcatatggttgcatatttctacttgtatgtggttgtttaaagggttttgccatgatttaagtaagttaagttcacgtgttgctaggtgaaaataacacgtggtttatggtctttttgttatgtgaccattactttcatttatctctttggtagtttgaatccacgcaagggatatgttttttccaggtttcaggtgttttaacttatttatgctaactgttaaattttttcacaaaaaaaactattgcaggaagttagttacttgcatcgcatcctttctcaaacattgcttgaggcagatgtgcaattgatattcaggtattttttttatactttttactactgactttagctccatgctatcattataatcattgcaccattttatatttcagatgagtgatttttagctacaacatatgcaggtctttacctgttttaatt

SEQ ID NO: 839 - DNA, 12105 bp, Oryza sativa
  unsure (1)..(12105): unsure at all n locations
ggattaaaatacatgggagaaagctcattacgactggaaaaaaaaagcattgccctggaaatatgatggaagctgggctcacttagtgtgtcccagccgccactctgactccccacactgataatcatcttaagcttgtcgtctgccctgctctccacccttccccatcccaacattccttcgccctcctccctgccgcctaacatctctacccgatctcccgctgctcttaccttgctttgttcctagctgatggctcctgggtatgcatcgagcttaggatcctggatctgcacaacagcagcctcattctgcctcaccaccacacccatcgtgtaggagtccaacgtgttccttaattctgcagcaacagcagctactgcgacactggagacatgctctggaccaaggtgtggaaccagttttggccagtggatttcggttggaatttgttgctgacttttactgttttattttgattattggtctgcaattcgataatgttcactatttactctttcatgaattgattctgagtcctaaatcctcctgctatctaatcttcttgatgatatgcacttgatagtgcagtggcaaggagtgtgtggtttcaactttgaggtcccgtgttcaatccccaacacgctcacaatttcttaaaaaaaaaaaagtttggagggacgtctctccttccaaatctcatctaatcttcttgatttccacatgcttgttaatatccataatccaaatggtcagtatgccaggcatttgtatttcactggtaatggtaattatgggtaacacgaaattactcttgtatttcaatcacaatattatataaaatacacaactcccaagcaggccatatttgtcatgagttatagaaccagcatctgtatttttgacttttatgcttgccctgaacaagttttcatctgttcatataatatgtttataatctactgttttgctgcaaggtaatattgcgtgccgctgatttctttctaccctcttgttcaatgcaggcaagtagttcaaatattccattcacatatcacagaagcattttcgaagttagaactcagtacacctcaggcaaagaacaggtactcctaaacttgttgcactctctcccacagggagatggaaaaaaaactaaatttgattctccttgtgagctgtgggtgttctgtaacatttatatttgacccgttattcaatgattgatgaaactcagattgtgccgtgatgtccaacatattcttgtatgcattcggaagttgcctgctgagaacttcagtgcagaagctattccgaattatggtcttcttgatgatttcttggctgaaaagtttgggacaaaagttgatgaatgactgacctgtacattaggaactgactgtgtctgcaaatgttcagtactcatatggtacatgggaagtactccaagacatcgccgttattggcgtgaaatcctgtgcaggtaacaactggaaccaatctgttctgacttgttgccagtcttcatagatgtcaacatctaatccttttttttcaacggcatatgactatatactccctccgtttcataatgtaagactttctaacattatccacattaaatgaggcatgtaatattaagtttatttggtgctggcttcgtctccccagaagtcatgttaaataatgtatatcaaagttcatttgttctattccatgtttttgaaacccagatagagaaatagtggtattctgggagaaactaattctgtatgggatgtttcataaagggtagattttatacgaaacactgataaccaattttataatgcaggcattgctccccaggatacaagtacatagcacttaaatgacagcggagtacaatgtcaatactcccagtaatgccgtgtgaaaatcatagcaatgtttttgcccttttctgagctgaaattgttgccccatactttaaccatgccaggctgcatttcaattttttaattgttccatccctttttggggacccgatatttgttactagaagttcgtatagagggaactgagttttggcatcacgatctattcattgcagcatgcttcttgctgtgtaggtctggtgtattcaatatcctgtcgtgatggcagcccatgtattttgttcatgtaaggttttgtaattagtctgatgaatgagataataaggtatttttaaatgttagaataggaaaagattccagccatgcatggatatataacaggaaattgaagattactacatatgtccctttctaatgtgatctatgtatgtatgcatgttcttttgtgagtgatgtactgtaattggttaaattctttccttcccgaggtacaaaactagagagttttgttgtaaaccttaaattattatggtcttttttcgtaaacctttaattttggcaaataacctagaacgataataattttgaaaacggaggtaatacatgattagattactttactcgtcaatgagactcctgtcgcgcgagtgcgtgatgcacgcaccaggtcgctgggcgcaccactgcacacaggccacagccacacgcattcttgccatcctaggtgggtcgcgtatcagcttgtaatcatagctcttctctaaagcaaaagacacggaggcagaggcggtatgttgctacctccgttctctcccaataaatggctgaatcatttggtgatcatatttgagtgtacaaataaataaattaactattataaaattaaaaaataaatataaaacaccattttttatataaaaaaaatcacaccgtttaggatcaggaagcttgtctcattaatttgttggctatcattccttctatctaggagtatgtgagtacaattcactaatccactaaatgttatgaacaagttcccaacaaataaacacttgcacattcacaacataatgtaacacttattacaacaaaatgtttaggcaaatgtggcacaaaaataatcaaatcacttctcctggtttgtgaccttgatggtatcttgaccatgttcctccatattgcgctggagagaggccagagacgggggagggactcatggatggtgtttacatggattggagctcatgatcttagataccttatcaggatttacacgacacaagggaagaccaaggttcattggagcagctcctctcgttgagattcccgcagacattagtggggaggaccgaaaggttggcatgtgggatggacaacaaaagtaaacagataaggttgagtaaggttatcaatataccgattgtatcgtacgattttacgattctatatagataatgtatctatatggattttatgtatatgattatacgattgtgatcctacttggaactttcgatgccattggtgcctacagaggcatcaaagcgcttccttgagagctacatcaacacgctactgatggtaagacaacacccaaaggcggatgtaaacaccggcaagcaagttgttagctactacctcggggaagaattgcatcgacaagggaagaaggaaaaggaacccagcgggaagagatggagccgtccaagtctaggatggaccaatttgattgttgttggattctacgatgcatgtgatgatactggaggtttgctcttatgctcttgaagctgaacttatggcctgcaatgagggggtgaaaatggcactgcaatggacaatcctaccagtgataatagagaccgattgcctctctgtaactcaaatgttgcaagaaggcaaaatggacagatctggtcttgcttttgtgaccagggagacgaaggagctcctgtccggaaggtggaatttcacgatccagaagattcatagagatcaaaatagagttagtcatcaattagcaaatatcgctcgaaccaagaagaaattccaagatgtctaatttctggtcgggcgatgattgtaatctcattgaacagatgatccttcaggatcaatctgagattcatgattaatgaaatccctttttccccgcaaaaaaaaaagattatgactttaacaacattggttgggcttgagcatccaaaagtcaagatggtagccatatgatgaaaaggtgaaacggacggtggattgcacactccatgttgcccgatcgcgaagtactataataaagaaatatgtgctagctccaatgtgtagttcgatcataataaaatgtattacacaattaatttcatttttaggcaacacgtggcaccacaaaatatatgttgggcccgctcaattgatatgtgcatgctaaacatcaagcctttggaaaaaaaaacttaatatccggcccatataccaaagcccaaatgctattattctttgcacgactatacgatgtatattaaccctcattttataccctagacaggcagttattgttcccatctcctattttccatgccgccaccgccgccgccaccaccaccaccaccgctgttcgcctactcctctccaatggattcaggtacttcatctccataatatctaccacttgaactgtgaactaatcttggtagcccacatcctccctgcatcaatcgttgttacaccattcttattgattccttccatagatataagacgttttttgctagtcggatattactatgattgtctatgtcattatccctctctggatggcaccggactcttaggtttaattttaagtagttggttatgctcttattttggtctattcttatagtttagagttttttctagaccttcttactaggttatttcaatacaggcaggttagcatttgtcccaactgctatacttttggttgggtgcactatgtaaatatggcgaagatgtgtttttgatcttccattttctaaaaaggaaccactataagtatgatgaattccaatataatcacccggtgaaacttgatttgcggtatgtagaagaaaacaatgatatctccttttgttaaatactatattatagctatctttctatttcccttgcacggttgaaaaatgtaaatatgcttttttttcctaggaaataaggcaccacaacaaatttacacaaacgtcacctatcaggaagactcagataacaaaatgaatcaatatttaatctgttttatgtcgtagctaactcaaattttttattaatttgttcctgaaacatattatttatttttcagttatatcttttattttaacccatgtgtacaaccgaagcagtcgaactggattgaaaaatttgaaatgctatactactgtagcatattactatttttttaagaacagcttatatgaaatttcacatatgtacaacacattttggccatcctggctggctaaaacactggaacataccggatgttgccaacagcaaggcacatctggaatttagaggacgccattattttccccattaatgtaaatacatctgccaactttcgtgcactaatattaccctttttttcctcaaatatagtgagcccacagataaaatgcaaaaccatccacggttttacatgcaaaagtagcaattatttattgtgtaatctggatgatccttgttttgaatgtaacaatctcccttatcatcttagagtggcataaacagcattctttcatgtcataaatctgtacttcaagaaacgtgatcacaaacctggttggcaattaaccttgtgattaatatgtttcatcgaatgaaatctttcagattcagcatatcaccaacttttgatctttgtttggcctataaataccattggcaaacaggagtcccattgcatccaaaactattccaagcaaactcttccagttttctgtttttctcatcttctgcttcccctgtgtagagcacagtagaggttccatcaggtgattctttgctcttctctctttgtttttaattcatcgttgatgtaagagtaatcttgaaaattatttggtggactacggggaataattaatctcttttcattatattaatctgcagcttgctctcatggcgttccaaacccaaggatccaacctgagggcattgctcgttgaggacatcaaagtgaaccgcatgatcctgtcgcagatgctgcgcaaattccaagttgaaaccactgtggttcagaatggaaaagaagctgttgaactattccttggaggagaaacatttgatattgttttgactgacaatcttatgcccatcatgactggtcctgaggtataacttataacttactccaaaagaataatgtatttcctttcattcagttaacaaataaataatcaagtagttctgatactagttaaacacttctaattaatttaagaagttttaattcttgtgtcactgcttgacaggcaatatccaagatccgtgccatgggtgctactgatgtgatgattgttggagtctcagttgacgccaacagcatggaagagttcaaagatgctggtgctgatctatgtgtgcccaagctgaagcttgagattctagagcacatccttcaggagaccaggagcaagaagaacaagagcagcgcttaggtttcagaagaaaatcaagggactatctgtcatcatttagtgtcatggttgttatcttataagaatttaggtttcatggttgattaatgcctggtttggtgtgagttctgatccttttagttatggttgttgtcttgtcatcatcttttttagagtcatggtttgtcttaaaattttagattcatgtttgatttatgcatggtttggttgtaatcctctcggaacaagttaaagttatcaagaatttattattgatgctcagtttatggtgtcaacattccagcaatgctgtgtgaaaaatcatcaactgagagttttggcagcgcacgattttttttggcatatgttaaatgctgacaggcaggtgtattaattcaatacccttttgagatgcatgacagcccatgcattccattcctatatatggtgcatttatggatttatataaccaaaatttagagattattcataaaagaaaataaatttactgattttgtaggaccgggatggcgtctatccaacggggttgagtaatcgtggttactttttcaaaacaacgaagcaaacaaacagcggaaataaaaacaactaatattacagttattctaatattactaaataaacactaaagtaaccacccttatagcaaaaggcttagcacagtaaagaaaccatatgctacaatgccgaacagtgtagcgcaacagtgccgaacagttaaaacaacacgatgcatttaatcaaaaactttagaacttcgccaattcaaatatgtttggtgtgaaacttcaaacacaagttctagacataaactaggttcaattttaatcaataaacatgaaaagtaacagataaaatgttgattattttagagattaatgtttttttttaaacctaattttagagattaatgtaggcttttggggggcgattagcaccaaggctaggagataagagagaaggagactggagattttggggaatttctcacgatgcttctacatccatcccttgctctattccatctatatttatactatattttacattctagtccttgtacacatatataattacacccactaacactaactctcaagatagggcatatacattgtaaagacccatcttgctaaaaaaatgagaaagatttctcaggtaacccttttgtaagaatatcatcaactcgacttgttgagctcacatatggcatgcatattatccctccatccaacttctctttgataaagtgacaatcaatctctacatgcttagtccaatcatgttgcacgggattatttacaatgtctacagctgctttattgtcacaatataacatcaaaggatagctcaaaagagactactcgtacacttgctaatgccttcttgaagatttgtcattcttctagagagtgggcgttagatttgtgtattgggcaccattgtcgtcgaggttcttctctttgagggtctgggcacttagtgggtgggtccgtctgctctgtggacagaacctcagtcccaactttgcgtttccccactggtggagaaatgctttttagtcccggttcgtaacccccttgtagtcccggtttttcaaccgggactacgaatccgggactaaagatcgctatctttagtcccggttcaaataaccgggactaaaaatcaccaatcgggactaaagatgggagcatctttagtcccggttggtaacaccaaccgggactaaagatatttgttcttttttttctgcttttaatattgaatattgatttcacaccatcccctcccatatccaaatcatcacatattacagaacatctccaaatcctcaaacaaatcatctccaaatacatcacaaactcttaaaaaaattacatcacagggttctaaaaaattcatcacagattcacatctcacacaaaaatacatcacagattcacatctcaaaaaaaaaagaaaaaaaatccggccggcggccactgccgcctcccctcctcccctccacgccggccggccagcgccgagccagtcgccgccgagcggccgcccaccgcagccgccgcctccgcgcagcctcctatcacgcccagaaatttagcccaaatttccagactattttgtgtattaaatccctgtccaggaccagccagggtacacaaaccgacaagtaatatacagttccaaacgtaaataaagcgtaaaatacttacagaagaggcacttagtcctcacaccgaaacaaaagcagcagcagcggaaaaggcgatcctagcggggcttcagctccactccacaggcaaaactcaactggggtatgagccttggtcctttaactccatcttcagctcagaagcactacacttctgaaagggggaataatagcaaggctgagtacaaccaccgtactcagcaagccacaccaatgatgcagacgtgcaaggggatacaaggatggtttgtggctatttgcataaaggcggttgtaaaacattttattgagcaaaacagtaaaactgttgagtaattaaagtaactttaaatctccactgatcaacgctacaccacgttgaacaggcccaaccaacccacctgaactacagtgcattgagtcgatttattaaggtgggactaatcacggtgaatctggtcgaccgcccataaccgcgggcacggctattcgaatagttttactctgatcagaggcgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagttgcattttagttggataattacgaccatgaagcatggccagatgtctcgagcacgcagctcaatctgatactaaaaaggtctaatactgtaattatcccatcaactgagctagtggtaattaagcatggctaagcatatagttctagctaggtcacataagtaacatgagctagtcgattcattacccaaagttgacaaagaacagatatcaagtaaacatagcacaagcgaacagataggtaatacccggatcccatgtaattagcaaaatatgcatatttatttgcaaacagtaaaacatttgtaaattgggatcaacatgctcaaggggaatgtgtgacttgccttgcttcttcaaacaatcttccgaactcttttcctcgcgaccgcggacttccgaaacgacggattctacacgctggcacgcaaaacgaggaaaaactctaataaaaaccaagaaaaaagtacataaaaagtaaacaaacatgtagagctcaattttagatgaattttgcaagttgaacggctcaattcggagttcgaatgaattagatatgaattttacaagttttgagccatttaaatgaatttctagaattaaactcgatttattgcgcaattattatttatttttacaaaggaaatggacctcgctgacgtcatcaagggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacggccacgaggcggcgcggctggggcacgggcacggcatgaagccggctcggccgagacatgacgcggcggcggcaaggggaaggcggcaagggggaggcggcaaccggctgcagcagccggcgacgtggaacggcggcgggcggccggaggacagcggcgcgcacggggacggcgacgcaccccaagaggcggcggtcggcaagaaagggggacgggaaaaaaaagaagggaggagagatcctcaccggaagcggcggccgacgcggaggaagaggacggcgacgacgattgcccaatggcggcttgcgaggacggagggcggacggggtcgcccttgaccttcagaaggagaggagggagttagggaggggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggagtcggcagcggcggcggagagaggtggttcgcgtggctacggcgctacggaggtggagaggggaaatggagcggtggccaagtttgcccgggcggcggcaaagctgncggtgtcggcggaccagtgcggcggcgaccctagcgacgggaaacgcgggccggagttcgccggagtgtgncggcgcgtgggagtggcgtgaggagagcaagggagggcgcggcggcttggggaaaattggggaaatgagagaggagaccacggggatcgtttttattggctcggggcggtgggatcatggccgcggaggacggaatcgaccggcaacggtcttcggagtgggctccggcgacgtgggcgaagtggggtggttcggcgccggttttggaggggggaaagtgggggaggagagtggaggaggtggggcgacgcggtcccgcggtcggggcgagcgcgcgggtgtagaagaagccggaatcggcggcgacgtggggagaccgtgccgacggtttcggctgagggagccggaggttagggatggccctgacaggtggggcccacctgtcggcggctcggggggaaggagagaggaggagacggttgggggagaagatgacaggtggggcctcgggtcccacctgtcggagagagagggagggagaggccggctggggagacaaagcagacttgagggagagagagagccgagcgggccgagggagaaggccggcccgagagggagagagggggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgctttaacttttatttaatttccagaaaatgcattattaaatgatttttaatcccgaacgaa

SEQ ID NO: 840 - DNA, 3534 bp, Oryza sativa
aaccgggactaaagatgatatttagtcccggttggtaacaacaaccgggactaaagatcttcctcttattaaccgggactaaaaatcatttttagtctcggtttttaatggaaccgggactattgtggatataggtcgaccgaccaaagatggtttctctaccagtgcccatttcttctgttcatcttcttgctggactctagtgcatctttgttggttgttttcttcccgtcacccgttttgctctttccttccttcctcctgagggtatcatccgcatgagcgcatctgtcaatgatctcgaacaacttgcgagcggaggtgacccgtcttgttgccaactcttgagttgtatagcgatctcggacgcctgatctgaacacgcgaataactgaaacatcggtgatttcagggatcatatttcggcatttattgaaccgccgtatatagtccctcaaagattcacctaggttctgagttaatgtgtggagctcgtccttgagcgtgtggcacttgtatgtcccttgaaaattggcgacgaactgctaccacaagtcttcccatgaagagattgagcggggcgggagatgcacaagccatgaacgagcagatcctttgagtgcggccggcaaatagtttgcgagtgcgttgtcatctgctcctaccgcatagagaaccgtagagtagacgcgtaggaattcctcttggtcagtgctcccattgtatttctctttggctcctggtcgaaacttttcgggccacctaacttctcgtaaagttggagtgaacgccatgcatccttcttcgggtatatggggtggtcggtgccctcgcggtgttcgagaaccgctagccgctgatgatgatgacaaagacgatgaggggtcactgggatttgggctttgacctctgggtcgacatccttgttctcgatccctctgtggatctggggagtgtgaatcccgtcgtcgtctatcggcttggcatcgtcgacctcgtccgttgtcgtcctgagctcgctgcccatggtggttttcgtcatggtggttttggcgatcttgtcagttttggtccccacttgggcgatgtcctcgacttccatcattgtttcgttgtcgatatggtgaacgtcgctgctgatgattagcgtcctcctgttttcgttgttcccccccgacgcccatttaggtggccgtgtaagtcacaattttctcgtggtggtgggctttgctgacgatgtcctcgtggagaggcattacgcggattgcggcctagatcgtgacttgggtgactggggatctccgtgggttcgtggttcccatcctcctgcacctcttccggttgtcctggaagtcgtgaagggccctgagctgctggtccagccgccgctgcgaaagcgctgttgaggttagccattgtagattgtattctttcaaccaaattattagcgtcaaggaacgtgattgggtcaaaaggtgtcacatctagaaatttggtctaaatttccagactattttgcgtattgaatccctgtccaagaataagctagggtacaaaaaatgacaagtaaatatacagatccaaataatacttataaataaaagaggcacacaatcctcacaccgaaaagaaagtagcagcagcagaaaaagaagatcctagcggggcttcagctccactccacaggcaaaactcaattggggtataaaccttggtcctctaacctcatctccggcttagaagcactatacttttcacatacttctgaaaagggggaataatagcaaggctaagtagaggaattagtccggtgtgtccccgggcgtcggctcttgtgccgcaacgagcggttctaaggttagtgtcatccatccgccaagaactgcttaatttgtgacgatatgttctcacttgattgcttacttaggccacagaagttggcggaagagcaccgtctcatcgaagtcggtactcaggaggtgctgtctgagctcgcccttatgagttcaatctccacgtcgtcagatgggcgggaggctcaactcgagagtgaactcaatgagacgtgtgaggaccttcaaaagatgaggaacctcgttgccggacacgaccaacaacgatagggcacctagagtcaatccgggatggcttgaggcaaaattatacatgacttgaccagctggcgcggaacctaggggtaaacgtgaaggtcccaccacacttcgacgatacgacgctggtttcctcgctcatggatcttatcaagggactggaaacagtccatggtaagcatgcggaccacgtaaccgaggaaatctgcaccggcttgcgcaccggtcccagccatgtcctcacttgcgtccggcacatgcaccacgagatcgacctcatggaggtccttgaaaagggtggggccgacccgacgcgcgaggacgtgttgtcgggggtggcggacttaggggaaagcatgatccccttctttgaggagtaatatttttaaactcgatggtttgtattaacttaaatgtaatactttgggcccgctttgtccttaggtagaacaatttcgcatagaggtttttgtattctatagaggtattgttgacgaggatgtccagcatggaggaggtcctgatgttctcgatgtcgagcctgtttctcccgtgactttgtccgcctcgaatgtcaacgaacgcgctctagtggcggtggacccgacaatgtgctcgtcccatctggttagcacttaagctcactcattcggcgtactctaggttgggtcatcagcctctgaatctcagtcttcatagataaccacgaagttggatttgctaaagttgttcccttttgtaggcctcgaggatgcacttgaagagagaaagtgccgtgccacatattggaagacgaaatttgaggtggccaagcttgagctttccatcgagatcgccaaaaaggatcaagacgttgagacgctctgaggacgcaagatctggctgtagaactcgtatctcaacagccattgcgacgccatggcggatgtttgcagggatctacgagtagcgcgtcctcctttggaagaatctgtaaaatcaaaggtgtttttgattattattctgtgatgaacaattgggcattggagattattggttttgttatttggaatttattcacgaagtggttttggagatgattggatttacaggtgatcgcaggatttgtcattttatatgaccggtcagaccgggctctggtagccggttagaccggcgtgtaacgcgcggtcagaccggcgcagcctgcggtctgaccggccgacactgtgtcggtttcggtttcgggttgtttatttggatatccgagtttatttcatgattatgacttctagatggatactatacgtatgtaatactattgtttgctgctaataagtcaagttggagatagcttggtctcggaatatggtttctttgtttgttccatgtgtaggtgactcgatgtctcgggagagtatttgcggtgatggaccgggagtcg

SEQ ID NO: 841 - DNA, 5465 bp, Oryza sativa
agccgacctcgtcgtcgtcgtcgtagtcgctctcgtcttcaaaaatacgaccatcctccccctgaacctgtgacagtgtccctgcaatttcaggtctagtgccaggactagcctcatcaaaagaaacttcgcaagtctcaataattttgttagtccctaaaataagtacacgatagccacgagtgtgtgcggggtaaccaagaaacaatccatcggtagagcgtgcctcaaacttatccaaatttccagatttcaagacaaagcacttgcaaccaaaaacacgcaaatgtgaaactttgggttgatgtccaaatcgaagttcataagaagtttttccaagtttagatcgcaagaaaactcgatttgaaatatagcaagcagtgttaatagcctcagcccaaaattttctaggagttttgtattcatccaacatcgttctagccatctcaaccaaaacacgattttttctttcaacaacaccgttttgttgaggaacacgaggagaagaaaattcatgttcaagacctctttcgttgcaaaattgttcaaatgaagcattattaaactcaccaccattatcacttcgaattcttttcaaagaaccaggaaattcaagctccaatcgtagaaacaaaccacgaaaatgttgaaaagcttcgtccttagttgccataaagaaaacccaagaatatcgagaaaaattgtcaacaataaccaacacataccactttcctccaatagattgcactctagctggaccaacagtgtccatatgtaatagctgtcccggtgcatccgtcatcacagaaacaataggagcatgtgaagtagaaaccatcttagcatgacgacactgtgtacagaccaaatcatgatctttcttaagtttaggcaaaccacgaataagatccaaaccacttaacctagtgagatgatcaaaaccaacatgtccaagtctacgatgccaaaacatcacatctttatcaaatttagcaaccaaacatattatcacaggtgaaacagcaaaaagtcatgacaacccactcaaataagccgattgcaccaggacattgaaaggctgttttatgtatatcttcctcagccataaagatctgattataacctgcattcccatccataaaactcaaaatcttgttttctgatgcggcatcaaccagttgatcggctactggcattggatattcgtcctttggtgttgctttatttaaattacgaaaatcaatacacaccctgaccttgccattcttcttaataactggaactatgctagatacccactctgcatatcggcatggacgaataaatccagcgtcatataatctcttaatctcagccttaacaggttcgagcatatcggctttacatctcctcggaggttgctgatgtggcctaaatcctggtttaaaaggtaaccgatgttcaacgatcgatcggctgagtccgggcatctcatagtattcccaagcaaagcaatctctaaactcttttaagagctctattaacttggttctgaattccgaagacaaacctttgctaataaatgtcggcctcggccgatcacccagacctatatcaatttcttccaaatcatcggccgacataaaaccttggccctgcttatcgtcgagatcatctactgtatccttagcacaggcctctgaaccctccacaacgccctcaaagtaatagcttgggttctccatcttcaatcggctgtatatcagaatcggatacttttagaaaatctccatcccaaacttttccagataaacaatcaaggccatccatctcccaaagagctaaatcagcattggcaacattaactgacctgtcggctggcacaacctctatcttgtcaccttgccactgaatcaagcactgatgcatagttgaagggatacaacaattggcatgaatccaatctctcccaagcaataaactatatgaacccttcccatcaatgacaaaaaacgtggtaggaatagtcttgttgccgaccgtcaactccacatttaaaacacctttggtctctgatggattactgccaaaatctttgagcaccatatttgtcttgatgagatcctcggcgttcctacccagcttcctgaatgtagcataaggcatcaaattcaccgcagccccaccatcaaccatcattttagacatcggcttcccattgatgtagccatttacatacaatggcttaagatgccgattctccgttccctcaggcttctcaaataccgcctgctctgatgatagggctagcttagctgattcttctcccacttcatcgacatcggcctagctgatcccgaactcggctggcagcgtaaagaccatattgattagtgctgtaacaacgctctttccttttgccaacctctttgcttcatcagctgtagcatcatcagctgcaggagcttggctcttaacacgccacacctgctttggttttggtttcctcagccgatggttgatttcctcttcaacctcctggaaacgttccctgctcctcaatctctagaccctccttttctgattcttcgtaaaaataccagaaggacaccattgattcttcctagtcgactcatcttcttgattatgatcttgactcatcggacccaacctttgatggacgggaagtcttgtctgtctaggccgatcacccctactatgtggtcggcttgagctttcaatgatgtcgctacacccaggacaatttttgatggatggcaacctcattctttcgttccagcagaatctgaagaactcgcaatcccaatgaggatcaaaaccattgtcgttctcttcataacgtctcccctgctgcttatcatacctcctttgatatttattaataatcttagccgaatgtacttggaaacccttcgcacgagatccatcggctgcttgacttgctgtatgcaccatattgacaggaaaaggattcccatcgaccttcatcggcttcttggaatcgtcaaacttaatttttcctccttcgatggccacctggatttgctgtctaaagaccttgcaatcgttggtagaatgagatccagaattatgccacttgcaatatctcttcttgcctaattcctcagccgatgggatcgtatgaccagcaggaagctgaatctgcttttctcggagtagcaaatcgaagatcttgtcggctttagtgatatcaaaatcatattttttctcctttccaggactcttcacccattgacacggtataacctttttgctcctcacccattcggctgcagctatctcagaatcatcatcttcatcgtccgattcatacatatactggcagacatgattaaccttcttagagctccttctgacatcagccgacctatgctcatgcaaggttaccttttgtatcagatgtgataagctatcgaagtcttcggatgagaatttttccctgatcggagggatcataccctggaaggccaaatcggctaactgggcatcggtcaagcttaagctgaaacacttgttcctcatctctctaaacctctgaatatattcatgcacgggttcatcataccgctgtttgattgctgttaagtcggacaacttcatctcgtgaaccccgctgtagaaataactatggaactgcttctccaaatcggcccaactattgaccgatccatacggcaaagatgagaaccaagtaaaagctgacccggacaaagacaatcggaacatcctaaccctcaaggcatctacagccgatgcttctccatactgggcaagatatcggctaatgtgctcataggttgacacgccctcttgtcctgaaaatttagagaaatccggaattttaaaccgattaggaagaggaaccctttcaaaccactctggataaggctgccgatacaagcttccagtctctttaagtttgagcccgaattgtttcctcattacatcggcaatcacatcggcccattgtcgctgctgagctgccccttgtggttgctgctgcatggattcaaactgaccaaactggggagcgaactgctgctgagccgatcctcctggctgatattgggcttgtatagctgaaggctggtatcgataacttaagttacccccttggtagtcgtgcagatccgactgaatattgcgtgccaagtgctcggggaccatctgaggtatcacagtgccatctggttgtatatggtgaactaaatgttctggagtagcttggttcccaaatggctgcacaagttgcccccaaggtgctgcgaacccagccgatgcattagccgaccccaggtgctgaattggctgatgccgtaccggagtctgctgaatcagctgaagccgttgcctcggcggtgtttgttgattcgactgaaaatgctgttgcggcaatgacgcttgctgaaccggctgcgcgacctgttgttgaactggttgtaccatcggttgaactggtggcgcaacttgttgctgaaccggctgcactgtcggctggactggcggtgcctgctgaatcggctgctgttgtactgaattaacaacgggtggtggcaggaacatagcagcaacctggtcttgagttggctgattcgtgatctgttcagcaggctgtgggtactccctcattagtaatctgggattcatcagctgagccgccgcagtagccgatgcagcaggtacagatgttgatgccgacgctgttggttgggctatcggcgcgacagatggagccgcctgcacaactggctgagcatcggtgatcaaggtccggtaatttggaaaaactcctcctggcaagtaaaccgggctgtagcttgatgctcagctatcgagccatcggctattgccttcaccatgttcgataacatattggctaacaccccagactggttaattaaagcatggtgcaccgcgtaatcaatccgatcttgaaagttgttaaaagaatcctgaagaccttgactgaaatttcctcctggtagttcttggtaaacacgatttggagttccatgcacctctggaagattatcaccttgatttcctgcagaaccttcggtagcccctttgacactcggctgagccgagccatctgggtctcgcttaacatccccatctttagatgaaccgatcccagggatgtcggcaactagcttcaacttgtacttctgaacgagtgaccccttgcgggtctgcatgtaggagctctgatactgatcccgtgcttgttgcatcattgcttcgaagtcctgcttctgctctggtgtgaacttctcggggtcaaccggcaggacattgtcatcaataatgtcggtcagccctggctttggcggtttgcctttgccggagcctgggcttggcggtgctgttttttcggccatgaggaagatataacgtctgactcctaatcaggtcccaccaggcgtgccaaaagcgtgttgaca

SEQ ID NO: 842 - DNA, 445 bp, Oryza sativa
  unsure (1)..(445): unsure at all n locations
ccgttgcagactgctgttgaggtctcaaggacggaggatgggaggccggaggcggcgagggcgcgaggcgtgcaggcggccaccgggcgcgaggtgccaccgccggccaggcgagaggtgcggtcatgcggagacgcgaaggcggcgagccgacgtccggcgactcggcgaagcggcgaagcccgagaaggcgcaaggtgcggagccggctatggcctgtgggcagccggcgaccgggcgacggcgaggcgcgccgcgcgcgcgcgcagacgactagtaggctggccggctgggtagcacgaccggcggncggngncgtngcnnnctanccgggaataaaaatcaaaacacactatataatccatagtaccgatcctcttttcccgtccacacaacaaactcctccctctatctctttttttcctctctaacttcttatctcttt

SEQ ID NO: 843 - DNA, 2133 bp, Oryza sativa
tatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgtgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaagtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttct

SEQ ID NO: 844 - DNA, 7085 bp, Oryza sativa
  unsure (1)..(7085): unsure at all n locations
tccttgcaagaagtcggggtttctgatcctcgctccgaacatctctttacccttggcgttcatttccatgtaccattcatggaatttgtacatctgtgtcggtagggactgcagctgctcaggcgtgacaagcggtttaccgagttcaaacttgtatgccacttccgccttcgggattggtgcgattcccaatcagctgatccatagttagaccggtgtctgaaatgaaatccgttatgccaaaatcttcacctgtcaccaagggctcgacctcttggtttggatgttctccaagctgagggactggtttggacttcttgtgataggctttctgaagtgttcggtcatagtccgatagctttaaggcctccttgtttgttgtggacattcccttgaagaagtttttcacgctcgggtcaatagttatcttcttttcaggactccgaggcttgagttgcctctttacttctcctgccacataagcatcaagctcctcttgactgcaatcgtacggcggctccctgtttttggtggcgtcaactttcgccttcttcgttgcccttgtgcgggcatgcggtggagcttagcgagaccttgtcttgggaggtgcaggcggacacggtggagatggaggaggcggaggagccagaggagatggtgcatgaagagctggcggaggagccggaggagatggtgcangaagagctggcggaggaaccggaggagatggtgcaggaggagatggcggagccggagaagattgtgcatgagacaccgcttgtcgccaaggaagaatgatgtactgcttgcgccatagtataatggcgtggcttgtgtctcgtagatgcgtctcaccgtctcctcctgggtagtccaactcgagatcctcgtacgcggcttccaccagctcaacctcgaccctcgagtatcctgctggaatcgacctgcagtggtaagtccctgaaatgtccgttgggatggctatttccgacgccaccttcacgtgatgagaggttatctattagtaatcaacctaagcagaaccttgcggaatgtacaagtcaaaaatcataaaactacgagcataccttgattgataagttcttgaagggaatatgcagctcacatggtgtccgctgagtgatgtcatcaacggggcaagtggtttcatcctgggtttgcatggcgtccatgctctgtgatcctacctgccccgttgaggcgcaactgctacgattgcctgatgggctaaccattgcaggaggaatgtacggctggggattctgggaccgatgtgcggccatgcattcatccaccttccttgccacctcctcttgcatgctgagctcgtagctcgataccctgtactcaagatttgcaatcttcgcctcgatatctctcttactcctcatccaactcctgtacgtgtggatgtcctccttgaatctaatcttccagggaatcacgcctttccctcgtgttcgtcctggatgctcgggagtctgtagggcgagtgacagctcgtccttctctctgtcgtgtcggaatgtgccctgagaagaggcttccactgcgtccgttagttgactggtagcctcgcatatcagatcgctaaagacaagggagccatcaactgggttaagcgttccaccgtgagcatagtaccagaacatcgatcgattcggccatttagcggtggccggttcgatactcctctcaatcaatcttgcctccatctcctcccacttcggcattgcgacgctatagccgcctgaccctaagtggtgatggtacttcttcttggcggcattttctttgtttctaaccatcatcggttgcccttgttactctgtcttgtaagcaacgaactcgtcccaatgatcccttagctttgggaatacgtcgaagttcggtgttagtcccttcaggatgtatttcttgtagagatatcccttgaagctctggaactattctgccattttcttaagagtccactgtttcactatgttctccgtacccgcagggagcgtgaacgtctcgagcattgtggtccacatcatctctttctctgattccgggacaaagctgtcattatccccgcgtgcccttgttctacgccagtacaccatgctgacaggcacgttatccctcacaacccaaccgctgtggcgtacaaaattcttggctgcttctgccggggcactaggtcaaccgtcttcgtccacctcagttatgatgtgccgaccctctatcttcttcacggcacctcgttgtccgcgtgccctcttctgtccagcggagggatgacttccactagcctcctcctcctcattcccctccgcatccctctccccgttcccctcctcattcaagtactggtttggaacctcgttcccctcttcttcgatccaatactggctgcttccctctgcgattatatcatatagtatctgttcctcattgcgatcagccatctgttcgtacaagaaatatttgctaagtctataggtcatatttgctaagcgtaatattaaaactctactaatcttatattaaatctctaataatcttatattaaaattgtaataatcatatatgctaagtctaacaatcttatattaaatctctactaaacttatattaaaattgtaataatcatatatgctaagtctaacaatcttatattaaatctctactaatcttatattaaaattgtaataatctatatgctaagtctaacaatcttatactaaatctttactaatcttatattaaaattgtaataatcatatatgctaagtctaacaatcttatattaaatctctattaatcttatattaaaattgtaataatcatatgtgctaagtctaacaatcttatattaaatctctactaatcttatattaaaattgtaataatcatatatgctaagtctaacaatcttatattaaatctctactaatcttatattaaaattgtaataatcatatatgctaagtctaacaatcttatattaaatctctaatacaatatgataagtctaataatctaataatctctaatactcacatttgctaagtctaataatctaataatctctgacactcacatttgctaagtctaatacaatatgctaagtctatcacgaatctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgttcacgttcattcgcgttcgttaacgtttcgttcacgttcgttaagcgttcattcacgttcgttcacgtttcgttcacgttcgttcacgttcgttcacgttacgttcatgtttcaatcacgttcgttcacgttcggcaatgtcggggcgcgcagcagtggcggcagcggagcgctggcgtggcggcgcggcggcggcgtttcgtggcggcgtcggggcgtctcggcggcgtggcgtggtccggcggcgtggggcggcccggcggcgtgtgggcgcggcggcggcgtcgtgtcgcggcagcgtggcgagctcgaggcgggggcgtcggcgacgtcgccgtggcggccgcatggacgttacgtcgtcggcggtggtggccgcgtcgaagtcggagtcggcatctgcaggaggcgtagtcggggtcggggtcagccgcgagcgtcgacgttggcggcagcatcggcaacgagctaggcggcggcagtttggagagagagagagagaaagagagatcgagagagagagagagaggcagtggcggctctcacccaagagatgtggcggcggcttcagcggcggaggcggcgaggaccgcaagacgacggcgagagacgacggcggcgtcggcgtggggttgccctaggcagtggcggcgaaggagaagctgagatcgattagaggaaaaacttctaagtgttggtggagaagacgagggcgcaccgggaatatatatacccctagatctttagtcccggttggtgagaacatccgggactaaagatattttcccgctatttccaaattctttttaaacccgattagggttaagaaccgggactaaagataatagcactgaattttgaatttcattacatatgtgtttctaaaatagtaaataatgcattacaattatttaaagtcaaaaaattaatgacaaaaccttcgaaaaattattgttatctgtagtaaactaagtggataatatataataagcacatgaatgatttaaaattgttaaaaattttaataatcatatataattagcatatgcatgatattaaattgttaaaaattctaattaacatatgtaaataccacatgcatgatttaaaactaataaaaattctaataatcatatataattagcatatgcatgatattaaattgttaaaacttctaattaacatatgtaaataccacatgcatgatttaaaattaataaaaattctaataatcatatataattagcatgtcatgatattaaattgttgaaaattctaattaacatatgtaaataccacgtgcatgatttaaaaattctaataatcatatataactagtatatggatgatttcaatttgataaaaattctaataatcatacataattaacatatgccatacaacaattgatttgtatggatattcaatacatccaaaatagtttacatcgtgtacacaacaattacggcaatacatcggcggtgacggttgaccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttctttttcctgggagaaccacgtggcgcttcggctcgtcaggctctttgcccttttttcctttgctagacatgtccttgatgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgctagttgtaccatcgtgtcccatggcatcgatacgaacaacactgttctggctcgtgctcttcatgtcttgggctctcgtgtagaatgtgtacccattgatttcatatccctggaatgtcgcgatcgagccagatggtcccctcgccaggaaggccagttgttggttaatcgtctcattacccatgagatgttgtcacaaccacgcggagaaagtatcaatgtgataccgtgtaatccatgcatcggacttaccgatgtttctagcacgaactagagccaagtgctcctcgatgtaaggagccaccaatgaagattgttgcagaatcatgaaatgggctttacggaataaattgttgtctaccgtcattattgctttccttttgagagtcccctttccccgtagtctcccttcatggcgtgattcaggtaccccgattgggcgaaggacttcaataaattctacccagaattcaatgacctcctttgtttcataccccttggcgatgcttgcctctggacgagcacggttacaaacatatttcttcagaacgcccatgtacctctcgaaaggaaacatgttgtgtaggtacacagggccgagaataccgatctctttgacaaggtgacaaagcagatacgtcattatattaaaaaatgaaggtggaaatatcaactcaaaggtgacaagacattgcaccacatcattctgaagggcttctaatctatccggatcgatgaccttctgcgaaattgcgttcatgaaagcacatagttttgttattgttgcccggacattgtctgggaggataccccttattataattggtaacagctatgtcatcaacatatgacaatcatgagactttaggtttgcgaacttcttctccttcgtgcttattattcgctttatatttgtggagtatcctgacattaccttgatgctctccaagcattcaaacatactttccttctttgccttgctaagagtgtagctggctggactcaagtaatggcttcttttctcctttggttccgggtgaaggtcgccgcgttgttccatatgcttcagatcattacgtgcttccagtgtatctttggactttccatatacacctaggaagccaagaaggtttacacaaaggttcttagtgacgtgcatcatgtcgattgcgtggcggacgtccaagaattctcaatagggtaactcccaaaatatggagttttttttccacatcgccgtgtgaccatgttcgctctatataggctgggtgccaggcccctttccatacactactttaagatctttcaccatagcaaacactgttttaccgttcagatgttttggcttcgtacggcggtccaccgtatgttccaaagtgcttgcctttcttccgtactaggtggtttgctgcaaggaatcgacgatgacccatgtacacaaccttcatacagtgcttaagatacgtactttttgtttcatccatacagtaagtgcaagccttgtaccccttgttggactgcccggataggttgctaagtgtaggccaatcgttaatggttatgaacagcagcgctcgtaggttaaactcctcctt

SEQ ID NO: 845 - DNA, 29957 bp, Oryza sativa
  unsure (1)..(29957): unsure at all n locations
ttcttcgttagctgcccgtcaacttctcctggatcatctcatctaatcttgtatcgtagtgctttacaaacagggcatgcttctaggttctcgtactcctcaccgcgatataggatacaatcattcggacatgcgtgaatcttctgaacttccagtcctagagggcagactatcttcttagcctcgtacattgtctcgggcaacttgtttccctccggaagaatgttcttgatgagtttcaataaatcgccaaattccttgtcactaataccattttttgccttccattacaagaactctagagtggtatccaactttttgtgcccctgctcgcaacctgggtacaacgacgatctgtggtcctctaacatcttgtccaatttatgggcccccttttaactttcgcagtcctccttggcgtcctgcaacatctgaccaagatcattcgcaacgtcattaccatcagcatccctttcctcctcgcccgtttgatttccttcgaatccagcgtactgaccgaagtccggaatattgtcgttttccacttcatcttcttccatttcaaccccttgctctccatgagatgtccaacaaatatagcttggcatgaaccccgactcaaacaagtggaaatgaatagtcctggatgtagaatactccttctgattcttacacttattgcatggacaacaaataaaacccttatgcctgttagcttcggccactctcaaaaaataatgcacgccgtcaataaactctttggaccgccggtcagcgtacatccattgccaatccatctacatgaaatgaaaacaaatcgtacacaaataattattcgtacaataatgacagccatacaataatgataaaatcattacaaactctgtcaacagtcataaaataatgacatatcattattcatacaaaaattataaaatattacatcaaataattcttatttactatttctaaagttttaaactaatattaatttgttgtagttcttttaattttcattttagtttgttttctattatttaagattaactttcactattttttccttctcaactattttataaaacctttcaaataaactaaatttctatatattctttctttcccatacaaattttctctctcatcaacttacaacaaaattttggagacaaaaaagtgtacaaaacatagctccaaatgtaatatgacaaaaaaaacattagaggatgaagttgctaaccttttagccacctccgatttgtatataatcaccaaaataaattcactcgaaattttggcatgacctcttctcttttttgaagaaattttgaagcttgctcgggctggaggaggaagaaaaggggtgggactttagtcccggttggtgttatgaaccggggctaaagatcgccgggatctttagtcccggttggtaacaccaaccggtactaaagttatgatctttagtcccggttggtgttacaaactgggactaaagatcccggggggcctgacaagccctgatagcatttgaaccgggactaaagaggttggtgttaccaaccgggactaaagatcaaatatgcccgttaccctttttaaccgggactaaagatcatctttagtcccggtttttattgtaaccgggactattgtggaattcggccgaccgacgaaagatggtttctccaccactgatactatatggcctacctgtatatggcctacctgtatatcaaaactcaaaagtggactacattgcctaaatgtcgtggtcgtggtcgtgggtgttacggaatattatctcccagggagataagatcctttcttgtgaaccaatctgaatcggagtagagataaggtctatctcatcctaagacccctatatatacaggggcagggtgtgacatatgaggttggcttgtactcagaagagatctataatgaagagagagctccaccctatatctgtgttcattgtctatttctgcaatgtttttaagggtaaagggatgggcgcgggtgttctacatcatctcacgcctctactgctatgggagtaacaggaaacggatccggtgatccgctaataggcgcgttggtttacaacacgttatcaacagctctccgttcactggtttgttgctccaatctgttattattattagattggattttaatgattgattaatctcttgatattttcgttgtttgcatgcactaccgcgagaggtgctaccgacgtgatactggtcggtcatcgcgttgcgctatgctaagaggagttgccgtccgtggtcggcggacgtccgtggtcggcggacgtggttggaggacggcgttccagccctgcaagacgcgagccgtgcgcgcctgccttcgccgtgggcgtcgattctcgccgtcgtctgcgagacttcacgtcaatccagtcggcaaaccccacaactgcatgctcgtgcgccgctgggcgatcagccgatcaccctgtgactcgcgtccgccttcacgtacggcgttggcagcccgcgtgttaccgtgccggcagtgccgcacgtagcggcatgcaggatcgatctatatgcatgccacgcatgaacgatcccatccatgccacgcatggcctgagtcggacgggcctgcaccaagcgggcaagcggccaacatgcatgatgcatgcactagtgagcagcctagcatgcatatgctagggtttgattgcatatcgttacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttgttgccgctggagttaatgctgaagtgaggcgccgccgccgttgacctcccatcgacgctgccgtcgagccgtggtgggaggatgatgggtcattggttgcctactatcggattaatctccgccgagacgatatggccggatgcaatttgtttgctgttgttggggtctcagttgctgtaacgccccgacattcgttagccataaacacagctaattcacaccgaggtgttatgcattacctgtgatatagtaccagtcccaggatacactagcttttacacgcagaataactgtggaatcaaagaaaactgttttattacatcactgggtagtagtccttacataagttgccaccatggacaggtccatagatgagcaacacaacattacagaaaaccataaaagcgacgacgcagaagcgaacagcgcggagaactaagcgactagcgaatagcgcggagaactaagcgactaagcgactatgcactaggcaaagaacctaggcaactaacttattccacaggcgagctttggggctaggcacgaaacatctagaagtctgttgacggttcttaaatcataatatctgaccgtcattacctacatataatgaaataaaacatggtatccaacttagtggtaggtattattactaatcatttccactagtgttggtgaaatatgtgtatgcaggtattttgagaagaaaacacatccgtcaagcaacaaactgcacctccgcgcattcaggatacatttacacggattggaggccccataagtcaagtaaacaactccaaatgggcccaactatcatgccaataggctgagggtctcaaaattagtgtccacgataaaaaatgggccgaacggagccgtctcgagttcggcccgaacactttttgtggccgttgatcgtgagattcgatgtggatggccctgatctcttcctaatgatggttggagggtagtttggtcgtttcccatacctgtaaccgtcatatggaggctataaatagagctcctctcattcattcacaacacacaactttgagctgaattacaagaggctcttttgtatcttttctacattagaataaggtagagagtgagggcaagctctggaggagtgcccggaagtttggcgctcatccgacttctacctcgacgagtgtagcttcctaggaggaattctggaggagtaccggagctgtcggtacactctgctccgggttcggagaaccttcttctattaagtaagcattcgtgttcctttcttatgttatttaattatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacggttgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccttctctggtagtatcggtgaaaacccatacctctatcttcgggatcttgagctagtgtgtttgtgcctatccatcgtaggcatgacacatgaaactctaaagtggaagttgtttcctttttctcttagagataaagcgaagcaatggtacactatgtctgtcaagaaattccacggtgaatgggaggagcttaagtgcaatttctgccttactttctttccattaacccgtgtaatcaatcttcgattagacatcctttctttccgacagaatgagaaggaatctctcggtgcagcctgggccaggttctcattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatacactatagattattataaggggcaagggtgagtacttaacgtactcagcaagccaggggaaagaatgacatgtcggtttaacaaggaggctaggcttttatttgcgaaagctgcttttttggcaaagtgatttatttcacaaaactcctaatgagtgagtcaagttttagttgtcgggaggaggctcacgcctcgacccatttcacaagttgctttgcaacaacttgtcacgattaacgaacaacaattaatttgtttcttctattagcttcttctcactttcacaacaacacatagtccacacagacatctcagcacaacaacgccatcaaggccctaacaacacctcggtgtcggacgacaccccaggtcacatagacccgttgctaaccacccaggttagccgtctgccacacaggcggactctggaaacgttacccttcccaataaccacttcttcacaaacatttgtcaaacaaatctacgctatgagaaacaccttacacttgcccttgaccgtgggcacggctgttcgaacagttcattaatctctgcagaggttgcacgctttacccacacgagacgaaactgacatcgtttacccgtcggcaatgaaagttcgtgataaggcctttccaaagctaacccatgaaaatcgcatgccacctagttgggctaagatccatagccgagtatcaggcaatgatagccgtcatccactcaggaaatactgaggatgcctcctactcctactggtaccacgccacaatagaagcaaaaagacacccatgatgggcaaaaatgtgtaacacttcgtctcctcatcctcggcatcccacaaccattggcacaccaactcccatgtgataacaatttacttagccagaggcatcccataaatacccgtgtggtcgcactgtaacgtgtttggatggatttcccaaaggaattggtccttaacgacaatacgtagccaaaccacaaaggcatgactccgcatcatcaccactttcacaacacattttatttcacaactactcagtacaacgtaccggatttttaaacatgtatttggaataacccaagtttcccacatggcaaaacctcggtaatcgtataacaataccggcacaaatatttgtggagctatcaaatgtatggaatcatcaacctatgaaatataagtacgactactaggttggtccattggttgaataaacaatccgaggcctaacatgttaatcgtgtaaactaaataatgcatttttgcaaacaatgtatcattgaaaatataggggtaatgtgatcaaagaggcttgccttgcacagggtgcgggtcttctccctcgaaagcggcgtccgaagcttcctcgtacttaggctctaaacgtggaaacaaagctaattaagaaaagccaataaatctagctcaaatcagagaaacaatagtggcactgtgtagatttcaattttagaaaaatttaggaacttgaacggggtcaatcggagttacggttgattttctacgaatttctaaagaataaaagaattttctggaataacaatttttggacggtaagggaatattccgttggaatattccgttagctgggacggcagaagaggggacccacctatcggcgatggatgggaggaaggatgcgcgggcccggcttgtcagtgggggatggaggtaaaaggggcatggggtcagcctgtcagcggctcggctccgccttcttcttcctcctctgctcttttgctcggctcggtctgggatggcgacgcaccgcggcagcgagtcccggctcagcgaccggcggtcggggaggcggcggcgaactccagcgaggcaccgccggcaacggcggcgctaggaggcgcggcgcagcggctctaggcggcggtacatagagtgaaatcgtgagaaagagatagaagagagagatggtgatggtgtggggagaaggagctcgggctgcttccccttttataggcgggcgacgaggtggcgagctggcagtctaggcgcggagctccgggcgtagacggctagcagctagggcgggatttcgagacggatgagatggtgaggcgacggcgatgcgacgacatggcgtcatgcgctggtggcaatgcgacggcgaaacgaccgcgacgcgacatgaagtgacgcgcggagagcgggaacggctgcgagacgtggatgacgtatggccgacgacgactagggccgggatttggggcggtagggatagagaggggtgacgcatgcagtggtggcaatggaacgcgagagagagggagagatgcagccacgtcttagcggataagctccttcgcgtcgaagtaaacgagaacggataagcaagggcgattggataagagaatgactcagcctagggttaggggtgacgaagggtgaggtcgcggccgttatctgttggcgtcgacgcaacagcgaagggaaggcgacgcgatggatggagttaaaggcgacgggacggggtgacacgaggcaacgtggctccgtgtctcccggaaagaaaccggagcgaggtcgggcttggcgcgacgcggatttggcgcggcgcgggtgccggctcggtgcgggggtggtgtggcgcgggtgttggcacgacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcgttgagttcgcctcgccgccgtcatgaggatgcgcgggttgacgcggagctccgtcgtgtgccaccgagccgccgccgcaccatattgccacacgggagtgatgtcgtcgccgccgtcctgccaatcaggtagtggacgggtcatcgatgacctcctcgccgtgtgccgccctaactcccttcaaagtcgacagacgacggcctccgacgctgccgccgtgctcgaggggccggtgcaccgggcggtggacaccgttgcagacaatgaatgggaaaggggaaacccaaattccccccttctcttgctcggtcatttaggcttaccagttgggccggtctacctccgcctgaccgaataaagcccaacagtaacgagacagcccaaacaaattaataaaaataataaacttggaaatcctcatgggcctagagtttcggaaattcggcccattaggcattttgggctacactgtgcttgctagcccaaataagatcatggcctgaacggtaattcggcccgattaatttcggtttattgacaacttgcgtttaagcccccagagtgctgggtttttacgctatagttcactgtttaatggaattttacagtttgaaccttataattaacaagagattatattaattttatttgtgtggctatgtcttgttgcttaggccctgtatagtttggttttgcatgtgggtctccggactcgtaaataaccatgtaatggtgttttttaagcattgctttgcttttaaaattgatgcaattccaactaaataatctggagatggttttctaggttatgatgcttccataaattgtgttcatatagtgtagaattcaacccttggaagcattatgatgggtttattttcctgcatttatgtgtgatggttttctatgtggtataaatattgggaatataatgccaaataagaccaagtaaataatagaaaatcacttaatgcatggaaattctaggaaattaaatatccatggctatggataagaccactctttactgatacactcctccatacataaatggtgatatcgatgtgtctacaagatggagtcacgtatacttgttgttgagatccatgcttttgccgaattcactgcgcatatcatctacttgcgtgctgcgttctctgagaactgcatgaaacgatttggatgatagtgtgggtgatttcatgtaaaggccttcaatgactattgtatggctttgggcattaatatagatcactctatccctatgatcacactcaagaatgggattctgagtcattgaaatgtgtggaataagacaatgtgtttgggattcattgtgcctttcccctactggcttaacatctcaatcagagtatggtcggactacggtcgacattttgctttcccaatggttgagagcacgcttttctgatttggagataaatgattatacctcaattctctagcaacgtggagttgcgaggttcaatagtttgagatatttttcactcggtctagtgaaagatgtaaagtgttttccaggtggtggaatgacactgttcgtatggttgcccttggtgtgcacatatcttctcactattatttggaacctgatgtcttgcgaggacaccggaaaattggatgcaaatctagtggaataagcccgagggtagatgctgtgaataggcatgattcccactccactatagcgccaacagctaaacttgggtgttgacccagtcttggtcctcgcatggatctagcgctaatgaccacctttggttgatgccgatggttggtggtgtctgtctaataagttgttctgacaacgggagttgtattgctagtttagagcatgtcctaggagaacattggtcgactatactgttgccaagcagtttatcttttgcttagtttggaactttgtattagatcaatatttctcagataaatagcgttcttggtctttcctgttctattctaaagcttatcttcatgctggaattgataaaatgctttagtttagaataacaattagtgtatgatccgaggagttacaaccacttacacagttcagcgtaactgtatttcaaacaaatgttggctatgcactattgcgttttatcgcgctctcgtagttgatgactactccctggttgtgttggttgatcacccatgggttgatgaccatgcttgtcgcacactggcgtttttcgcgtgtggacatgtgcgagtcatgcaaaggttcgtcgtgttgcatgcgttgagcttgttatgccaacgacggttgcaccgacacattctactatttttgtggatatgtctgaatataatggttttattgtgaatattaccattgttggaggtattgattatctcccaatggctatgtctaggggatattagcaaatgtggtttgataattcgctcgtgcatcatacctaatacatgctgcttaactataacccaattctagagtttggtatgagtaattggggtcaaacttgggcattaaacaaactggacattaacccaactctgcaccacaaaaatctgcttggcagcgtaggctagtggccgtgcatttttgctatcatactccttgtcgagcgcatcggaatgcgttttgccaccataggttgccttcttaagcatatgacatgggatgtctaatgcacgtcgatccggaatcgattgtgagtttgaatggcacaaggtgagcattaatccatggagattgcatatggctaaagtatttgcatgttggttgcatatacatttggtagcaatagtggtttttgcagacttgtatatcctaactaggaggttgaggataacccttcggaggaaggaagaacactgtagtcatgccactgtattggtatatatccaggctcactttaatgcaaaaatctctccgattaaagtgcataatatttcccaaatatatcgccaccgtagcatacattcatgggagaacatttgtgatcgaggtgaaattcctaaatcctatgccacgatatggggattggtagtatgctattgtaagatatctcggcattagggggagagaattgcccattttggaatgcatgtacatttctttgagtgaacgcactaaatgagctgaatttgtatgtttagttcatactcctggttgcttggtgcacggagtttttgccaacaaaatcatatgaggaacaactggatagttgttaaaaagagtaatgctcccaattatggtaaatgtggatagacccgggaataatatcgtatccatataagacttatggaatttgatcatgttatgtgaggacgcctgctaacacgatccgtgggccttagtcagagcataagagttctcaccggatgtgagcatactcctctgattctcctagtggagaattcaccttcggaaggtgatatacctcataatgatgttcgtcgtggagacgacattcctagcaattcgcacatattatggtgctaggaatatggaacaaccatggatcgatcgttttgggaaatgacgaagatctggttaaatgtgtaagtgggaataaatgtgtcgcctcttgctaatgattctctgtgagagaacccggatctggaaaaagtccatggcatgagcatgcgatgctcaaatcgggtcaaatggaaatgcaattgaggctgaaccgaatcactaagtaaaagtcgcgaatgttgttcggatttttagggtcattattgagataatgaggtggtgatgtgcaatggttcaagtaggtccttgatgagacctctcccacgtaagttgaatgttccgctaaataaaggtattggcaaaatggcatgaaattaaatatgcagttaacggatttaggaaatccgtgaggtcttgaatagactccgtagtgaagttgcagcatgtaaatctcgtaccaatgggtattctgataagagtaccatttcccgttgggagaaaatctcattgatggatttttctctgaggggagacctcattgatgaatttttctctgagatacaaaataattagtaagtctgaacacaccatattgtataatcccttggagggattaagacccatttatgacccggtaagattgcgatgaggaacctgctaaggtatacttagtgttgttggctatgtgttatctcccatagtgcttaaattttcagactagctagttactctgatagttacaacatatctttggaaggcttgtagttgatcttgtggatctccaattgttgttgacatcgtcagagaaagttgcaatgatcaagagatgtgtttgcttggcacgtggcctaccgatgaataatgcggtcgagagatgtgtttgcaatatggggcgagatgttgccacaggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaactttgccaataaatggtataattgaaaatgacaacaatctgaaaagcaccttcttgtaacctgaaagaagggagtacaagacaatacaccatgtacctatagtacgtatatagcatatgaaacgatcaaatgcctatatattgttgcttatcctattgctaccatatgatgcatcaatcaaacaaacaatactacgctttcaggttaaatatttctctcacacttcatttgattactcgtttgttgatctcaaataatatattggatcatacctgtctaacaaatttgccggtcaattcaggtctttgaccaatgggtttcaatttccatccggtgaacgacagcgactggttgatcagggcggcgatgctgctgagcttcaccctgcaggtgatcctcgtctttgtcgcgcccacgcgcaagcgctcctgccacccgcttccccacctcgccgtctggtccagctacctcgtcgccggctgggtcgccgtcgtcggcctcggcctcctcctcaacagcctcagcatcagcggcagcaacaatgggtcctcctccatcttcgccttctggacgccattcctgctgctccacctcggcggccccgacaccatcaccgcctactccctcgatgacaacgagctctggctgcgccacctcgccggcatgctgttcgtggtcttcgccgcattggtcgtcttcttcagctccgtcacgagcaaccccatggtcacggccaccgtcctcgtcttcgtcgccggcgtcatcaagtacggcgagagaatctactcgctctactccggaagcgtgagaggtttccgcgacaagatgctcggcgagcctaatcctggccccaactatgccaagctcatgacggagttcgagtccaagaagaacgccggcctgatggtcgagatcatcgtcgtcgacggcgagcacaaggaggcgctggagcaggcggaggtgatgaagaacggcaggaagagcgtggagacgatggcgtacgagctcttcgccatgttccgggtgctcttcgtcaacctcgtcctcagctacaaggagcggaggatcagccaggcctacttcctcgacctcggcgacgtgatgacggccgccgcggcgttcgaggtggtcgaggtggagctcggcttcctctacgacatggcgtacaccaaggcggccgtgtcgagcaccaggagaggctgcctcctccgcttcgtcgccacggcgtgcctcgtcgtcgccgtcgtcctcttcgtgctcatggacaaggccggcgtccgccacgtcgaccgcggcgtcacctacgtgctgctgcttggtggggtggcgatcgacgtggccgggtacctcatgctcctctcctccgaccggacgctggcattcctcgacggcaagccgaagctagcttggcttgcacgggtggccagggccgtgcggctgccgacgaggcggtggtcggagcggatcacgaagatgaacctcatcaggtacagcctaagcaagcccgaggaggacgccggccgccggtgctggtgctgcaggtggacgacgatcccgcgcgtcgtgcgctgcctcgcctgggtagccgacatggtgggcgtgagggagatcttggacgacttcttcttcatccggcacgagccggtgagctgcaggaagatcaaggattccaacaaggggaagaagtccatcgacgtcctcaactacgtgttcgatgggctcaggaagacggccaacgaagtaaggtactccggcggcaacgagatggaggaggtctgcgactaccgcggcggcgaggggataatcaatgagctcgtcggcgacatccagctgatggagctcaacgtgaacgacgtcgtgcgcgaaagcgtgagaagggagttcgacgagtgcctgctgctgtggcacgtcgccacggacctgtgctcccaccgccgccgcgaaatggaagtgccacggaacggcgacatccagagcttgatgtccatcagcgagaccctgtcggagtacatgctgtacctcctcgccaggcggccggagatgctgcccgcagcgacggcgacggccgccgtcatcgggctgctccggtaccgcgacacgcgcgccgaggcacgccgcctcttccggtcggcggcggcgtgggaccccacccaccacgacgcccagaggatgctgctcgaggtgaacacgtccaagaagccggcggttgtgaagggcgacgagagcaagtcggtgctgttcgacgcctgcatcctggccaaggcgctgctgcagctgggggacgacaccatgtggagggtggtggccggagtgtggagggagatgctcgtccacgcggctggcaggtgccatgggagcacgcacgttcggcagctcagccgcggcggcgagcttatcagcatggtctggttcctcatggcgcacatggggatcggcgacatgtacaggacccaggtgggggacgccaacgctaagctcgtcgtccttgaccagtagacatgcatgcctgctgccgcatatattttaatactccctctatttcaattcgtagcaacttaaaataggattagatccattttaggactacaaatctcgacatatatttattcagattcgtagtcccagatctaatcacattataagtagttatatattaggctagagagagtacatcacttacaagtgaccttccgcgaggcagcttgattcgttcttgttgtcttaggttttttttttttggtgtgtccattgaggatcaagtagatgatggcgactatgtgggttgttactaccatctggattgggaagattgattgatggcagttgaagtcgttcaactgtgttaaccgattgtaccgaaatttttacaatttggctcttttaaaaaactagttaaaaaataagccttttgctcagcgccaaccttaatggtgttgtgataaaacatctcagcggcataaccattggcgctgagatcttattcaaggtggcatgatttcgccatgtaatcaggcctcagtgccaatttagttggcgcggacctcttgacattttaaataaaaaaaaggccatgtataaacctcaacgctgctagcctggtggtggagcccttgctttgcatctggcaggtttcacattcaaatccctagttctactttttatttcctacctgccctcctatttttctttttaagaatttggaatgagcagatttgatgatttaaattattgcatttgtcttagtaaaatatttagcttaatatctactacgaatttacaacaaaacatgtgttttcttttaaaaaaaatggagaacaaaaacctaaaatggtaaatattatataagtgaatttcaattttcaatttcaaaaataaaatggattttgaaaccatgcaattttttaataaaaaaacttaagcagaaagatgataaattgagcactgggtaagtgagaaaaaaataggaggctatggggttcgaaccttgaacatggatgaagcagcaaagtggacttacaactgagctgtacccttaaatctaaatactatagtttgattctgtatacttatatagttcatcccactaagtttagttaatactatttctatcttctctcattaagccacatcaccctaattatttttagcatttgaatgatagatttatagttcaaattgtctcttctttcttctctcataaaactatacaatctcaattatttttagactcaaaattcataagtatcaaaatttattttagtttcaataatcatatcacatcttatttgtacatattaggcaccttaatttcccgtagcaacgcgacgaggtattcatatagttatctatatatcatacactaaggtcgtgccatctcaggtagaatgttagcaccaatggtaaacatctcagcgccatcatggttggcgttgagtaaacggctcatttttgcaattagctttttatacgagttattattgcaataaattttttaaaaggatcaaattgtcaaaatttcggctgattgtgagtgcatcactttggttgtttttggtgtgtggtaggtgcatttgatgctaccggcaagcatttgatgaaccgattgtgagtacaatggcgaagattacaaggtgaaaagattgatccattcatcgagattcgacaacaccgcactcgtatgtcatcctcttattagaggtgttatttcaggttttggatgaaaatctagatctatcttcatatagcaacagcaatacaacacactcatcaaatccttgttgaacacctagagtgagtgatgtgaaccattcctactatggataaaactattgttcacatcatggattaacaaaaagacataaagatcaattcgtccaagtgctgaaatccgattcggccacctgctatattgctgacttcaaactgtcaccaaatgtgcatatacgagctccgtttttggcccgtgagtacttgtcaagtcatcttttcaacagatctagcctcatctccaaattcatttctgtcggctgcaatcacagaaacaatgtgttgcatcacctataatgggtctatgggcttgtaacttcatctggacctagcccaggtggggctctcatgtggggtgcgccgcaacatggtggagcatgaccctatggaccccttggtcgtcctcccacctccttaaataggtaggtaccccttcagagtttcttgagttttgttgattagatttagcaacttgctacttgtttgtagcgcacgtgttggataaaccgtttgtctgtttgtttttggaaccccgccatattgttatttcagagtaaaaccttcatatctatttgttcttccaattcggtgtgtgttctacttgttcttacttgtttttcgattgcttataggatgagtgccctcgtgaccgggttgacgcgcaccgcaagatcgcggcgaccactagagacagtattgttgacggtcgttatagaccaatttcgaccatcaatacttctagaaataatggagacctagcaattcttgcatgcatttttatttagaaataatctggttccacttgtacttggtaaagtaattgtatataggagatcacttcataaatggaggagaaacgatggaaattcaccgatcaatcaatcagagcctgacatgtggtagacatatggatggatgggcccacaaacccattaaaacatttgtaaatgggcccaaccaacatgccactggccaagtatccatcaaacaacgtccaagaggaaggactgggccaggaggcctgccaaaggtcggccgaccccggcctggctccgttggcccatgcccaaaccaatgacggttgtaaccgatttgccaatggcagttgtaccggaattaacgcccacaaccgtcattctcaaccactattccaatacacaccaagaaagattcaagaagaagaagctctcttagtttactcactttgctctagtgctagtagagttagaattagaatagtctccttagttcttcaagtgtaacatcctgaaaattcctgacattaaaaatcactaaaattttgaactttttaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagcacaagtcaattattaaaccctgtggtataaatcacaacatcaaatattaaataatcaaaccatgttgatagcctgatttcatatttaacaaaaggaaacaacatagttgaatataattcacttgaatccaatctcacatgaaatataagtacacatgaaatgatgatcacatcaatggcccgatctataatagagtttctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaaactcatttaaataatacaataggaaaatatataaaatatgggtaatattaaattttggtcaaatttcatctaaaataaaacatatattgggtaaaactctaattgtgtgaaatctagaaattatgggacaagttttaataggaaataggcctcaaaagtggataattaggaaaaagtcactgttcattatggcataggtgttcgatgtggttccctagcccttccccccctccactgacgagctccccctgacgccccgtgcccctgcacgcgccgcgccgagccgatggggcccactgctgcgcgccgactcgcgccccgcgccgccgtcgccgtcgccgtcgtctcgcgccccgcgccgctatcgacgccgcgtgccgtcgcgccgccttgcgccccgcgcgctgtcgacgacgccgtcacgtcgccatcatcaccgcgccgcgcgtcgttgtcatcgccgtcgcatcgtcatgatcgcctgtcaccgtcggctgcgccgcgccgagccccgcgccactcccgtcgccgccgtcgtgtcgcccgtcgcgtcgccatcgccatgcgccgcgagccgtcgccgttggcctcgcaccccgagccgccgcacgcccgtcctctcgctgcctcgcgcctgcgccccgccgcacggccgtcctgtcgccgtcgccctgagccgctgccgcgccccgagccccgtgccgctaccacgccttcgcgtcaccgccgtcgccatgagcgcctcgagccccgcccgcgccgcgcactgtcgccgttgcgccgcgccgtcccgccgccgcgcgtcgccaacgccccgagccccacgccgccgcgccgtcccgtcgtcgtttaaagccggccacccctccccgcgcctatataagcccctccccggctgcccattgctccccacactacccccaccacctcccctcccttttccctctctttcccatccccagcgttgccgcctcattggaagccgccaccgccgccgctgagccgatgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggctgtgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtaccatttcgcaattattagaattaattcaaatttgaatctttacactagcataacttattcatttcagctccgatttgagtgaaacttgaacctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtagaggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaactcaatagaaccggtgcttaaacttgtcgcatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttatacaattaatttatctttttcatatattaaactagggagtatataagaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactataattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaataggccacgatgacaatagaaaaattaagaaactttagccttagcatgattgggatccattagcaaacacgaatagtacattttgttgcgcatatttgattgttgtttgaatattggtttttctcgcgtattatagaccttgtgtatcgcttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggactgagccatgaagttaagcatgaaacaaccccccgtacaccgtacttctcgaatgggtatagacctagcggattagatagccgagcggaggcagtatccctgcatagatggttcacccctgagtgaggcaggtgcgctacgatgggacagccgttgaggtagggctgagaggcgtgccctacatcggtgtcaccattggtaggactgccatgagtgtgtgagagagagaacttaacttgaaccataatttaatatgtgtgagacttctatttatcgggagcgccagaactcctcacactgctagaaacatggacgcctagagtgcatgaggatttaagttcatggagcgggtactggcaatgcgaggttatcgaaaagctatgccatgacgggtctcatgtgttaggatgagggtcatgtgctgggcagtcacggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacatcccgataggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgtggtggcttgctgagtacggttggtactcacccttgctattcatatatcttttaggagagtgtttaagaaaagcccttgtcggtacgcttgcgtatccaataagatgatcggagtgcggtcttgttctaggtctcgttccccagtcgactgcctgtggcatgttaaccgggcccttatattattttgtgttccgctgttgttctctgatagttgttggcctacctggccctaatgtaagtatttaactcttttagcctgaattcattcgtgatatgttgtgattcaactatgtatgtgtgtaccaactattgatccagggattggtacggataaacacagatgatttccgatttccaaaatcgggggtccacatcaagtcttctggagaattcaagtatggttctagtaactcttccctctttatccgataatgaaatattcttctttatataatttggtcctttactatatttgcataattatttgagtaccaactttggtttacacttatctcgtattaattatgcggctagcttaccagagatatgcaatggtattggcttagtgttcatttatttgattgctctatgttatctgcagaggtgtagaatagtacttagtaatgtaagcatggtgcttagattactaagtatcattaaatggttctatatgccacggatctgtagaggcaggacgctgatgttgacaactcagtacgagtattcgtcgacgtgtgtatatagggctaagcaagattcatggtgcgggtattcctctgtatctttaattggttgaatagccataatggattgtcgtaaggaactcggcaatcaggggtggtttcttgatataccaggtgggcatagttagggggtattagccacatagttgtaccatagaaagtgtatactaaaatgactatatatattagaagtacataaatggtgcttttattacttcttctctgcttaacctagacttatattttagtaagagtattttaaactgaaccttctatgtgtcaaatctatccttatcctcaactgattaacccatgcataagactttgatttacataagtaagataagaatttatagcatagtactctcttaccatatcttcccatggaattaaataaatacgataccttggaaatacttacgggtgaaatgctatagcggtatatcgtgcgcttgcggatttatttctgtaaccataagaataccgtctaatatttctgccaccattgttggggatcatattcctagtaatgtcgttaagaaatatcaacaggtataaatatcaacaggtatatcggtgaacgtcgcctccatccatcaatcgagttatccaccacctctcatcgaaagattgggaacaaaccttcacgggttcatatcagtgagcttccccaaggtagctgatttgttcttgttatcttaatttattttgtttttgtttcatttttttggtatattcttagtaaacatagagactaggttaatttcatttttttatgaaatattcctgttttttttaaaaaaacaaccttgtcatgttatcttataaaaaaggcaaccttatgttatcaatatgatagttcctcaaaactagaatgtgaaagatggacaagtccttaaagtggcctcattagcagaaaacgtgtagtagatattatcttcttataaagttgatgcccactaacttctaaaactcaacatgcaaatgtgtcacatatcatccactatcaattattatccagagtattttaaatcacatgtgtaaaatcaaaggtgtttttgattattattctgtgatgaacaattggcataggagattattggttttgttatttggagtttatttacgaagtggttttggagatgattggatttacaggtgaatcacaggtttatcattttatgtggaccggtcagaccgggccggtgcggtcggtcagaccggcgtgtaatgcgtggtcagactggcgtgtaatgcgcggtcagaccggcgcagcccgcggtctaaccggtcgacgctgtgtcggtttcggtttcgggttgtttgtttggatatccgtgattatttcatgattatgacttctagatggatactatacatatgtaatactattgtttgctactaatgagtgaagttggagatagcttggtctcggaatatggtttctttgtttatttcatgtgcaggtgactcgatgcctcgggagagtatttgcggtgatggaccgggagtcggcttggggataagacgacgtccgtggtggtcagagatcatgcgggatacttaggctagagttgatgcacgtggttgatggagattcgatatggcatacgatggaggtattgtgtgcgtatgggatgcggagtcgaatttggaaggagtccaaatttgatatgattggttatgtaaagtttgtttcttgtactagagggtttcctaaggtgtttaggactcctagtatgagtttggttcgtggctttagggcgcctacctcgggtataaatagagggggagcatgaggcttccagttatcgctttttagagaatttgagttgagttttgagttagggtttagagtttagtcgaaatttttgtaagtagtgttgttggtgcactatgtaaacgcagagagaagtaataaagtcgtcatccactttaagagttcttcgatttgtttttaccgggtttcgacggtctaaccggcgatattatgatggtcagactggcggcaagcagcggtcagaccggcggcatacgagcggtccgaccggcggcggcgacaggtgcggcaggcatctcagcgattcaaccgatcgacctacatcggtcagactgacgttcatcaggcggtcagactgcgatccgtcgaattagagggtaacttttatttccgctaaaagttttcgatttttgggtataccaaccattcacccccctagttggcttagtttttgttatttgatcctacaagtggtatcagagtcttgttttcttctttggatttttatcggtctagagtttttgccatggctactcctgctaggttttcaactaagaatcatgttttcgatggaacggatttttctcattggtgtagtaggatgcaatcttacattatggctgaagattatgatatttggagaaaagtttctcatccttatgtgattcctgaagctattaatactgctgctgaaaaaactgcttttgaacaaaattgcaaagctcgcaacattcttttgagtggtatttctcgttcggattatgatcgtgttacgcactttcgaactgctcatgaaatttggaatgttttgagtaactttcatcaaggaacaaataacattaaagaacttcgtcgtgatattttcaaaaaggagtacattaaatttgagatgaaacctggagaagctttgaatgactatctttctaggtttattaaaattttgagttatcttagatctgttgatttttcttatgatactaattatccacaatctgagatttctcgtcactttttgaatggtcttgacatgtctatttgggagatgaaagttacatctattcaaaagtctgttaacatgtctactttgactttggattcactttatagaaaattgaaaacacatgagatgaatgttctttctaggaaagttgattctaagtcaagcgctttggtttcttcttcttcttattctttggatgttgatgctttttcatctaagccttcttttcttgctgtttttaatgtcacatccgatgatcaactcgaacaaatcgaggaggaggatttggcttttgttgctaatagaattctcgagctacgaataatgccaggaacaggaaaagaggtggtccaaatcgttgctttgaatgtggttcaattgatcatcttcatttgcattgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 846 - DNA, 641 bp, Oryza sativa
  unsure (1)..(641): unsure at all n locations
agagaaacttcgggagaatgaatagggcttgggtaggaagaagactatataggggcatctttgcaggcaggccatataagtggcacctgtgaagatcgatcttcgcaggcgcacgacgtttgccgcctgcgaacatcgatcttcgcaggcgacgcttatatggtccgcctacaaagatcgatcttcgcaggcggaccgcgccctccaccccgggtacattttttgccagtggggttttggctccgaattacatgcccgcctgcgaaaattgataccctacgacgccgaaaatgagttttctagtagtggccggcaccagagttgcagccctctcttgcggacgcttttgcctcgagcttcggttattgcagccttgctcacgaccacgcgatggatcccctggctggcaacctcgcgctagggttcgcctgcatggcagttagacgaaacctagctagctaccggccaattttgtactgtgtgttattattttgcaaatttagctgaacagctctcagttgngtcatgtacaaacaatattaatttcgttcatctggtcatgacgatcatgtgattttacaatattcatataatggtatggaaataataccattgttgttgtttaacctaatatatacctt

SEQ ID NO: 847 - DNA, 14970 bp, Oryza sativa
acatagtacttggccagtgcttctcaccatgtataatcttcctacctggctttgtcaaaagcgaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggaacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccggtgaactagccgggccaacatacttggcaaccaatgattgcccggaaaagtacgaacatgggaaagcactcttgccggaatgggcactgaacgaaggaccatgggagatgaaaaggttacataccttttacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaaagcttttatgtttcaggccgatttcctaaaggtatgaatgatactaatattactcttattcctaaaaaaaattatcgtacttctccgactgattttagaccgatcagtcttggcaatgtttcttataaaatcatttctaaatctttggccgatcatatcaaaagtgttcttcttgatttaatttcagattctcaaacaagcttttataaaaggtcgtcgcagtgcaaataatcagattattgaccaaaagatagttctctctttcaatttaaaatcgtttaagtaaaatgcttttgtgactgaaacttgatcttgcaaagcgtttgatcgtctagaatggaactttattgagaaggctcttcgtcgtaaagtggtttcatggtcattagataaatctatgtccttgcttgcattaattcggcaaacttctctgtcaatggaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagccttcttattcaa

SEQ ID NO: 848 - DNA, 1103 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcttacatttaataacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgcaagacgatcgtctccatgttgtcctcctctggggcaacaaacagcaggccgagttggctctggccggaaaggtggcc

SEQ ID NO: 849 - DNA, 898 bp, Oryza sativa
acagtagttcatgaaaatgaatttggaagagctgattacctgttatgatctttggttgaggacgagaaggcccttgcaccttatcggatgaactggacttcgggtcggtgttggtatctttttagggaaggctgcttgctcgagcctctgtttccgggatgtcctcatttgttctgtacccgactggtttccagtcgggggcacctgatcagcactggcttcagcttcggccgactggtttccagtcaggggctcattgctggcctctatattatcggtcgctggttgactactagtcaggcgattttcggcggtcggcccggtttctgtggaggtcgtaggaccagtctccatgctagtcggtttagtctttcctagaaggatcgatgtcagatggcttcctgcagatttgagatatgctattaacactacttcgatggtgtatgtttggcgatacaggggaaattgcttaatgacttgtacctggatgacttcctgatttttggtattggacgactggatgttttcttcttcgggttagcttgccttggctgttttccagtcacctttttgttgccagctttttcaacattgtcaccctcgtcgtcactcagaattaatttccttttgcgagagtccgactggttagttgctttgagatgcttggctgagcatcagaccggattttcggccctccactggcctgaccagcctgccggcggggtgagcggcgttgagcgattggaggatcagatttcattaaagaaaattcctatgcatgatatttcaagtttcagccaaccttacaaaagacaaaaggatgtcataagaaaggccgagatgtctgatacataccggtggaggagggtgaaagcattatatggcaccactggcagca

SEQ ID NO: 850 - DNA, 707 bp, Oryza sativa
gcagtgccggcgccattgcaccctggtgggcacagtgatcacgggcgttgcccgatcaacgccctgaagctgagagtgtgcgccaacgtgctaaagggctggtcgatgtgaagattgggtacggccccgatgactgctgctcgttgctgtcagggatcgccgatctcgatgctgccatctgcctttgcaccgccgtgaaggccaatgtgcttggcattagggtcaacctcccagttgatctcggactcatcctcaacaagtgtggcaagacctatccgaccgatttcacctgctaagcggcacagttataatattccagagtttaatttggtgtggttgttcgctattgtggttgtggctattgttccccgtgagtaagtctcttgtcgggtttgcagattgatgtgcggttttatcatccttgaatcactttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattggtatcgagaatat

SEQ ID NO: 851 - DNA, 9985 bp, Oryza sativa
aatattcaaatcgaagttgccgatatgaaccggaaagtccgacagctgagagtaaaacaataattatgaaattttagctcaaacaaacaatatgtacatgaatcaaaaggtaacaaacaagatatataagaaagatataaaatcaccaagtagattaattaagcattcaaatatatctaagcacaatatgaacaaggcaataacggacaaaccaagagaggagacacgtgatttatttaccgaagtttggatctaccaatcctacgtctctattgaggggctacaaaggctgggtctctttcaacccattaccttacgtggttacacaaatacactactcgattttactcttgctttcttccaacacagaggtgaaatcgaagcctacacaaccttggatgctcactggcaacgtctagctatctaaaagactttaatatcaaagagtaataaacgcacacaaagctagcttacgaagggaatttgaattcaacatccataagtttttttttcatatcaattacttgagaattgagattttggttcaaaaagattagtttttaattgagatcatggcactagatcctagatacacttaaagaatcaaattattgagcatatgattttcattaaaatagttttaacggttgaacgaaaatcgaggcattgcattacttctggatttatttatgatagtggacacgattgaacgcaaagtacatatgaagaacatttttctaattactagttttgaattttggaattaaatttaataagtgctaaattgaaagtccaagactgctacagcatcatatttattaattttgaatttgtaaacacaacatgcaaagagttcatggtgcatgttttacttaatgcttctcaatacaacatatatgaccacgctaatataagccacgtagccaggtcggccggatacttttggttacgtcaaaactctcttaggataataaattagacagtgtaggtataaattactggtaggtaactttgttgaacaaatactggtgggtaattaatgggctagaccgggatgattaaagagattaatgggcatggtcagcacattatattgtggacatataaatcatattgtctcagcatattggggctgtttatacacatttgttgataaattttctgtcaataatttgacaggtacaaatataatataatcatataacattatatatagtgtatcttgcatttaaatataatgcaagtatatgtaactttaaaaagtcccatggtaacatgctgtttttacaaagtggaggtcaccggatcgaatcacctcacctatgcccgtgctgtatgtttttttcttcctagttgcacaaatcttgaaaaaaattcaatggtttaaaatcatgaaaaaattgtagttacatgattttattataattatatagtatgtttgataaattttaggagaaaatttattgataaatatataacaaaatcgtttcagatttgttcagacttcagaccagtcatgacttgcatgccttatttaaatttccagccagctgatcagcaagtcgcacacgcttggatgcattatatatactcctatttattataactggagggagtatactccctaggacggagaaataatgcatccaaggacggagaaatatatactccctgaagttattaattactccctaggacgaagaaataagctttcttacctgtttggtacagctccaactcctaaatttaactccagaagttgggtctggagtggagttgtggagctgcctaaacccagctctacaactctaattcattttgtgagagaactccactcagcttcactcccaattttggtggagctgaaactgtttggctgagctccagctctaggaggggtggagctagagctggagctgtgccaaacaggcccgtagtgtgcaagtataagtaacagagaataacatccgagacccaagaaactctgaaaaaacaatattatattgatagatccagaaattatgatatcgtgaaaaatgtacaaccgggcatgattgtttgattataattggtgctctgcatgactgcatagctctattcatcgaaataattacggagtaagaatttaacgtgtcatgtctctcgccaacaactactggcaattatcatatctcggtatctcacacatgcatcatgcatgcaactacatatacgaagcgagctcatctataaataccaggcgacaggcgacaccacaagcaaatcatccaaaagcgacgcaagccagagcagcctagaacactgagtcactgagtaccaatagctcactcgatctctcggatataccaatggcttccacggttgtcgctcccatccttgcccttagcctcctcctcttcgccgtcattgtgcgcggctgcacaccaaactgctccggcgagcaggtcgtcccgacgccacccactgcagtgccgacgccattgcaccacggcgggcatggtgagcacgggcgttgcccgatcaacgccctgaagctgagagtgtgcgctaatgtgctcaacaggctggtcgatgtgaagatcgggcatggccccgatgattgctgctcgctgctgtctggaatcgccgatctcgatgccgccgtctgcctctgcactgccgtgaaggccaacgtccttggcattagggtcaaccttcccgtcgatctcagcctaatcctcaacaagtgtggcaagtcctgcccgtctgacttcacctgctgagctgcacatttataatgctcatgagtttattttggtgtgattgttgggtgtcgaggtttgtttgcatgatccctcgtgaataagtctcctttttgtttcagattgatgtgcggttgtatcatccttaaatcactttaatttgattgttgtaagttgatctttttgttgagagaatgcaaatcttcaaaacccattgcattatctatatagatatattgttatgcggaagatattttaatggtttacattttcgctttctctcatccatgagccaaaaaaatagaccaatccatatatctgtatctaagatgatcatgtcctcaaactgtgtcacgcacaccaatatagaccttgcatcagagtttcagggcgttgatctggcttcagggcgttgcccggttatataaaattcgaccggttactgaagctagcccgtagaagaagatggttccgggaataggtgacttgcccggtgtagttagctatgttgtagactgtagaacacatggttgttcctgagtagactaaggttgcgttccgagatggaaattgagaactccaccaacccgcacgcaaaataaagtgatccattagtgtatgattaattaagaattaaccaaaataatcttgaaaatagattaatatggtatttttaaagcaagtttcttatagaacatttttgccaaaaaaaagtatcatttttgcaaaataatatggtatttgcatgaaaaccaaggagtggaggttagaaacgtctgatgccaaacatagactaagagtaggccccatcttacaagaaagcctcaaattaggtcttatgcagccagtccatcagttctgcgcacccacgagaagaccaccaagtcaccatccccgagcagccctatgccacaacctaagttttctggtgtctcggcttcatcatgattacgtaagtacatacaatgaaagggtacacacgcgagattacaagtcaaccttttccggagagggatgcactgacgcagtgaatgtgtaggcaaatttgttgcaggacatgtaaaaagcatataattagctgagggacaccgtaagaccacacatctgccgtagggcaccacaaaaaactcataattagctgctggtctctcatgacattattttattattttcagagaaaatagagagaaacatagattaaagagaagtttgcacatggctcaactaaatgtatgtgaagcacggatacgtcacaaacctcacgtatcagtatcagatacgtacttcgataaagacacatattagatacactccgatacatatccctttttttcataatttcaaaataatacaaaaaaatcgtcatcgggacgtagattcctagcaccaccgccagacacaatgcctcaggttcgttgtcgtcgcgaaccgtcagtgccgtcggacatggcgaccccatctctgacggacacggcacgccagtatctgcacctccataggacacagcatcgccgccaccgccgccagacgaaatggctctaggcccgcggtcgtcgggaaccgtcggcgccattgccgaacatggcgactccatttccaacagatgcagcacgccggtatctcgacctccacggggcgcaacaacgccgccgctggacattgcaacaactccatcttcgccatgctggctgtcggtcgatctccgtcaccggagccttgccggcaaaaccctcgcgccaccagctttgcctcgtcgaggtgactctattcccctagtttcctctttcctttagccaccatatcaagctgccaccgtcacctcccttgccagctagagctgaggttttcccttcgttgttctggcctcctctcaaagtccctctacttgccaccactttcctcggatgcaaagaaaaaatgaacacgttcaatcgctgacgttgccgtctcctgatcatcggagcaccagcgccctcctcttgtttcatggaagaagaaaaaagaatgagtagagaaggagagagaataggaaaaaaatattccctgacaggtggatcctagcatgggagtgaggctcgattgggttcatggggtaaaactatactttcatagttgtttctttctccaattcctctgaatataataaaatagtcccatgggtgtctaacagctaattaccacctttttacagtatactatagcataaacgcgtttttgcggtgtccctagttaattacacttttttggatgtcctgtaacaaattttgcggactatatatatagagggatgttatgccttcgcaacgatacaaactgattaagtagaataccttgactaggatgctgatattattttttaggtgatattataatgtaatttctattcatagaaaagcatgggtactcagctagcttgctagtatcgtgtaaattgtacaactggacatgattgtttgattggtgctgtgcatgactgcatagctctattcatcgaaattaagaattcaacttgcatatctctcgccaactactggcccatgcttgcatgcaaatccatccatgaaaaccaagcaattatcacccatgcatcatgcacgcaactatctataccaagcaagcgtactatagttcagctataaatagcagatgacaccccaagcaaaaatcaacccaaagcgacacgagctagatagcagccaagaacacttattcactgagtaacactagctcattcgatcccagacaccaatggcttccaaggtcatcgctcccttccttgcccttagcctcctcctcttcgccgtcattgtgcagggttgcacacccaactgctccggcgagcaggtcgtcccgactccacccattgcagtcccgacgccatcacaccatggtgggcacggtgagcacggccgttgcccgatcaacaccttgaagctgagagtgtgcgccaacgtgctaaacgggctggtcgatgcgaagatcggacatggcaccgacgattgctgctcgctgctatctgggatcgccgatctcgacgctgccgtctgcctctgcacggccgttaaagcgaatgtgcttggcattagggtgaacctccccgtcgatctcagcatcatgctcaacaagtgcggcaagacctgcccgtccgatttcacttgctgagctgagctgcatgattataatgttctggagtttaatttcgtgtgatttttggttgtcgattgagcctttttttcatgattccgcgtgaataagtcttgtttcttttggcaaattgatgtgcggatctatcatccattaaattactttaattcaattgttgtaagttgatttttttttgagattgtaatatgtaaaacccattatatatattgttatctggagataattgtggcttatatgtttgctatgtcacccacgaaagcatgaaaatagatctgtatttgatatgatgatgtcctcaaattgtgtcacgtataccaatatggaccttgcacctaagcaatggcgacgctgaaattcttgaaatgtaatatgaccgattgaatttagtcaaaatggcccacagtacatgggccaaactatgtactctcgtttaggccaaactatgcaatcccgttggttggattgccattccagcccagcgtgaaggggttactaaaacttagccctgagaataagatggtccacactgcattgcaaccactagatctactataagatcatcctttcctttataaccaaacaaacaacaaggcacataatcataagattatattatattgtatacaccgactaatttatcggtgtattttagaaattcagatccgaaattgcaaactctgctccaatgtgttctgcagtgtgattcaattatctagataattaattagcggaatgaatgtacatttgtaggctagttatttcaagcatttaaattttgtcttcaaatatattctatttagaatattaagaggtatttgcagtgataaaatgtacaagatatctccccatgtcgacaaccccacccaggtgtcagcaagaggataatgaaaggtaatctagattttcccctcccctgaattttcatgaaagaaattactgaagtatttatatatcttggaacagagggagcatgcatgtacttaattttctttatctaatgttatatgatgtgtgtcaactcaactatggtagttaataaatatagaaaaatacatgccggtccttaaacttgagaggtggtgtcacttaggtccgtaaacttaaaaattgcatatttaggtccacgatcttggtttaatgtattacagcaggtccaaacgacatttgactgtgtctgactgctaaggtcattcccaacccaataactaggatggtgtccatagcattaaataagttgccacctaggacaaaaaatgatgttgcaagtgaataaatgaggaaagagaaggaaaccatgtcttgcatgagacatggtttctacacaacatccaagacatagcattaaattgaagtatggaatagtggtgtttgtattggaagagtagtgtttagtactagtttcttgatgatgtggagtttatggaaatcatgtctagtgttatgagttgggactgtcctaacgtggcgcttcatgtagacaccaaatttacatccggccccctccacaacacagagtggcagtaaacttacacttagacccttcgaagtacatcgttgtaatataagcaagcggatggcctcatggtgaagacgaataactgatggagctggccggcgcgattgtctaacacaacaagcggcttggaatggtggaggttcgcttcctcctccgcctcatctccggcgtaggcctcggctgctggacctacgagctgcggagcttcgtcgacggtcacgaagagctcgctgcacagcgggacgcggtcgatgagatggacgctttctacgacagcgccatccgggagctcctcggtaggactgggttctaccccattgccaacgtgctcatcatcaacattatcagctagcttcttcctggagccatgcctctcgttcatgttgggaatagtcccacatccctaatctagagggagttgaaccaacttaaaagtagagggagctcctcacctcttgagctagcttttaggatgtagcaaggctttctcccggttgggccaacgtcttccggtttggggctaacaagtggtatcagggccaatccaacaatctctagtgcttgtgcacactcaaggcggtgtaagcccaaagcccagtggaccgcgggtgtgaggcccgtatgtgcccgtgtgtggggctggtcagtggaccgcgggtgtgaggcctgtatgtgcctgtgtgttggaccggtcagggctaaggggtaccaatgttgtgacgggggagattgttgggaatagtcccacatcccgggtgtgaggcctgtatgtgcctgtgtgttggaccggtcagggctaaggggtaccaatgttgtgacgggggagattgttgggaatagtcccacatccctaatctagggggagttgaaccaactttatgttgtgacgggggagattgttgggaatagtcctacatctctaatctagggggagttgaaccaacttaaaggtggggggagcccctcacctcttgagctaacttttggggtgtagcaaggctttcttcccgttgagccaacccccacctctttgagctaacttttggggtgtagcaaggctttctccctgttgagccaacgttttccggttttgggctaacactccaggactgtgtgaggtggtaccgcatgcgcgaggacgtcacggcgtcaaacctctccgggatggggttgcagcgccaggctggtcccgttggacatcgcccaaaggccaaaatgccatgtgtgcgcggttgctgcgaccggtggtagcgctcgtagtctcgacggagtcactggcgccgcactagcacgccggcaaggagaggactatgatgttgttgcagtgcctattccgatgcggcagcacggccgtgctgctcagcagcgacgatcaccgttgtcgcgccaagatggaactccgtcgcctggtgcgcgccaccaccgcggcactggcaagcgacgatgcttactcctgcatctgcagcaagaggatgacgacggactcctcggtgccagcatcaacaaggccctctccaagaccgcccttcgcgcattcgctgccaacctgcagcgtcttctgcacttgcatacacatgttgaatggcctaagtgaaagtttaccactattttgtgttgcggagggggtggatgtaaatttggtgtctacgtggagtgccacgttggcggtcagatacagtcaaatgtcatttggacctgttgtgatacattaaaccaagatcgtggacataaatatgtaatttttcaagtttatttacctaagtgacattagctctcaagtttaaggaccgaccatatactttactctaactagcatggtggcccgcgcagattgtgcggctagtatcattatattttctatcatataatagcatatatgttcttattatattattcaaatatattaaaatgacaacataattttaaattttgcaataactttacaaaactactaatgtgtaatattcatattgtattttatatacgtgttagttattaattatttttaatatcaaattttagttatttgtaaattatatatattcctatatggactgtagactcgtcttttaatatttctttttttttaatttcgaattttctataaattgtatttctatatagactctatactcttcttccaacattatttatttttatttctgaatttttattatttctaattgtatttctatgtgaactctaaactcatatttcaatattctttaatttttaatttcgaatttcctatattgactttaaattcttcttcccatgtttttcttaatttcaaattttagttatttgtaaattgtatttttatacgggctctaaactctaattttaattttattatatttatttcaaattttagttagttttaaattcctatatggactttatactctacttctaatgttccttatttttaattctgaatttcagttatttcctaattgtatttctatatggactctatactctacttctaattctaatgttcgtatttttaattctgaatttcagttatttcctaattgtatttctatatggactctatact

SEQ ID NO: 852 - DNA, 1315 bp, Oryza sativa
ttcagctatttcctaattatatttctatatgtactcttgtctcgtcttctaatattccttattttttaatttcgaatttcagttatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacataaaggctcctttttctattcgtttaataatataatagataaatataaggtgcttgatctacgacttagctgaatttaattactttgggccaatcaattaagctttttttttccaagaattgaattaacttcgggaaggaagaggttaggaacttctcccagcacatgtcaaacggggtgactaattatgtattaattaactaaaataaattttaaaactagattaatataattttttaaaacaactttatttgctatcgaaatgttttgaaaaaaacacatcgtgcttacgaacatatataccaaccggaataaacatatatacatagacagcaaagaaaaccgaactctttgttgaaaaagacaataatagtcgatcgatggagcgattgatattgcgtaaaatgaactaccggacttgattgttggcttgctgctctgcacgtacgaatgcatggcggctaaaattaattaatcaatttagcaactagctatatatgtgcctatgtcctccatggaaaaatcgtatcgtacttgtcgcaagcaactagcccattccgcagcaaatccaaatcttccatccggggacaaaccagtgcgtgcagatacatcgtgcatgcatgcaactagcagccactaacacaaacctgtctatttgtaacggctcaagtatcatctgtaacagctcgcccatccgtaacaaacaaaagatacggatgaagaaaccatcttttatcccgattaacaaaagatcacgggtgaagaaaccatcttttatcccgatttgtaacctcatatagttccaggatgcaaaccgggatcaagcatccggaactaaagatgacgatctttaatcccagttaaaatacactggtggagaaactatttgtagtcccggttcgtaaccccctttaatcccagttgtccaatcgggactacgaatccgggactaaatatagctatctttagtcccgagtaaaataaccaggactaaagatcggtgtaccattttttttatttgcatggcgctgttttgtgcatggtatatatatctatatgtatatacatat

SEQ ID NO: 853 - DNA, 1393 bp, Oryza sativa
gtacagtagttcatcaggcaagagcgttccttgatcacacacttggtttgaaacaaggtgtggtgctaattctgttcagccctttctatttgtgcgctgagcactcgctgcaccacgaggctctcatagtgctctgcagcttcagccccaatgtgtttctcatctttgtggggcgcgtcaccttcccctgcattgttagttgcaagcaaagcataggtttcttcatctaaatcactagcggaggagtacctaccatcagctctcacgatcattacacgagtgcttgggcagtccttgcacacgtgaccatagcccatgcagcgtaggcactgaatatctcttgtcctttctgatgatgccactgatgatgagctcttggaaggtgtagcaacaacccctcttgttggttcactcgggcatggtatagagtttgttgtagagggacgcagcttgttgcttgaggacgatggtgctgctgctcgatttgacggtgcagcagcgttggaaggtgtccaggagctagcacgacctgcagaaatgttagtcctgaagctagctcttcgtccgttcacttccctttcactttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcttctacatatttgtttccctgtctaagttgttgcaatttgtgcagcaaatcacgtgcatgatatgaaggaacaaatctagctcgcatgactcttttaattgcatcccaggtttggggagtgttattatttggattggaacgaacaaattcactccaccaaatggatgcaaaatcagtgaactcactattaccagccctaacacgtttattctcaggaaaatcatggcaagcaaatttctgatcaatagctaactcccaagtaagatatgcatcagggtcatattttccatcaaagtaaggaatggtaaacttgatcgtgcctaaagaatcatcattatcacgtacctcccgtcgtggtggagcgcccatgccatggcgctgccggcactgttgtctttgtggacgaccaagtatctcctcatcatgctcggtgtcagtagcgtactccagttcttcccttgccgcgatgttgctattagcatcatggccattgtggttgcgcctagccgatccatcatgaccatcttggcccattctctccaacgtattcaagatacctgcaagagaagtgttcaaagccacaagggacctctccaatgaggaaagcttggagttggtgtcaatttgagcagcctccaattgacc

SEQ ID NO: 854 - DNA, 5146 bp, Oryza sativa
  unsure (1)..(5146): unsure at all n locations
cattcctaaatctactttttggagttctattctgaaaattagacatcttttggataattctatcatatggcaacttttttaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactntggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggattgattcacaaaaggatctatttataaattttaatcttgcaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccggccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccgacaaaatttgacttttgattagagaaggaatcaaatagtccggagctattattt

SEQ ID NO: 855 - DNA, 12326 bp, Oryza sativa
gagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccgcccgtccgcttccctggcgcagctctcaagtggaagggctgcgcgccggctggaagtctcttgactcttcccgttctatcgatccctgcggtgggagagcaccggcaaccagtggtcgtacacctcgccgatcgacttggctcgctgcggcggacgaccactatgacgtcgtccagcagctactgcatatcgactaacctcactccgtcggatcccccgcctgaaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagactatggaattggggtttaggtgatgcaagctaattccgtaaaactccacaatccccctaaagaactttgaggttgggagaggaaaaccaccatataagaagtgagaaaataccacgacctcgtgtgtgtcaggggtcagaaatgcttcgccgcatgccggacgccacccgatgatctcctttgccggaagaacgccatgtgctaccatctccttcaagttctcatccgttacatcggagggagcccattgactttcgaagctttctctctcctcggccatgggagcgagatggatgattagatttggagcgagggcggcagcgaatgaagaggatattggtgcgatggatgtacggaagatctatgcaagagaacggagcttcgagaggggtggaatggtgcggatttgcgaaccctagtttccgccggcgcagtatttgcattgtagcgggaagtggggaaaatggagaggatcgcggcggggaagacgaaacggcgctctattttagcgtttatttcactaaggtatcgggagatgcttatgggcctgggcctaaacaatactttcagcccaattttattatcagcgtggctggttgtgatccttaaggacttaggtatatatttttgctttggcaaaagttgctcacgacagaatagcccaatgctgctaaaatcctttttgacgtagttagataattctttggaattactacaatgcaaataaaagggtgcccaacagaaaagtgttatactaattttgttggcctttttaggctacaaagctgtccgggccttattgagatgactaattttaaatggtcattctctcagcatgttatatgcttaccttaataatggcgtgggtcatagcttaggctatttagactcatcatttatcatgctttataccacatttgatgagtctttttgagagtttttactcggatttttatcatgtatgttggtttatagacctttagagtgtttctcactcgggccttttctatacctcatttttggcgcattaaagctaaagcagtcggctggatgttttatcagatgccacacatgcttagccatataatcccttgggtgattcggttgtaaaaccactcggatggatgttttgatgcactttgactatatgtttaggttttatttaactaatcacatagtcgggggctacacctaattagatgcatctactcagaagactaagacagaggaagttgaagcactcggattatcatttgaattacgagagaagactatttcatcgactgtaaaggtgtcaggggctactgtggagattatggataccccatacccatacgacatgtatatccgattaggtatggggtgccatgtatagatagaatatcttcaaagggaatcgggttaaattccaaacttctatgtcaaggaaatacccgggatcctagtcggttacgattgtatcttatctgtaactacctattccgttagggatatgggttgtactttgtaatacggacccctttccctatataaggaggtgtccgggtgtcttttggggcacgatttttctctcagatcatacaatcaataaaacactcggcggatcaatcctcgaacagaagtagggtattacttcttattaagaaggcctgaacctgtataaaatttcttgtctctaaacccatccacttttccagcttgatagccacccctttttagtattgccaaaatcttgtttcgacaagaagggtggtgacatttttttcatttctttttctttcttttaccgtgaattgggagaatgggaggggtatattttggactgagggcaatctggtcattttttgaaaaaaaatggttgtagcggtgtggaatcaacggtaagttgacggtgatggcatttttgggagaaaaaggcttgtacgatggtattttcagaaagttgctcttgtcgatggtatttctgggattagtgtactcgccgatggtatttcaaggattttctgatatcttggatactctaggatgaggtgctgattgttggattcggttggaaagggcatgccttgggagatattccaggtgtcaggttgaaggttgtgaaggtgtctgcagtgtcactgctcgcactcttcaaggagaagaagaagcagaggtcttagattacttttgataggcaaaaggttggactagactgtcaaggctctgaatgttttgagtaggaaagatcctagctatgttgggaatccccgtggtaactcaagctttataatcgagaattgttccttctcagctgttgctttggttaacagtactattaagagttttgttcccttaatctggatatatattaatattgcgctcgctcctcccttgtgtttgctagttttctccgtctttatatgttgattatatcattgattgtggttttttaggcaattgcacatttgactctattttaaagcgtaactaccaatttaaccctactttttaagtttactcatttgaccctattttctaaaagggaacatcagatgtgaccctatttcgtgaagccaagcaaacggtgttaataaaaggaaaaagagacgtttatacccttctcatttgacctagtttctatctacccagacttcacacgccggcgagctcccatgccgcacagggcaccgctcccttcctccgcgcgcatgctgtcactgcccgccatccacgcgctggcctccgcctccctccgcccacgcccctctgccgtcagtcgttctcgccacacagggcgtctctcccttcctccgcacgcacgccgtcaccactagccgtccacgtgccggcgtccgcctccctccgtgcttgtgccgctccctccctccgcgcgcgcgctatcaccgcctgccctccacatgctgggctccatctcccttcatgcgtacgccgccgccacccgacctccagcctctgcatgccggcgagctccggtgctgcacgccatagttgccaagatttgggttgggactggataaggatgggggcttggggatatggttgagtgtaataagggtattttggttatttggggtggtaaaaatatttttttctctgttttctatatgaaaccctaacggtagagttaaaacagggtcaaacggaaaatacgatttgagaaaacagggtcaactaagcaaacttgaaaatatatggttagtttggtagttattatgcttaaaaagagcgtcaaatgagcaattatcccttttttatgctcgattatcattgtgataaagttatttttgctcatgtccaatttacattagttaactatctttgatgccagtttacacttagagacatgttagattgtggagttcttcctggatttttgtcaacacatacattcgagaaaaaaaatcaaatgtttcatccatcttaatccagtaggtaagggatagaacatgatggaacgatcaaagaacacaaaaagaaaaaagtaaaaggaaaaaagaacctactaattacaatgctttgtttgtgactaaatataccgtaaacaaatcaggaaaactgcatatcttctatcacttgacaaccacataccaaaagaacaaaaatgctcaagaagtagcaaaggaacattttcttcaatagagcagaataagaattgtgtccatttttccattttaatttatttgcctggtgtgattttgcataatgtgacaactgagacaagaactcttcaacaaaaaagacatttgaagcataattgccatgacacatacattcattgaaaagcaatcctttttctacaagtcacactgctcgtttaaggcgcggagaaatttctttgattgcttttgattgctcatcccgccacttcgagcaaagtccacaaaaccgtgctcatcaacacacttgtcatataaggattccgtcattatgtctatgacaccctgtcatgtaaaattttttttgctagcatgaagttttaaaaattattaaagacaaatagaattgtaccatagggtttagcacaaccatattactagtatattatagtataagtagttttgattttttttcctgagttaaattttgttaggtttgatcaagttcataaagaatatcaagttcaacccaaaataaaaaagaaaccaaaatatattcaatgttaaatataatgagactaatttggtgctataagtgttgctttatttttatataaagttgatcaagctttcaacaaaaaattaataactttaaaaaagtcaaaacgacatataatttatattacctctatccctaaatttatgacgttggtgagttcatcatattactacagcataacaccttaaaggtgctggttgcaaacctggcatacgtgttggtttcatagccaagaccaattatccggcaccaatgacactaggtcattggtaccggttcctttgtgctctttccgattcaaaaaagaaaaaaaaatgaaaagagaagctagctccaagcatcggctcggctcgatgagtcgattctttcaagctgcccctaatcccatccattacatatcaactacaaaaatcctcatcccatccttcacatatcacatatcaacaacaacaattatcacagattacagatcaacaacaacacaagatcaagaactacacaagcaagatgaacttactctccccggtcccgccatcgttggcaatatgtgtcgccatcggaggagcggtgtggaggtagctgttgccggttgccaaggtctctctccttgccgaggtcgccggcgattgccctctgcatgccaatgccatcgccgccagacctggtggcacaatgggcggcggcgccggatgtagcgattggcagtggcaatggatgtggtgctagaggcgacagagcagtggcgcagagggaagagaggacgttgcagagggaggagaggacaagtgcgagacagaaagagagagagagagagcacaagcggatcggatatgaatggagtggatgcatgatgactttggtgggagttaattggtggctcggttcggctcaatttttttcaactgccggttttcgaagaactggtatctataatatattataggtatttgaaaaaatccgggtgccagtttttatttagaattgacacctataattgtcaaaagtgccggttacatattttttcctcatgtgaaggtgagaaatggtcaataggtgtcagttttaaataaatcggcatatatgagcaggtacctatcagggtttttttaagtagtgtataaaaatggaacacagagggagtagcaatcatctataaataaccatcacacgccaacacaagctgaagcactgtctactccactagctagcaccattactagcttagctagatcacttcaccacttgagcaatggcttccaacaagatcgctccccttcttgccctgaccctcctgatcctgttcttcgggtgtgcagtaactaactgcaccggcaagccagttgccccgacgccgccgtcgcacgacgatcacggccgctgcccgatcgacgccctgaagctgagggtgtgcgccaacctgctcaacgggctgatcggtgtgaagattgggcgcggcccagacgattgctgcccgctgctggccggtatcgccgacctcgacgccgccgtctgcctctgcaccgctctgaaggctaacgtgctcggcctcatcaacctcaacctgcccgtcgacctcagcatcatcctcaacaagtgcggcaagaactacccgtccggtttcacctgctaattatttgagctgcaacaatattcactagagtttatgtgtctcaataagacgagtttagtttcgtgcaatgtctgtctgttgacgctgttgagttgaataagcgtctcgcgtctgtttgcaggcagtactcgatcgatgtatgtccagttctaccgtccttgaccacctggttattctaacttgtaatacccatcttatatatattagatcgtttttatcagtaaatctcacaaaattacatatatttaattaaaggatcgcaaaactactacagacttaattagcttgaaatttctcacaaaactacagatttagaatgaagtgtcacataaataaagattaaatagaaaatttatcacaaaattataatttttgtaccaatttatcacaaaactagaatgttgatagctttaacgcgtgaagatagtggtacgaatttaaaatttagaatatatagtttgtgatcacttcaatattaagtatgtaatttcataatatttagtcttgaatatttattttttaaaaaaaaactaaattaatcactaaacctgtagtttatcataccacgtcttaaatatctagttttacgataatttgattaaaatatatgtagttccgtgaaatttagtctattcatattatcatggctcacacgttgatataatttctttgttttccatgcccgcataggaaagcacgacttatatgtatggctgtatctatatcatggtgagatagaacttatcgataattaccggcaaaaatattatttgtacacaagtttaagatacatttatcacacgtgctaactaataaatgtcacaataatagtaataaaataaaaataattttacttgtaagtgtaagcttctataaaaattcctcttagattcattatgttgataggctattttaatatgattttccatataatattggatttgcagtatattatggtagatacgaatccaagtacaataggtatacctaataagttatactgacacattactccctccggttctattttaattgacgttttgaacaatgacatggtctacaagatatctctttgaccttatttttctactataatatatataataaataaatgcatatttacttttattatagtgctttaaaagacaaatctatatatattgttttagtttctttaaactaaatatttttaaagttattgatggtcaaagttataaaactttgattttaaccttgtctaaaacgtcaattaatatagaaccggagggagtattagatatggctggcctaaaaagagaaaaatctagcaaaattgtacttttaaaactatcatattattttttccctgttgatttctgctgaaacacaatgaaattgaatttgaaaactaatatataggtggcataaaatgcatatatttacgatatctttttatatctattagttagtatatgttactagtacttttatttcgtcaaaaaaaatgccaacttctatatatatgaatccagatatatacaaaagttgttttttttaacggagcccagggagtacgaaatatggatgcataaattgaaatacattcatctggcagccctaatttccacgaacctaggcccatcacgaaaatgagcctaggcgcattaagtggacaacccattcggcatcgttgccctgggtaggtgaagtgtcaagtagctagagtacggcatgtgtaatcattttatggtgaatggccgccgtacgtcgatcgattggcgagaggaggcggcgccggtgcctacctcccgcgcctccgccgcttttcagcacacgatttatcatttgtcaatacatgcacgggacgggatgaatacgtacttgatttgaaattaatagaatagagataacttaacgattcggtgtagtgaattaagataattaattgtagccaatacaacagtatagtaaccccttccgcctttgtatatacagcatttggggctgctgtgaggtggagatagagcgaaatagagggtggtgccacttgcttaatttactctactttagatcgagtttaagatgatgcgggtgcctaaatttgtattgaggggtgcatacatgatgaaaatagttaagggtatagctaaaaaatttcttgaccgggttcctgggcaccccccaaattaatatacactcactactggagaaatgatctttgctgggtcggctgatttccacaatatttccggttctaaaaagaaccggggctaaatattgtttttagtcccggttaaattttttttttttaagtaccggttcatcccctgtcagaggcttgtgtcagggggctgaggatctttaatcctggttgatactactaaccgggactaaagattaccactttagtcctggctggtagtaccaaccgagagtaaagatcatttagatctttatttccagttagtaataccaaccaggactaaaaatctatctttagtcccggttgaagttaccaaccgggagtaaatatttctctcccatctctgatcggttaagtcccagacgggctttcttcctcaccgagatatttagataagattggatcgatctcaccccctctgctcctaacccctcagatccccttcctcctcctcccccctcctcccattcctcctcccttctcctccccctcctcccctcccatccggcgatcggcagcggcgggcaggtggggccgcggtcaggtgtggcgagtggcggcaagcggggtcatgcccggcggcggcgacggggccgcaagcggcggccatggcagccgacagcgtccattctttttttttttgataatttgtgattccctgagatgtataatttctttttttgtacaacttgtgattcattgcatggatcttagatgtatttgatttgtgtgtaatttttttaggatttgtgatgtatttgatttatgtgtataaagtaactttggatttgtgatgtgaatgatttgggatattactttgatttggggatttggggtttgctttgaggatatgcatggcactcgatttgggagaaaataaagggattaactctttcaattagcaaagaaacaatgaaaaaaaaagaaatggggaccgacggggactgcctatgctctctttagtcccggttggtaacaccaaccgggactaaagattgaactttactcccggttatttcaccccggactgaagatgcgcatttttagtcccagattcgtagtcccggttgttggaattaatagatgggccttatcccactcgaagattaattattttgaaaatcacaaaagcccacctcatgggatggcatgcatgggagtttagtatcaccttgcttattctaggagaggaggacctccttaaaagggaggatgccctcctagccacttgaagcatgtgaggtggagagaacagggggaatacacgcgtgctcgctcgcctcgcctggcggggcgggcggcacaacgtacgcgtcgaatggtccacaaaattggttcctcacccttgcgcagatgcggccttcttttgcagttttgttttgctgcgggaaatttagaaaaatccgttgcgtgaaaacggcgtggagttcgaataagttacgcgtgacttatccggttcggttacgcggagtggagatcaagcgacctttctctatataaaccgagccgccgcctccacgcaacacacgtgaaatcaatctagggtttgcctcctactctgtactgcgccgtcgcttgtagactactccattccgctcgccggcatgcagcggcgatcgggatagcatgtctccggaacctctgccttccacgtcctgcaccgggagaaggcggcaataaggtttttgggaagcgcttcgcacgactgctccctattcgttcacgacggctcgtctttctgtttgctcgcgtgatgcacgcctttgtcaacgcccgcaaccgcgagtaattcctgctgtgcaactggtcttccggtacccttggtacgtgctcactatgttacgcatatttgatctgtttatgctatactatctagtttacatatgtagatcttatgatatgttcatgctagtttacatatgcaatgtcatgatttatttatggaataaattaaattattatgtgttaataatttcaacaccggttggaaaatcgggactataggggttcccaactaggagtaaaaacggttttgtagtgactatctccacccctagctgtgaacatcgtcgagacagaatgagccgatattttgttagaacatccttaaagttcttttttttaaaaaaaaacgaccttaattactacccgctcgttatcacattagttttctgccatgaaattcggtgttattgaggaaaaaaaacgaaaagacaacccaataaatactatgatatttatagaaccttattgtctattttttttaaaaacaatattaatgagtttgtaacaccaggttttagcttagttgtcaaaaactattttacaaaataataccctagtgtcaaaatttttctggttctgtgcgtgtatctatgatcttgtgcgacggtctcaaataaatcattctttggaaccctaattatgatgcaaaattctctatccaatttagtttagataatggaacgcaaggcaacaaggatttttatactgatccagcacaccaagatgggtaatagcccaacttttggtgaccggagctagtgtattatatatatcatcctcatgagaataatgaggaggaaaaaaaacctaatctagtatgctagtatatcggtgcagagcttgggcatagtggttggcgactagttgttatcgacttctttgggtgttgactcgacgagatcggaggtgttatatgttgtcttagtttctctcatgggttttgacttgtcctactcctcacttacgtgcctggtatttataccctcagttgcccgtttgtccaagtagaactagggaaaaaagtatgatccgagtagtccaagcagcgcaagtaggcctatgtatttcatttattatctaggaatccttccttatctattccagactttatctaggtttgtttctgtattggacttggtctacagtggtcttgcgaggtaaatactatatatagggtatccaatatccagaacgctgacaatattcgaacaaaacatactatgtacaccatgaattttatgttttgtcatttgaagaaacccttgcatgggtgaagaaatggggagcgtcttcatggaatacatttacatttatgatcagtgaagttggttggggaccaaatcacggccttcctcaagtctactccaacaccaccatgccattattgagccatagaaggcaagagatacatggtttggagtcagattcgggtctcctaacaacattaacttcaaacagacttagctgctgattaagaagaacacttcggtcttcctcctaagctgtttggaattttctaaacaaaccacgtcaaagtcagtttttaggtattggacttcgtaattatatcataggctaaacccaaaaggtgtgccttataaatgttttatattttccactaagaatgaaaatggccaaatgaattacctagatttggtatagaaggagggcaaaagagaaatcatagacactaacgacgccaaaggaaaaggacatatatatatataggcccattaaaagaggatatggatttttttcccacggagggaatgtttactcattttcttacatgtcattttgat

SEQ ID NO: 856 - DNA, 561 bp, Oryza sativa
cacaaacaaaacagcagcaacaacaacttcctctctttccttccttttttttccttctcttcacttctgatttttttctttcttttttttcatttctttcttttttttacagcaagctcaaagcttcagccaacaagtcaaaacaagccttagcaaaataaccttttcccaaacattttcgaaatttcacaagcttcagccaacaaatcaaaacaagaagtaatgatgggttggttggctagttacatgattcagccaacaagtcaaaagtgagagtacttaaatgctttcttgggaagggctgattcacttcaaaaagttgcaaaagggttggctgttggtggaggcagcaataaatgcatttgggggtggttgatgtggtgatgagggtgctgctggttgtggtggacgaaatttggtggggttggaggtggatttcgtggtgaatatggtggtgatggtggcagcgggatgaagataaatgaagtgatggtggaagtgtatgtggtgacaaaatcgtgagtataacccgaacttttaaaagactaaactactagaacc

SEQ ID NO: 857 - DNA, 9764 bp, Oryza sativa
tgtaggtaaaaacaaagaagtgataaaatctctcacctagcaacttgagctctgataccacttgatgcagcagcaggggttcccgatctttcgataagaggaggataaacttcgatttgggggaggacacgacgttggcgatccgactacaactaccacagaggtgctgcgccttagcaaccggtacactgactccacgttgttgctgttcttaccgtgccaagaacaaccttgaacctgcaagcaatcgaagaactagcaagaacaagttgacaaggaaacaactcacgtcacttgtcaagtgatgaaactgaaacaaaccagaatggggttctgaatacaagtatccgggtggtctagccgacacacgcgagtacaaggaagtagctgcagctaaacttacatccaaacaaaacccaaagtgcaaaatggtggctgctaggagtttatataagtggaggaatgatcaggagaggaggtgggagcaaaccctaggttttgtggacccctaatgggctgtaaagatacaaggcccaagcccaagtttctgatgtgaagaattattttcgtcattctgagcagcctgggtcaaatttgaggccatacatagctgaaagtagacgatgagatatttccaacaagtactcatttgccccgtttgccctccggagtgaagagcattgacttcatcaaatcagcattgctagtgttgcttgcgatctggttcctctcccatattcctaacaacaagtagatcacaacaactatttagtagcacccaattctgagaagaacttgtatgattagctaggaatggttttacctgataattaagttcacgagctcgagctctagtcattggtccttgttgtgcaataggcatggttgtatcgttggaagggatgtcctcatcaatcctcctccagcttcatcggatgcatggcaatcttgaacaccgcgcgcgcatgctcaaagaagagaacctgcaccaccacacggagcgggatgagctcattctgtgcctcgtgcgcgcacgccttgtccgacagctttcggcagttgagcaccctgcatagtcgttgttggctagccaccgtagttggcagatagaattaacggggatgatagaaaagtggatggaaaatgcaacggagtggtatagttccaatttccccaaattccagtgacacgttgctgatatcgtgaatagtagtaatatttttctaatttggtatatttgtagtggcaaggagctaattaacccttgagtctacagagaattgcatagttgatttagaccacagtaaagctcgactgatttcaaagcttacatgttctctaacggaggaataccacatgagtattgaattattacgtcaaagtgaaaatctatgaaatgccatcgacgagtgttctaatccaagaaaagccattgacgaatctaacttccaaaatgccatcgtgcgaatcaacttctctcagaaatgccatcaccatcactgctctgtcagctctactccattggacatggtgtaaagaccattctgcccttgcgaaggctggataatgtatcggcaaaactactgcctgatacttccttcgtttcatattataagactttctagcattgcccacattcatatatatgttaatgaatctagacatatatgtgtgcctagattcattaatatctatatgaatgtggacaatgctaaaaagtcttataacctgaaatggaggtagtacttttcttttttactggaacggaggtagtactttggtaaagagtggattttttcttggaatatttgcaccaggtaatattcttcctaaaacttaaactgaaattttcaattttcacacaactgaaactgtccaaattttaggattactattcctaaaactgaaatctgcactatgatatacgaactcattttcgagttgtagaccaaaatttgtccaaatttattgaatgtcaggaaccaccaaaattaaactgaatgacaaaatagctaggcaagaactcatatgaacaccactatatgctcagaacagtacaggctagcagaactctaaaaaagtcgatcttgaaaacaagaggaaaaatacaggcaacaatattgcgggtctatgatataaagtcaagcaaagcatatgaacaacacatcccaccacgccgccgctgttgctggaatctcagaatctctgcgtggcaagagcaagccacaaacaaacagcagcaatgctacgagttagctaaagaagaaggcgaggaagaagaaaatcacccatatatagcccgcgacctccgcgccggcgcctgcggcctcctcgtcgtcgcctgtgaccgccgcaccgctgcctacgaagccagcgctgctgcctgtggagcccgcgccgatgcatgtgaccaccgcgccgccgcctgtggagccagcgccatcgccgccgcctaaggaccctgcgccattgcctcggactcctgactgctccttgcgactgccgcgccgataccgccatgtaccgcccgcgcctcctcctggaactactgcgtcaggcatagcggcaccaccaccgtggagtgctgcctcgccgtcgtcgctgggcggaagagacgcctgaatctggtttagggttgtagaagtgtggagattatggataccccatacccatacggcatgtatatccgactaggtatggggtgccatgtatagatagaatatcttcaaagggactcgggttaaattccaaacttgtatgtcaacgaaatacccgggatcctagtcggttacgattgtatcttatctgtaactacctattccgttagggatatgggctgtactttgtaatacggacccctttccctatataaggaggggtccgggtgcctcttggggcatgatttttctctcagatcatacgatcaataaaaccctcggcagatcaatccccggataggagtagggtattacttcttattaagaaggcctgaatctgtataaatttccttgtctctaaacccatccacttctccagcttgatagccacctccttttaggagcagggatcacggtgaacgatctattcactcgcctcccgactgacacaccgactgacacagggagcgtcgggtcgaacaacctcgctccccacgtcgaaggcgtcccgtcgatcatcgcgatactatcaaccagtgatgtgcggcgagaggccacatcccccaccattcaccagatcgttatgacgacgatgtggatggagttgctgccttcacaagtgacctacgccgagtggatttgctggccggcttcaaaccgactggaattgagaagtatgacgacacgacaaatcctgagtcttggctcacagtctacggtctcgcaattcgtgcagcaggaggagatagcaaagccatggctaattatctgtccgtggccctagcggactctgtccggtcctggcttcacgggctgccccgtgacacgatcggctcctgggcggagcttcgtgaccacttcatcgccaacttccagggcacttttgaatgtcctggtacccagtttgatctttacaacattatccagaagtccggagaatcccttcgagattacatccgatgtttctctgagcaacgtaacaagatctctgatatcactgacgacgttatcatcgccgccttcactaagggcattcgccatgaactagtcggcaagtttggccgcaagcctcccaagactgtcaagcagatgtttgaaaaagccaatgagtatgccaaagtagaagacgttgtcattgcatccaagcagtcgggcagcacctggaagccaaagaaagatgcgccgactacaggggggagtggaagtgccaatcacaaggatcgcaagcgtaagcccgaggaacttgtggcaactactacaccatcctcccgacagcgctcacacgtcaacactttcgacaagatcatgaactcccaatgcccgcatcgtccgaattcaaatcatgcggccaaatatttcttcgtctagaaacagttcgcagagcaatacgccaagaatgcacgcaagctgactgacggagatcaaagcatgtcaaagaagaaggatgatgaagatgatgccccgactggttttcaagactcccgcaaggaactcaacgacatctttggcggacccctggcttatgaatccaagcgaaagcaaaagctgaccaaacgggagaacaatgttgttcagcccgatacaccccaatatcttcggtggtcagagacagttatcaagtttaaccgctcggatcatcctgaccgagtggtccacccggatcatcctgaccgagtggtccacccggggtggtaccccctagtgctagacccagtggttcgcaacgtcaagctccgacgatctctcatcgatggtggcagcgcactcaatatcctttttgccaagactctagacgacatgcagatccctcggacagaactgaagccgagtagtgcgccctttcacagattcatccccgggctatcttctactccactcggccagatcactttgctggttaccttcggcactcgggagaactttcgcacagagaacatttgctttgaagttgctgactttgagacagcgtaccacgctatactcggacgcccggcgttagccaagttcatggttgtcccacactatatctacaggatgatgaagatgccaggtcctcgaggagtcatatccctgcggagtgacatcaagcaaaccgtcacctgcgacaaggaaagctgcgagatggcccagactcgcgagatcacgctcgctcgagaggagatccgactggctgcatcaacagcaaccgaaggagaagtgcctgcaatgtcacgcccggaatttctatccaaaattccaaacgcttacatgtatgtaaaccctcgtccaggaatcagccgaggcacacaataacaaattgataatacagtacaattattactctaattaataagcgaacaaaatgtcattacagaggtagatagttcctctcaatcaataaagttctaagaagcggaaaataaaagaaacagcgcaggcgactcctctccacaggcagcttgaccagggctactcctaatcatccacaccaacagcatcactgtagaactcctcctctgatgaatgattgcaaggtgagtatatgacatattcagcaagccacgtagcaaatatgcaagtgcacgggatagcaaaggatggcataatatagtctcatttgcataaatagcatttaacaaatatttcagaatttaataaaacagttaaataataattaaacaatattaatccaacgctatgcaacataccctgttgcgtaggcccaaccattctgaacaaccaaccccggctgcacagttctaactccaaaccaggaattaaccattccaaaccaggagctaaccaagttattaacattaatatggtgagaaatgtgagactaatcacgaaagacattgttagacccgcccataaccgcgggcacgactattcgaatagtttaaactctggccaaaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttaaacaaggcatggactccccagcgacccccgtgggcttatctccgccacttcacagtctggtgctctactatgaaccatactatacagaaagtaaagccgttgccaacgctggcttgtggttggcacggtaaatgtttcacaaccgaaaatcgtgaaccggtccttaattgtcatgagcacaaccatcaaaaccatatgctcacaacccaccattatcaggttttggttggcaaattgattaattaaccaatcacgatcaaccatcgtgagctatcattaagccatcattaaataatagtgaatcataagttatcccatttatatgagctagtgtctctaagcatggctaagcaattctgtctaatatctagctgaaccaacatataaagctcaactagtaaaattataataacccaaggtatcaaggaatagagtaatcaaggacaaaagggccataacaaaacaataggttatttccacccaatgacattcaaaaataaatgcaatagttgaatagaaacaatagctttaaacgggatcaacatgctcaaaggatcgtttgggatctgtgtgacttgccttgctggccttggaactcttcaaagtcttctcctgcaaattcggactctccgggaacgtcggaatctaaagagaaaagaacaaaatcacccaaatagcacataaacaagcatgagcagtacatgtggatatttttaacatgtagatctcaattttagaaaaatttagagacttgaaccaactaaatccgagctaagatgaattagttatgaattttcaaagatttaatcggattaaatcatttatatagattttaattgaattatgacgcaatattgaattatttttgaacaggaaaaggggattattgcgtcagcggctagggttcacggtggaccgggtgcacggcggtgactcacggaaacgaacggccgggattgatcctatccaaaatgaacgaccgagatcatcttgatctaccgcgggtctatggcggacggcatcgatgacgtcaacggtgacgccatcaccggtggtggctcggcctcgcgtgctcaccggcaaatgacggcacggcggcgcgaacggacggcacctacgggttgcgggcgacgcggcgaactcaccggtgaccaaaacggcagcagatggtcaacggacggcgacagcgatgaggaagaagcggcggcgaccttcggctcgacgacgacggcggggctccggcgatctacagcgacaacggaggggcggacgaggtcagcgacgacttgatgatcacgacggcggctttcccgagcgacgacgacgaccggagcgacggtggcgcacggctggacgaacggcggtgacggtggcgctaggctacatggcgctagagctctaccggcggtgagagacgaaagcgagggtggcggcggagagaggagacatcgagggtccttttatagcggctagggggcggcggcgaaggcccacggcggccggcggcccgaaggaaagtctagggttcggggagagagacgaatccgattcgagatcgaatctaccaatttccaaacgatgttagccgacgattccaaaagagaaaaggtagagtggatctcggggatcattttccctctatcaatttcaccggatcgggaaagggatgaacgaatttggaaggagacggtggcgcggctcggctagggttcagtcgggcgacggctggaggttgacgacggccctgactggtgggccccacctgtcagcgggcggatgcgcgcgcacgcgtgagcggcggctcgcttgcgggcccggcttgggccgagggagggagagagagatttgggccgactttcggcccaaagccaaaagaagactttttaaaacttttccaatttaaattattcatgaaattcaattccatttattaaaaatacttccttggctcaaataaatcccagaaaatcaaggaatatagaatcaagcaaaatttttaataaaattttatctggcccaattttatattggaatttattatttaaaattagatcttctcttctaggcttttaaaatcaattctaataattccaattaaacaacaatttatatatttaagatttttagggtgtgacatgcatccaagatatcaaagagcggagaaggcgatgccaagactaagaaaattcctctagatccctctgatcccactaagactgctgtaataagcgctgagttagattgtaaataggaaagcgcgctcatcacctttcttcaaaataataaagatatctttgcgtggaaaccatctgatatgcctggtattcctaaagaggttattgagcactctttacatattaaggaagacgctaaacccattaagcaacgactccgccgttttgcacaggataggaaggatgcgatcacggaggaattgaccaagctgttagcagcaggcttcatcaaggaagtcctacatcccgactggctggcaaacccggtcctggttcggaagaggacagtgcaatggcgtatgtgtgttgattacaccgacctcaacaaatcttgtcccaaagatcccttcgggttacctcgcattgaccaggtagttgactcaacggccggctgcgagctactcagtttcctggattgctactcagggtatcatcagatccgattaaaagagtccgactacttgaagacttcattcatcacaccgttcggggcttagtgctacatcaccatgccttttggattgaagaacgcgggagcaacttaccaacgcatgatccagagatatttttcaactcagattggtcgcaacgttgaagcttatgttgatgacgtagttgtcaagaccaagtagaaggctgatttgatcgcggatctagaagagacctttgcaagcatccgcgccttcaggatgaagtttaatcctgaaaagtgcatcttcggagtaccgtcagggaagttgcttggctttatgatatcccataggggcatacaggccaacccgtagaagatcaacgccattctcaacatgaaaccgccgagttcccagaaagacgttcaaaagctaactggatgcatggcggtgctcagccggtttgtctcacgactcggcgagcggaggatgccatttttcaagttgctaaagaaaaccgacaatttccagtggggacccgaagtgcaaaaagcctttgaagacctcaagaaacttctcaccactccaccggtcttaacttcaccacatccgcaagagccattgttgttatatgtgtcggcaacatctcaggttgtgagcacggtcctggttgtcgagcgtgaagaagatggccatgttgaaaaagtccaacgaccaatttatttcgtcagcaaggttttagccgactccaagacaagatatcctcaggtgcaaaagttggtatatggtgttttaattaccgttaggaaattatctcactattttcaaggtcactcggtcacggtggtcacatcgtttctactcggggacatacttcataatcgcgaggcaaatggacggattgcaaagtgggctttagagttgatgtctttggatctatccttcaagccgcgaatttcgatcaagtcccaagccttagcagattttatcgctgagtggactgagtgccaagaagacatgcctatagaaaagatggagtattggactatgcattttgacgggtcaaagaggctttcaggcaccggagcaggagttgtcctgatttccccgacttgagaaaggctgagctacgtattgtggatacatttttctacgtcccataatgtggcagaatatgaggcgcttcttcatgtattaaggatcgcaatatctttggagatccggcgtctgatagtttgtggagattctcagttggttgttaatcaagtcatgaaagagtggtcctgcctcgatgataatatggctgcttatcggcaggaggtacgcaagttagaagataagtttgatggcctcgatctaacccatgttcttcgaaataacaatgaggcagccgacagactggccaatttcggttcg

SEQ ID NO: 858 - DNA, 1652 bp, Oryza sativa
tccatcagggattctgcaatgctatgtctttggaggagggaaggcaattgctaaaagatatacactcgggcatctgtggcaatcacgctgtcgcacgaaccattgttggcaaggcttatcggcagggttttttctggcctactactgtatccgacgccgattaaattgtgcgaacatgtgaaggttgtcaattttttgcccgacagactcatttaccatctcaggagttgcaaaccatcccgttatcctggccgttcgcggtttgggggctcgacatggtcggcccattcaaaagggctactggtggtttcacttatctttttgtagctattgacaagttctcaaagtggattgaagccaaactagtcgtcacgattacagcggacaaggctagagattttttcatcaacatcgtgcaccggttcggggtacccaatcgaatcattaccgataatggtactcaattcactggcgatgtgtttaaagatttttgtgaagacttcggcatcaaaatttgctatgcctccgtagcgcatcctataagcaatggataagtcgaacgtgccaatggtatggtacttcaaggaatcaaagcgtgagttttcgaccgactgcatccctatgctggcaaatgggtagatcagctgccatccgtactttggtctctgcatactacgcccagtcgggccacgggtcagtcaccgttttttctggtctatggtgcggaagcaatgttgccaagcgaggtagagttcgaatctttgcgattttgcaacttcaaggaggagcgctacggagaagaccgagttgacgatctcaaccgactggaagaagcccgtggggcagccttaattcagtcggctcggtatttacaagggttgcgacgttgtcacaaccgcaatgtttgatcgcgggttttcttagtcggagaccaggttttgaggaaaattcaaactacacgagatcggcacaagttatctccattataggagggccagttcataatttctaaagttactcggccaggttcttatcgactcaagcgtgaagacggtactcaatgtcgacaactcttgaaatattgagcatgttcatcgtttttatgctagggcattacttttgtatcttctttccctctttgattgctaacatcaagttgctccttgagttatcagtcaggggctactataataataattgagtgtgattcttatcaattcaatttgcttcccgtctgcaaagccgttgacagcgtcaatatcgatcttcgggtacaagaacttggtcattgccaatgccatgctcgcccccatgcatccagcttctttgatgttcttaaagtatgtatccgaagcagctctcagcttgtcgaagtttcgatagcgtcgaacgaactcagaccattattattaaaaaaacatggcttggatgagtggtgtatcggcgttggcaacttcatccctggctccttcaagcttcttaattttgttgaccaagatgtcgaattgagcctgagatttaattcctgcaatatgcataaatggttcacatcaatgactgggcacgaagacaagaatggttctggagttttaactacaaataccttagatgtctttcagagccgagtccctctgtttggtcaattcaccctt

SEQ ID NO: 859 - DNA, 581 bp, Oryza sativa
cctttgaatcaaaggatttatgtaaggaatttcataagattcaaatcctataggaaaattttctatttggcacattgattcaaaggattaaaactttccaaatcatatgaaattcctatggaatgacacattgcatgtatattttggaggaaacttagcaagaggtctaacctcttgaaaatttcctttgagtctatctctcttatccgattcctgtgtttttcctatggtccaatcaaacgatcattcctgtgttttttcctatgttttgcaatcatctattttatactttaattcatgtcagaatcatgtatttttcctatttctctactttttttaaccctgggattcaaaagggccctaatgatgagacatagtcctgatctttcgatagatactgataagtcgtttgtggagaactcatcattgatgtaggatcgaacaacaagaactaaggtcctgtttgtttcagcttaggattattataatctggattattaagagtaagctgaaacaaacaagtagattattatgatagattattataatctataagccatattactataatctaataatct

SEQ ID NO: 860 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgtccagcggcagcgcaggtggcactgtgcctgcaggcgtcggcgcgcgcgtggtcgcggacaagcaaggtgctggacctcgacgcgctgtcaacccacgacgccactgctacggtcttctgtcggcgtgcccttcctctgggaggaggcgtctaggaggcctaaggttgtggtcatgccggaagacgttgcgccgccgctgcccattccggctaccggcgagaggacacctgtttctcacggacgcgatggcattgtccagcagcagcgcagccgctaggttgttgtaccctaaggtcaaagagataatcagacgatcagacgatgaagatgaaaagaagcgaattaatcgcgcatttagtttctctcgttgcaacgggaagaccgtgtagtagattttctgtttcttaaaaggaaaaataatcttataagaaacacccaactagacattaagatatggtagcagaggagatacattaatgttttgatatgcccttattgctagcaatgtcgccgtaagacgcaaaatttttaacctcattgccaagttttgactggatgctagtgatatgc

SEQ ID NO: 861 - DNA, 18207 bp, Oryza sativa
atattgtgtgtggtttaagcaagggagtcaaatttaaaaataaagcctagctaaaatctgcatttatggctcaaaatatatattataatctacgaagagctagcttttagcttaattgatgtactaacaactgattaatgtactagcccgaagtgttaatagttaacaaaggacaggggtgcaattacaaggtagcaatcgcggggatatatatgtacagtgcgaattgataatttggattcgctagccaagatgaggacacttcaagtgcaaaagaagggaaacgcctgattaattattttttactagctacaagtaaagagcatggtactggctgtaatttagaatggtcggtttaagtcctgacgctcataattaaatattacaaacatgaggtgacactttccatttgaatctaattagtgattttggatatttactcatgtacaccttttttttttaattttagggtagttttatatccttgaaaaggtactaagatgtaccacatttttcaagtgtaaaacttagtacctccagctataattaggtagtatcttgaggtaaaaaaaaatcttagtgtaaaatttaactacctcaacaaactttcttaacgaccatgaaatttctcaaaattttaagatgtattaggacacaatcataggtgtatgcgtgtgcatatgtgcatttttcacttaactaattgaagaaaatagtggtctcaagctagctactactccctccgttttagattatcatttatcattttaggaaattttacaccaaataaaaagatgagcaaaattatatcgttattatcctccttaactgcattccaattatttcctaaaacatcatcaactattggccgagtttagttccaaaatttttcttcaaactttcaacttatccattacattaaaacttctctacacacacaaacttccaacttttccgtcacatcattccaatttcaacaaacttctaattttggcgtgaaactaaacacaccccttattaattaacaactcaacgtctaatatcaattgtgcatggctgcattattgatgaagggtaaaagtataatgtcaactctaaaattagatcaaattgatctacatatttcataggtacaccaagaccaagaaaagctaatactccatccattctaaaatataaggcacaaccactcttaacccaaagaccaagaaacaattattatcacttctttgtttgaatcaatccaaccaatacaatacatgcacccaatagaattaaacatcttatgagtgtatgatttaaaaaataataatttaggagagaagagatgcttattaattgtcatgaatgcatgcacgctttatattatgaaacacctttaaaaagtagttgcgccctatattttgaaacggatggagtaactctctcagggcagtcccaacccataacactagacatggtttccataaactccacatcatcaagaaactagtactagacactactcttccaatgcaaacaccactattccatacttcaatttaacgctacttatctcacataatgtcttggatgttgtgtagaaaccatgtctcatgcaagacatggttttcttctttttcctcatttattcacttgccacatcattttttttcctaggtggcaacttatttaatgctatggacaccatcctagtcattgggttgggaatgccctcatactatatttactctagcaacaaactcaatgtatgcaccatccccactattttctagccaatagcaaatcaagatattgtatgtgagttataaatgcttgtgtgcatggatgcatacatcaatatccatttactccaacgcacaaataacaaatagatctaatgaatgaacacaaatatgtagatcatttaggaaaaacttaaaaaaactatatgtaaattaatttggaacggagggagtattttgataaaaatgtaagtgctacaataataaagttttgtgaaaagaagggacgattactaattgggtgctaattattggtgttagttggtgagtactcctacgtggtgtagtaattggttaggctttctgcttcagggatcaaatcaaaccggtcaggccgcccatgaccatgagaggatcgatgagcgatcgattgattaatcaggaggcgaatctggattaattagctggtgggtgtgtggttagcttcagattggagtctatcgatgtcgatcagtctaaattaacagcccggccgcgatagctaggaacgattccatcggaaggtggatatgttttgacaacataaatgtgagggcatgcagtgtcaatttcacgaatcaagatccaatgcacgcagttgcacacaatctgatccatccatattttatcgcagagtctaaattgaatgccagagtctaataaatgactgttttcttctttttttttaattacacggtagacgcatacgcacacccacacatacacacaccactatacatgcaacaacacactcatatttctacgaatgtgtcttctagtacatgatctaagagatggaaatcagtggcacatccttaatctccactaaaatccgtttgaaagctattcgtgggcatcaggatttgaaccctggtgggtggagtgatgcacctataattctaccaccacatcactgttttctggggggggggggggaattatcaagtgaaaaccattaaataattaaaaaaccatgaaaaaccatgtctgaaagttttctaaaaattcataaaaaaattataaaaaaaattactagagatagatataggcatgaaattcatccataccaaatctcaaatctaaaatcagcttcattttacagaaattaaaaagacaaattttacgtgaacatatagtactattcactcattttttttatattttactttcaagtaagttattgcatctgagatttggtgagaatgtagtttatgcctaaatctgtttgcagtaattttctcataaatttagtgaattttagatctggtttttacgagttaattttttttcatttgatggatttcgcgggatatgtccctgttttctattcccaaacggtcaaaaaaagaaaatgagcatttcagatttacgactgtatatgatcttcgatatgatgaggtccaagtttttgcatggacatataggcagatgggaacatgtgcatgcgtgcatgcgtgcaaatggatatatatggatgcgtcgacctgtggtggtttgcgcgttgccctcgatcgatcggcggccggcatgcacacatcatgtacaagctgatcagcactccagtcgggccggctgcaggatcgccgattcgccgttgcgccgtcgctcttggcttttgacccaacaaccgcgtacacggtacacacgcatatgtacaagcaggagcaggagtgtgtagcagcctacgtactactacgctcgatcgatcaataggtcatgagatgtacgtgtacgtatgtatacgcagctgagctgacgatatgatgtgatgatgagttcggttgccggcgacgagactagctattaattagctatgcatacgtagtcgatcaatatatatgcgtgatatggatgcatggcggtagctagggtgtcgccgataatatgcctcagcgtcaatcgtacgtgcatgtatgcggttgtgtatacatgtgtgcccggctctgcatgcccctgcaggggaggttaccaagtcgatcgccagccgcgatcgacacaccgcaacatctgttgtgtagctaccacaggattagatcattagagaggtgcgtacttcactactacaatacctattttcctatgcggacgttttatacggttgtccggcccaactgtagcccggcgtctaggaaaatcggcattttcacatacgggcgacccgacgaccgcacgggataattgattatcccgtacggttgtcttatgccacccgcacgaaaaaaaacaaccaaaaaaaacatgaaaatagccgttgcccgccagatctgggcggggccccacctgctcgtcgctgcataggaagggaggcagcggtcgacgtgcacgacgtggacgatcaccaggaggaggtccgccgctgcgcccgaccgtcgccgcgcctggctcgctgcctcgccagctcggtgatcaccgcgccctgctcgccgcctctcccgctagccgccgcgcccggctcgccaccgcgccggcccgccgcctcgcccggccgtcgccgcgcccggctcgccgccttgccagcctgacagagggaaggggggaggagtggaaggtgtggagggagttgactgaggggaagagataaggtagagagagagggggggtagttgagggagaataaaagaaaaaaagtaagagagaggatgtgaaaaatttgaagtggatgggagggaaaagagggaggtattttcctgtgcggttcacttaaaaaggccgcacgggaaaatcgatttttccgtgcgatccacttaaatcaaccacacgggataatgatgattatcccatgcggtcggattaggaggctcgcacgggaaaatcgattttcccatgcgggcgacagccccgcaccgctccccttatttttccgtacggttccacttacgaccacttgaaaacaaaagggggcggtgtccagaaaaatctatcatgtagtgtgcttggtccctttatttatgattaagctacaaattttatctacgatgtacttcataagaaaactttatatatgaaagtttctttaaaataatatatatttttctctcatgtttaattataataattaaaactcaatcaatcatatcataatgtttttctatttttacgtatcataagtttgtctttatcttcagcaaaagcgaacacaaccgtactcctcaaaatccagcaactagatgtcttgcaaaaaaaaaattcaacatgatgcagcctaggtatcatcatattagtagcggtgtgccttcccatgcatgcgccagtgggcaatgcagtgcacagtttggagctaacctttacttgctgttttttttttctttatcgatcttctctttgaaaacataaagaacttcagcttgatcgagtttctttggccttagttaccactagctagtactcgaacaagcaacgcttttaattacaatcgactatcgctacttaaaatattcattttgaagatacccatataggcgaatcataaagcgaaacaacggcatataagatgaaccatatgagaaaacacattttcgtaaacaagtgacttaagtggtcgacatgtacattgtaaatagtttgttttcatatgaggggtgcttaagtggtgcaccttttgtaattaattaacctaatttacatagtcagtccatctaagtgttcgtctttgtttaatttattcaccgaggaacacgcgtaaaaatgttcactatgtaagacctctttgtccacgggctgctccattcagagtttcagaccactctcttcgattcaaaaactcacaaaatatagttgcatcaggccatgcaccacttgtcaaagaaaagggacagcctccacgatttaaccatcgctgctctatggctgccatcaccactgctccctagccctcttcttctgcagtggacgaggcgacttcacatgctgcaaattgggttgtagccttgaatagaccagtatcttggcaccggaaacatatataggagaaaggagggaatcgagtagacgaggaggaggaggaagtagcacgcggatgcctagctggaaggcccattacacatatgcatcacgttggattaaaactgtcctaaattcgaatcaagttgtaattcatccgatcaaaagagttcgggtgttgaatatgaaagtatttgaagcaaaaattcaaatgggggttaatatgatctttgttccttgagaaatttttaagtacttaagagacactaaaatttttagtggaaatttacgtaccttctaatatctggaggtactaaaatttttaatgcaaattttcataccttctagtattgaagatactgaaaaatctaaattttacgctaaaaaatatggaagctcataaacaactgtaaaatcactcttctttccttgaatgaaataaaaaaatacgcaaatattaaggaatgacctagtatcaaataattagaagtttcgaatccaggtcgtgtagcccaccaccttgtgaagctagccggaaaacccctgaacgtttctcttcttgaatgaaatcgcttagcacctaaaaagaaaaacaacttttatgaaaaaagaaaggggggagaaacacctggcgcgcagctacatgtacacccaccattttcttttctttcaataaaattaagcttgtacttcctccgtcccaaaataaagctatttttgaggttggcataggtattaagaaagtaggtgagaataattggaggaagtgtgtgattggttgaaaagagaaagtaggtgaagaagaatggtcgtgattggttgagaggaggaggtaggtgaagaaataactttattttaggacaagacactgtgctagaaatagctacattttaggacggtgggagtagtacattttaatcatccactaaatcaagcatgatcggcttaattcctgatcagaacttggtggtggcgcaggaccgcgtgcagtgggatacgcatgatttcatcatgcacgacgcccatgaaaagagaacacagtacatgtggcagcatgtatgggaatggatagcactagctagctgggccccccgtgacaggcacgggctccaggaagagaccagccgacgttcacgggttctccatatggcattgggtatacctgtcccttgttccagacgttactactgtctagtgctgtctgtgacaggtttgtttggcaaatggaatttttcggcagatcagccggttgcccgtgcacacttcaccgcgcccaattgcgaaaatgcatgtgattctcgcgaggtttggttggtgcgacacgcacatcctgagactgagaggccgggtttctgtgcatgtccgtcaggccgtctgctggtgttgacctaccaaccgtcccccagtttggttcggtatacgtgtgcgtccgggaagggcggaaggctatagccattgatcacttttcgattgcccgatatgtctgtggtgagagaaatcaatgcccgatcgagcctatgttcgtcatgcacacattggctgtgtttagttggatccaaagtttggattttgattaaaattagagatgatgtgactgaaaagttgggtgtgtatgacaggttgatgtgatggaaaagtactgaagtttggatccaaactttggatctaaactcagccattgtctagctagccatgcatcacattgttaatttgtgcatgttttgcttccaattttgaaaagggaaggacagtatatacgcatcaggttcaggttcttgacggcgcatacagatatgcggtgtactgcagcttagagcgatcgagcccatgtgctgtgtgggacgcgttgtccccggaacatgcatacgctccgcgcgccggtggacgcggcgcggcgcggcgcggtgtatgcagcgcagcgaggaaacagcctgtacgtgtgccatgctgttgctgctgtacgcgtacgcgcgtcgccgccgcactgtctccctcccgtggtctctctctcgcgcgcgcgcggctacggttgctggtgagcccgttgaaaacgcgcgcgcgcgcgcgcaccggcaccgcgtcgtgtacctaaccgattttccactgcaaaatcaaaagcgagagacgggctagctagctgcatcatcatatcaatgcacaccgcacatgtatcattgcccgcggtttaatttccagcgcagactgcaaattaacaggctaaattcggccaaaagggagcagctagcttttagtacgtttttttaaacattttatatagatgttcctttaaaatattaaatatatatatttatcaagtttataataattaaaaactcattaactatgtgttaaaggttttctcgttttatgtgcatcaacttaatcttcatgtttcatcagtttcatataaaaggaaaaacgagctaagctagcgatatgtgtatgcatcatatcgcaaccactttcccatgtagctctcgatcgcgagatcatcaccaactaacagcaaataattaaatggacagcaccaaagctaagctccaacataacaaccctgcattatgcatgtgtgtacatgtactctgtctactgcgtgccaccaggaagatcattcaatcagagatttttgtgcctaatcattgggcttcttccataatgcctgattgccttgctattagcaaagctagctccatgctgtatgtgcgtatatgtccataaagatcaatctacagcacaactcctgcactaatcgctttttggataggcaaacaagtactgcattcaaacctatacgagaagtatatgtatagtgcacattactgccaaattggttagcacatgggtcatctttgcagctgttgtccaggttagttttgaagatgcatggaacattccaacgaccttaatttatactctatgcaccgtcacaaatgaatgttctgtcaaccttttcattctttgaccactaatataatacttgatggaagctgcaaagtctggggcttttaactatttgccacttttagatttggcaaataactatttgccatccctatctcaatgacatgtgggtccacatgtgtctatgacatgtgggtccattggcaaaaagttaattgccacatctaaatgtggcaaatggttaaatatctcgcaaagtcttgatttgtagtgtccaaaatttatccggccaaaacttgatttctaagggttataaccactcagactaagagcagtttaatagtatagccaactactagctccaattcatctatagccaatctaatagctcatttatacaatagtacatactatactattaatacctggtcctacctgtcatacgcacactgcgtcttggagtccgtgctacagctagctacaaatctatagctcgttgctcttctctcttcttatttatctcattaaaatatatttgcagctggcttatagcctgctattgtacctactctaaggctctgttcgtaagtgctcgttcccaactcccttcgcctcgttttccacgcatacgcttcccaaactgctaaacggtgttttttttaaaagtttttatacaaaagttgtttaaaaaatcatattgatccattttattaaaaaaattggctaatacttaattaatcacgcgctaatggaccgctctgctttccgtgcgcactgttcctagttgggaacctccagcagcgaacagagcaggctaagtttggtaccgaggttaagcaaggatttttcgccgtacgtaaaataacacaaaccattagcgtataatttattaagtattataaacatgaaaaatgggtttatttaattttttaaacgaaaccttatatatatatattttttaccgaaaacatacgttttaataatttagaaagtgctaacaagaaaggataaagttgacactctaaactcactatcaaacggggtccaagacatgtatctgatgggaacacgaaaaatacaacaaagagtattaatgagaaacaccataatcatatttcttcccactactaatttgtcggatatataattgcaaggaaacaagtgtttgtgggaggggagggaggaatcaagtacatctatgcaaagttatatactctggccaccccggagtaataatgttggatttgtcttgcaatatatgtatatcgctgtataactttttttagataatgaaatagtcatctcggcctttgctcaaagagagctacagtctattattacaatctagcactctaaaacgagtgtagttcagaaatgatagaagaaatgaccacacaaaggtaaatttaaccaaaacaatatcgggagaacacattattgaagtctatttgtgaattttcatccatgattggcaaaaagctgcataaccgtcgtctcaagcttacgacatgcagcttttaaaagctcaccgtcttcatcacacctttatagttgtgcccaaaacggaagccaataggttgccctgaaaattacctgcatatatgtagcatatggtgatttgtcaaaaatcatatcattcctacacaaccacagagcccaaccatatcgatgtataactaatatatgattcccattatttccatgtgtattacaattagagtctgtatatgtcctcaagattttgcattacaaattttggataatcatctaaaacgacccctctttttttggacgacaaggaatcagcaattattttgccgaggttatccatggggtaaaccatatatatctcttatttctggctggttttaaagtccagataaaatagttttagctttattttgttctacaattatacaaatctgctttatatattaccctgtttcttaaagaaaagaattcacaatcatgcagatgtgctttagtttgttcatcaatgcctcttccaattcagatggaattgatgcccactctcagttgtattttctatacactttacaagggtgattccatcctaatttttccacgtggttgttcttgtgatagattagatttgacatgtatgctcgcggttgcagagcttgagccaatttcaagagggggccaaataattcctactaaatagttgagttttcaacatgtaactagtggaaaaaaaatatttgcacgatatattaagaaaaaaaattcatgttatacctaggattattacaagaattaaagaaaaaaaagccacacaaaactgaaaaagaagaagtaaaagagtggacaagcactgcaaaaagagagaaaaaatagatccgaaagagtgagctttgaatgattcgaactctcaacctccatgttatattttactccctttattccataatataaggcacaactactttttagagatgttccataatataaggcatacatacatgcatgccattaattaacacatattctccactaaaatattattatttaaattatccactatcaagatctctaattttattgggtgcatgcattacatttatttgattaatctaaactatgaggtgataataattatttcttaatctttgggcttagggtggttgtgccttatattttggaatggagggagtaaaaaaaagaaaagaaatgcaaaaacttaaaaacttatatacgaacttacatgttgtataagaaggccatataaaaattttcatattttttagacttctaatgagataattaaattgtaaatcttgtgtgtgcataaggatatttttaggtatttttgaaaaaaaggcctaacccaataccgtatcgtagaataattgataaaaaagtcactggtatattatagaaagaaataatatcagtggcaaattattaaattcagacaaattcagtagtataaaatagatttatctcatttatttatatcggtctaatctttcgaatgcactactcataagaataaggggacgtatgtgtgttcgtagggctgagtaacgcatgcgtgtttatgagggggaaaaaatcataatatcagtgcaagagggtcctcctgttgaccttgatctttctcttactcaaataaaatttgaaaaattaattaaaagtgcagtggccctagtgtctcattaaggaggacaataatgcacatagatgcagggagtccatcgtacctcttaatgcacaattaaccaaacaagagcatgggtaccaacatgttgagggatccaccggatcatgaccattcgatcaactgtgacgaccagataacctggagtcatgcgtgtacccacgtagacatggccccatgaacaatttctttttctccgaataaatcacccaaatcaagcaccgaacaatttcttttctcctcagtgctgcatgaagcccttagagcaggtacaatagcaggctataagccagctgcaaacatattttaaagagataaataaagagagaggagagcagcggactacagatttgtagccagctgtagtacggactctaagacgcagtgtgtgtatgacaggtgggaccagatattaatagtgtagtatataactattgtatggatgggatattagattggctatagatgaattgaagctattagttggctatactattaaacttgctcttatagtccctccaaacaaatcaccgaaatctgacaaaaaaaaaagagtaagaaatataaattataattttttttctaaaatcttagaggaaatgataaaccaacttatggactcgacgatcccaaaaatgtgaaactgaaactttcgattaagagagcaacaaattccaataaataaatacaatttggatggagacggcttaattatacatgtacagtatgacaggcccccctccaaattaaactagcacgactatttcgtgattatagtgcctgctaattgccatcgctgatcgctgtcagtatgtagcagtactgtagctgcaagcaaagcaaagatgtgtttggtgtgccgtgcacctctccatctccatctcgatgctgctcgatcggaaggctatcctgaatgatggatagtcctaattgtttggataggtttctccacgtcgactttcacttgcttccactcaggtggggcaggacgtacgacactaggacactagctgaaaaaaaggcacaagtcctttggaattgtagggcataattttacaatttctgtatggctcagattgtttcttttgaaaattcattaaactcctatgcagcactaacttttttgtttgaaagaaaaaggaaattttttactagtattaaataattacatcaagataatacacagttattttaagaccactcttaacctctatatgcatcactgaatgtatagtttcgtcaaaaaaccaagtctactatggaaagggtttctatgagagagtttaactgatttgcgtgaaaactctacaaattactgcaaaaagattttagttttttctactactagcatattcatattgtccctacgatgcaacgggattttaattaaagaagattattatcaacccattattaccatcatttccttcatacatcatttcttaatttctctatatatgtatttgttactaacatgtgatccttcataccctcagactattcttttttcttttaataaaatgtaatgaattgatagtggaggtggttgacacgtggaccctttggtcctacttgtcatttttctttttcaaatagtatggagttggtggtgcaagctatggcagattcatcactcaccatcatcactgctctcttttataagaataaaaataattttatattaacgagcaaggtatcacttttgagtacacctcctctttcacatagaaatgtgaagcttgccctacatgtggacaccgtgctagtaccagagcatctccaactccaagagttccgtatggccgtatacatggctcctaaagcttaactttaggaattaagtcacaatctaggccttcaataaaatacccataagctctctaattttgtactcacgcttaacatcgatgccttaccgagccaaatattgggcacgtatcggcactcctggtgtcgattcagccactatcgttcgatccgcttggtagcaatgatctctccctcgcaaggaaaaaaaaaacagaaacagtttaaaggaggactcacttaaaaccaaatttaggattactgttggcggagagggtgatttgttggtctaattcttttaaggatggcccaaatcaagaatttctagtgtcaaattttagtatactcttaaagagatgctctaagataagattacacacaaaattacatccatgcatgcatcgatctctttttccatgctgatttgattttaggatgcggcataattttaaaatttcgatgtcaattgtaaaattatgtgacatttccatgcagtgctaagtatgtagtttcttttataagagtaagcctctttttgaacagagtatatttgtaggattcctacaagaattgaactaattttccatgaactttctttttttgaaaagacgttcttgtgtttcaaaggaatactaatttattgttccacttcaaaattttgtttcagaaggtattgccgaggtttaggataataactttagggaaaaatccaaataacgcaccttttcaatctcccctacaaattagttttgtaacttccctcctctatctagtttttagtgattctcatcgcactccttagcgatttctctagcatatggtgagcgaattaagaccctatgttctctcttattggacataagatttaatacgccttatctaataatttgaggtcattgtcatgttttatcgccgtatctttggtgaaattaaagcatgcaaaagcaaaaacaaaatgaaaagtagctttggtgtcaagaggcaacttaatgggagacccataaggcatgagaaattgctgaaaactggatagaggtgaaaagttgaaagagaaaatgaacttgtgtggagtgttttgtaccaaaataatttgtcggggagagattagaaatatgagtgacttttagaggtatttggaattttccccataattttatagaggcaatcggtaccacttcatgttttatgattagtaaattctcccatctgtggacacacatcaaaccgtacacatgctacgtggctaagataagattaggagcaaattaaactacatccatgcatctctcttcctttgttcccatgctgattcgattttgagctgatcttgatcggttgttcaagggtttctaccacgagaggggcccacatgtccggatcaccttgggcacgcacccaacggaatgggccccaaaagtggcagttggaacaattgctggccgtggcccatgagctgaaaggcactggtaacggaaaacaccggcccaatctagagggctcctgtgctgacacgtgaaaaaatgaacggtcaggattgcctgcatctccatcgtcttggcattccaaagaccaggaaaaaaatatttttttaatttggaggctgaccctcggccagctcggactctcactgaggctggtttcatcgatttgtgttgtgtccatctgaacagagaaaagaaaaggatagtatgagtaatgtttatacatcaaataaaatttcaaaaaaccatgaatggaaaaaataacccagtcataaataaaaccatctattccggttgatatattagggatgcccatcatgaataaatcttctgaaatatctaatctgatgttctatctactccatttaattactctggaaaagggaaaagacaagatggaacagaagtagagaatggcataccttgctgcatgcatacactacattgcaaaatatttgagaatgatgaggttgttttccaaacaatattgcaacgtccttgcaaggtgccaactgggtaccaagatgggcatcctagacaggcaggttcagagacaacaaagagaacactcttcttgcatgaggccattctccttctaccaaataagactgtccagtaatgactctttgcaatgactcttcaggtctaaatagagaggttcccctctgccgtccaaggtgcagataaacacattaactgcaacataggaggtcaataagacaacaacattagtgtaaatgacaagcatttctttggtgtacaagaaaaccagagggagactagtagcaacacaggtaaatgttagatggcatagaaaattactatctgtaagggtcttaactgtatctagcatatgatgttcaaaggaggaaacctcatcatattagcgtatgggaactaaaagatccactacataaaagcagtgacatgagacccataaacactacagggagcactacgtgaagttatgacatcagaggaattattcatggaagcaatggcgtcaatctcaacaagaactgcttgcaaatttacataatatgagagcaatttaagcccaactaattgaagtgcagaacaaagtttggctgcagaattggcgctagacaagatggtagaggctatatagcattaggaaactgtaaaattaaaagacatggggaggacatatctagctaactagggattaattgtagaaatggctgaaattagcaaatgagacgtcaaagctgaataataaggttctgcatgggcaatcaagacaaaattttaacctctaaagtaaaatgttggtcttagtcaagtagtgatttcactcaaagcaaagacaaattaagcatgatcagtaaatattgctgtttgagcacatcccatgctttctttcagaataccatctgagttctcataagaaattttgcaccaaatttcttggaactgattctgacaaatgaggaaacaaacaacgaattgtgaaggaagtattaccagctcatgcttcaaaacaaatgtaacactgaaaagttggggaaggacgaaaattgtcagtcctccccaccaatttgttttggggaaaaaaaaaacttgccaccgatcatttgagtcagctagaaaaatcgagaaaaaatgtcttctggtgacaaatttctgcttttttaatttgtttctttcttacgaaaagaatcagtcagccataccaaaaggtttcaaaaggatgttggagacattttccctttcccaatttgcatgtcctatctgaatgaaactaaattatgcagtacaccagacctagcaaaaatattgctccaatcagctacagctaaaattaccggtagtcaggtttgagcacccatgttgcaccatttgtgcatctttacaacactgctatttccttcaacagattctgaaaccgcaccatatcgctgcacaaaatgcagttctttaaatgttcagttattgcttgcagagctggctcaagactgaaggtgcacattggcgaattaggactgagactgaataataatgttcctagtagaagagcttgatgcatggcctttctatgatgaacttggtgtgtgattggaagccagtcccaggttgagctgatgttccagatcctctttatctttttctttgtagcgaattgcaaagggaagttcaagtgcatctgaagcagctcctcacattccaggtatcctaactaaaagtttgtcagactttggccctgctattcgaagtaagtgatggctgagaagagctcattaaaccagcgcctattgaggggttgactgaaactccaagaacacagaggatggtgccctggcacaccagctcttccagtccaagtagcaacagaaaaactatcatgacttctaattggagtcaagcttcaactgccgtttgtgccacctgttaagcttctgcttctaggtgcagcttctggccatcgttagcctgcattatgacatcatgactaattgcactctgagaaaattaggaaaaaaatcattttcagaaacaaaaactgtgacaaattatttacgttagggatcagaaattagtgcttacatgaatccagagcatcagaaaaaatatgcaaaatgtcgggttcttcgttcatgccgggatgagctatggtctgttttttccccatgccatgcctggatgagtttggttcagcctcaggggtcgtctgcacatacatgatcttgtcgctagtcatttggaatcttgatattcacatcttcagacaattggctgaaaatattggaggtttcagtcaaacatttactgaaattattggatgatcagtctatatactatcacatggagtatgttgtatatggaggagtgttacgaagtaatcgaactattttgcaattggttcaattatcccatgagtgagtagcaatgagttcaacaggggaaaaaaataaatctaatgttacaaatttcaaaaagccaagcgctagtgtctagcgctgcctccaccgagagacccgactgtgtgcctctatagggcatcttttcggcagggggtcgcctgccgtagggatcttttcactgctccttttttttttttttttgcagctggccggcagggggtcgcctgccgtgccccagtaggggatcttttcac

SEQ ID NO: 862 - DNA, 1368 bp, Oryza sativa
tcgagctaataaacaggtcgtgttgtctcagaatcggcgatatggtacaaaactaatttctatatggattcagtccgagccaaagaacagcgcgcatatcgacctaggagtagaagcgaagcatacctgctctccacgaaagccccgcggcgaggggcgccgtcgatctaagccggtgcagaatcttcgcgccgccgatgccggcatgccgcggagagtacaccggagatccacatcctcctggggttttgacggcgcgtccgcagccagctgctcgccgccggagccggaattggggaagcggcgtcgtcgggggagaagaggaagcgacaaggtgagggggagatcgagggttcccatcgtccatcgtcccatcgaatcacaagtgtcgatgtaagccacgggctgggcttctctcttcacgcctgggcatcaagcccaagctgctgcaggcccagtccacgcctctttttgttttcttttcttttttttctaaaggaatttttgtttgtgctcaaattggtaatgcggttgtttggttttagcgcgcggttacaagataaaataagtaagccaaggctatattgatttgttcacgaaggcatgtagcctgcccaaaaatttggtagaggacaatagaatcagtactaggtttctcaggaaatgtttacatatctgccgatgatagactttgtcctctatcggtacatctctagttttcccagttttccatgcacattccctagcctactcaacagatgatttaatctggtatggttattagatacaaatgaaaatttgcagagaaatttactactgaaaataaaatcacgtgtaaaccggaaattaataaatagcaaggctttacatttgggtatgatccaaaccattcatatgccaggtcatctgtcactagcatccaatccaaactcggcaagtcgattagaaattttgcaaggatcttagcataaatgtctctaaaacccaggccatcttgtttctttgcctttttcagtttatcccaactgatccaatgcgttttttttctccttctcttgctggatccaccaatacctagaaatgagagtgcttatctggtcacctttgtcaaatcaaaatatgccatggtgtagatagggatagcttgagcagctttgatcataatctcctttcacctgtgaattcttcgccagactcttatcttttagatactcaagagcttcagctctagattttctaatatacattggaagccccagatatttctcattttgtgttccctatgttatgtgcaacgtttgcatcacctcgcttctcttatgatccctagtgttcttcttgaaaattacagctgactcatatcattcg

SEQ ID NO: 863 - DNA, 7485 bp, Oryza sativa
cccatttgcacgaatcagaattaaagaatcatcggcaacagcaggtgagagatgcttggtgctcctgggcaaattttaaccctgccaattcttccttcattctctgccttcagtaatacagcagaaagccttcagcacagagcaacaaatatggtgataatggatcaccttgcctcaatccaaatggttctcctcgtatacagtaaacaaccaagtccagctatatttccatgataaaaacatcaggataccaattagcaaacaacatttaccacatatttagcagtagttgacaaatacctagcactgattccccgccaaaaaaaaaaaaaaaaaaaaaaaaaaaaaaaaaaaaaacctagcactgatgttcgaagaaggatagcatagtatatgggaattaaaaattcactacttctgcataagagcaaagacccgaaacaaaaaatactaaggatcgatttatggaggcaattatatcaacagcctggacaggtactgcatgtaattggaagtgcaattcataaccattacataatcgatttatgagagaaattcaagcccaactgattgaggtgcagagcaaaatgtttgctaaagaattgacgctacatgtgaaagctgtaaaatacaaacatggagaatttttttttcccattttagataaacatggagaagacttatgtaggcagggatgaactgtacaaaatggttgaaacaaacaaacgaaacgtcaaaattgaataataagttcctgcatgggcaatcagaaaaatgaaattacaatgctggtactagtcagataatgtatgcctaatatcaagtccaagtgttgagttcagttacttcttgctatctcaaagcaaataacaaattaagaatgatcagttaatcattctgttgtcatacctttttcacgtgtacactctataccaggttcccataacaaactttgcaccaaatttgttggggctcataatctgacaaatgagaaagaacgaattgtgaaggaagtattaccaggacatgcttcaatacatatatggcaatgaaagttgggaaagaacgaattgttgcagtcctctagtcaataccaaatgtttgtattccagtatgtacaacatgtcaactacatgttcttgtttcagatttgtttctttcctacaaaagaaccagctagccataccagaaggttttaaaaagacatgggagacatttcccataaatcaaatttgcatgtcttatctgaatgaaattaacgtttgctgtatgctatactaaccaaacattgctatggtcagcttcagctaaaattattggcagttattcttcagcatccatgtttcagcttttaagcctctttgcgacagtgctatttcctccagcatatttatgtactctgagaaaattaaaaaaggacagtcatttttacaaacaaaaatcgaggaaaatcatttgacttaaggatcagaaattattgcttacatgaatccctgagcaacataaaagactcttcaaaatgctggattcttcatctacctaatcagaactatgctgctatggtctattatttccgtttccatgcctggacaaattcagttcagtctcaggctctcagcggttgtctgcaactctgcacatacctgatcttgctgctttgcaaccttggtaatcacatcttcagacaatcggctgaaaatattggatgttccagccaaatctttactgtcatagacttgcagcgtgaaaaattcatcatgtctctagctttaaaagatctcctcaggtgtagcttgctgaattctctgtgcacttcgcaagcctaacccgcagagaatttaatctgttaagtatggtaatatgataattcagatacaaacgcacattttacagaaaaaaatactattaaaaatagaattatatataagccaaaattcggtgattaaatgacaaggcattacttatactatgctaaccatagtatctgcagagtacgatacaaaattattcatgtgccaagtcatctctgacaggtatctagtggaaacttggaaatgcagtcggttagaagttttgcgtcttaaggccaaattgctagcagtaagggcatatcaaaacagcaatgtatctcctctcctctcctaccctatctttaatgttttaagactttatttaagcttctcttggcttaagacaaggaattgaaaaacgattcaacagaaaaaagaatttcattcaaattcaccttatttaagcttctcttggcataagacaaggaattaaaaaaaagctaagcactagtgtctagcgctgcctccaccagaggcccgactgcatgtatatgccgtatttgacaacttaccgttgccgtattggaggggatcttttcactgctccttttctttttttttttacagccattattataaccggaaggggatacacgcccagccgatgcccacatttgggatcttttcgctgtattcggtcggggtgggtgcccttggggaggcgatggagtagagtcgaaccgaccttataaagaggtcgcgcttgatcagaatcggcgatgtgggataaaacgagttactgggatcgatcggcgccgaagcgcagcgcacggaccgagctaggagtagaggcaggcgggcatacctggccccatcggaaaccggcggcgagggcgccgtcgatctggccggagctgaagtttcccgctgccgtcgccgagactacgcccgccggatcgagagccggctgctcgccattggacgtcgggaagcggcgccctcgacggaggtcgggaggggatcgatgaagtatgaggtccagttcgcatctgggctgctttttttttttcaaaacaacggttcatggttattcatttatgcttttctttttctgtttgacttgtgatctgttaagagtgcacatcgctccttccattaaaaaaaactatttgtgacttgtaatcggaggatgtgtcatatttagaattaaattttaaaaaactgttcattgaaatttttttagaatatttgagatgcacaattttttacgaaaatatactgtcgatctcgtacaaccgttgtgcgaaaatgatgtgagcgtgacgtcgcggatggtcacaaagtaaaagtgtgagaccgtgcggtcttatggaacgaaagtgaaccaaacagcgataccggtgtcatgccgatttaattagtaattaattatcctgattagtcaattaactaattattaattagtcgctaattaggataattaatcacttttattattagttaatagttaattaggtagttaatcactaatcaaatggagccgttagacggtgtcgctgattggttcagcgagactgttccgttccgcgagaccgcgcaataccgtccgcgacgtcacatctatgtcattttcgcgtaatggttgtgcgagatcgacggtatatttctaaaaaaaaacttggatgaacagtatattttcaaatttaattcgtcgtatttgtactaggtttttttacatgatggagaggttatgttgtatggagtaatggaataatgctacattcatcttgaaatataaattataaatatattttaactctaaatttagacaagcgctcatcaagattcgaagttagagatattttagtggtatggatatcaccactagcattgttttcaaatgtgttaggcaacttcggcttagttcttttttaaacattagcccataatttttctctcaaaccttgctatacatatgatttttgcctcatccaaatagttttgatcatgagttgacttgtactaatatattgacgtgtaattcttttgtgtgtttgtgaaaaagagttgacttataattttctttgggctgcattccaacctatgtttggaataaactgatatgttccacacgaaacaaggtaggaggttattagtgaataattaattagatattaacaattataaaattgaaaatgagtatatttcattttttaaaataaacttatatgtaaaaaggttttgcaaacacacaccatttaataatttggaaaacgtgatcacgataaatgatagaattgcaaaagctaaacgaactttcgaactgagcctatattgcccttatttcatacttatatgctagcctatttgggaaaacaaaattctcaatgcgaaaaaaaaacactcatttgcatgatagaattatttgatcacaaatttgacaactgaaatttaaatttttaaataaatttcagaccaaaattgatggaatgcagacaatattgccaccaaaagatcaccaattgatggcgatctgcgaggccgtgcgggtcacggagcgcgtctgtgggaggagaggcgggcctcacgggtgcggcgggtggtgaacagctcggaggcgctcgtcatggcgggtgggggagggtgtgcacacgtggcgcggtggcgatggtgcgagactgcgagctcctgtctcctaccggatgcagcgatggcgagggcacagccacgcaagcctcagcgcgcagatgtcgtccacagtgggggtacggcgcacagatggcgtcccggccaccctccctctcctcctcgtccttggcctcttcgttccttttgtcgaatctgggagacggtggcggcggggactggggctcgagggagatgatggcagatccaggaggatgacgataacgacggtggcatggtaattgagttcagcctgatccccgctaatgtgtttgattcattacctcgtgatgtgatattgctgctaatccatggggattaattaggtttcttgggatcaaattcgtgagctctagattaaatttggtctttttcgtgctgtttttggttgtctcgttgattaattgatttggggattggatagcagatcagattagaaatcggattcggtgggaaaaatagcgccggataaatcgaataacgcggtggtgacggacgaaacaacgctggtgaaaagatgtgacgattggaaaaatatcaatcttttaattacttaagattaagacttaagatattattcacttatctgtatgcctgctagataatattctcaaagtgaaactaattagatgagccaattatgcgaggtctgcaagagctgttgattagatgtttttttgagtaataaataaaagcgaatctgaatagtgcttacagatatttgcattagtactttgattagctgaccgcaatttgcatatgatttcaaataaattgaactttgttttatatgacatgtaacatgatggtgcaaagttgctgaagagcacctagcgaagttatgcactgcgatttgtttaagttgttatgttgttttagttttttcatagttggagcatcacttaagaaaccttctgccatcagttttgtgaacacctttgatatttatatttacatgtttgtcagtttgacattctaattgtaaatacatatttgtctattctgccttctagcttaatagaaattcctcttgattaatttttttatctaacacaaaatatttcacgcagctgagcattttgggctgcccacggttaactttggatggccttatttccaatctcaagtcatttaatacgaatgcggtgtttggaattaagcacctcagagttggaacactcttcagtttacggaaggagcagtacgaagagttattatccttgttgaataccgacaagacacaggaggtgcataatcgggggccaaagattccttcatgctaatcagtttttatcagattgcaatgatggatagatatgctcctgatattgagatgtgccctatttgtcagaactacaaacttgtttatgattgccgagatgaaggatgtgatgatagaggccgagtttagttccaaattttttcttcaaactttcaacttttctatcacatcaaaactttcctacacacacaaacttccaacttttccgttacatcgttccattttcaaccaaacttctaattttagcgtgaactaaacacacccaaaagatcaggtaatttcaagggttgtgctgtttgcatactgagatgttatgagtgtggaaggtgtgtagacaagttggcattcaaggagtcattttctttggactgggtttgccctaattgtcaagagaagaaggatctgtctcccccaatgaaataggggtttgtcccccaacgaacactcttcctctgctaacagagaacagcgtgcaatgctgtcatgcaagccatcttaacgtatcatttctactgagaaaacagacaaaaaaaacgatgagtttgttattcttgaaggcgcagccatcctgacatgctgcattagcttcttgcaagaaaaagaacaaaaaaagagtagttagtttgattcagcaaaaaaaaaagaaaaaaaaaagattgtttcgctactatcgtctaactggtgacatttcagaggtgagtttttcctgattgctttgatgttatacatcccattgaatttagtcttatgtgagagatcatttcctatctttggtttggggttgcttccaaggattgctgttcaagagcggaagcacaacgtgaactttacgtcagtattgcagcagcagctgatattcttggaatgttaagatcgaagatgaactgctctcctcctctcacggtctcaccagagcaaatagaggattgctgtaatttaccttatacatgcgtgccgcaatgttgatgttgtgtaattctgaaaacatttgtcacactaccatgtaatttacaactacttgcagagaaataaatgacttctaaccaaacttttgctttcatgtcaatttgtcaagtatggtgaatggccgtcctcgttggtaacatgatgggaatatcctggaagcaaacaacacctgtcggagtgaatttctgctgtttcgcgtagtagagaatgaaaaagagaaggccaactcaacaattacatttggcaaatgaaaagaaaagaaaaaccaaagttcagtttgagatcgtcacgttgagttaggctatagcacataggggaaaaaagcaaattatatttgtgcctctgtttggctaatctgcaagtctgcttgattcattgccacctgtttcaaggatgaaaatctgagaaaacatgtggaactacgacaagacgtatcatggaacattttatacgctccaaaaccgcagtaaaaacaccaacgatttgagaactagtcacgcaattaaatgtttttgattgaaagaataaataatcagaatacagtgtgcagccattggcagagctaatcatgggaagaattctacatgaccgccaatatccttgcacaacaacttggcttcagaagcaagcttcctgcttctaaaaatcaccaggtttgtcaaccggtgcttgggctgtggttcaaaggatctagctttggccttcttaccaagcagcaccagctcccgggccggcattacatttccccaccagaaatcacgc

SEQ ID NO: 864 - DNA, 1291 bp, Oryza sativa
tcgccgcatcctccaacttgatttctgttgatccaaatactttctcgctccacagctctgaccgtctgttgccagcccagaagcccaaggcagtgctgaaggtgcttgtggtgagcttgtccttgcggagagcaaaccattcctctgatcgctgagcaacatccgaagagttcagctgggaggacaccacgagagctgaagatggtgagagagatagcagggatgactggctatagatctgcaatgatgaacctgagcagctctgaggaatatagccttcaaaatttcgtcttgatggcaagaatgcaggtgaggtcaaccgcacacgaactgtcgagcgaaaggctgttggaattggcaggagtgtcctgaacaaatatgaaactgcgcaatggttaaacatcatgctaaatgatggtgcagtctgcataaatatagcatagctgagaaagcatacaggaagtgctcaacaagaatggttaacctctgaatgtggcatacatgaaaagctatacttatttttatatgatgaacatgcttggctttttgcaagaataatgcaagcaagtagcaagggtttattccttgattgattttaggaagcaggcttgcttggggcaagtaaaagtctgggctaaaactaagaaagagatcccagcttctcaagcaatggagtatactacaatgaagcaaactccaggaagatgaaaaactgcaaatagctctaacctctcacgccggacaacaaagattccatttacagttcgatcaagggatatttgtctcctgcttattttatctatgtgttatcaaattatataggccgagcatacttcagtcagtatttaacatgaatccaagcctcatgtatactactaaaacaatctattcaggtgcagtcctgatgacgaggtgaagctaaatttaagtcacacccctgataaagctgaagaattgataagcgcagctatacacatgatatgaattagcagggtaatttgaacaattttctgaaggcaagcaagaatttcagaaaacgaaattacagctcattgagagtattgaaatcttataatccttcacattttcccttatctcttcatttatcttctttttctcccaaaatccctttggcatttggcacaaatactcaattaacatgtatgcgccccaaaatcaacgctaggagtgtccttgcccccaattgcaagattcagttaaccaaaatgtactatgcatcctaatggtcaatggagcatttggtttcattccatactttgttttgtagttg

SEQ ID NO: 865 - DNA, 21731 bp, Oryza sativa
tagaggtaacatgtacaatatatcacatctatactaattctaatacactagccccaatgtttgtttgtccaatctactcttccctctctctccttttgtcttgaattttgtgtagtggttgcgcctcttgcatgagaggtggctgcttatctctctcatctcttctctcctccacctcactattttagctcatgtggtatctaggagattgtgcttggatgcccatagtacttgcccttagaagagagagaatgagccacccctcatgcaaggggcaaactctacacaatctctaagaaaaatgcaagatgatgtgagagtgaactaatattaggatttgtatgttagatgtgatatgttgtatgtgttacctcttaattaatgagaagatgatatggtctaaattagatgtgacatccacctccactataaaacttgccctaagccagctataaacatattttaaagagataaagaaagagggagaagtgcagcgggctacagatctgtagccagctgcagcacgagctctaagacacaatgtgtgtatgacaggtgggaccaggtattaatagtatagcaagcaactattgtatgaattggctattatattggctatagatgatttggagctagtagtggactatactattaaacttgctctaagccaaattctagggtagttccgacttcttagcctacctggacaaccctttagaccgactacattgacaagttgagggaactttggtgtgcttttttcttattcttatgtctttttttttctgtttgacttgtgattcagagtgcacgaagatgggggtactccttctgttccatataaaaaaaactaatatgttttgtgacttatgtggctcgtactattaggatgtgacatattcataataggtttgttttttagggacagagaggatatgttatggaataatgggataatgattacatcatcttgaaatataaaatataaagattcttactctaaatttagacaaactatcatcaagattcgaagttagaaatattttagtggtctggatatcaccgaatgcattgttttcaaacgtgttaggcaacttcggcttagttcttttttgcaaacattagcccataaattttccctcaaacctttctatacatatgaattttgcctcatccaaatagttttgagtcgtgagttcacttgtaattttccttcaaaatgattatggctgcttccaacctatgtttgcggtaaactgatatattccacgcaaaacaagacaggaggttagtgaatgattaattaagtattgacaattataaaatttaaaaatgagtatatttgattttttttaaataaacttacaagtaaaaaagattttgcaaaacacgcaccgtttaacaatttggaaaacgtgatcacgacaaatgatagagttgcaaaagctaaacgagctttcaaacagagcctatattgcccttatctcatacttgtatgctagcctatttgggaaaacaaaattctcaatgtgaaaaaaagactcatttgtaaaataaataaagatggtagaattatttgatcacaaatttgacaactgaaatttaaatctttaaataaatttcagaccaaaattgatggaatgcggacaatattaccaccaaaatttaaacccaaacaaaaaaatcatggtttttaatttcttggtgaaactcctgtatgtgtttaatcaaattcttcaaatttggctaaaagtttcaattttcaaacttggcatcaaataatttcgttccctttgattttattttaaagcaaaaccatattaagatttatattttcaaataagttgcctttaaggatgagagaagggcattttagagaaatctaactatcaactcacggacaaataggtatataagaaaacaaaataaaacttacgggtatataatggatgacgcaaaattcaagagcataaaaaaattgagaaaaagaaactcatgtgcatatagggatttttcccttctttttgagattatttattgggttatcgaaacggatatttgtccgacacattgaaaaatacattttttgcaaaaaaaaaaaaaaaaactttcttctactattaattcgttagggaaatttgttagattgagtcttatttaagttgtaattcgttcaataagatcaacaaggagaaatgaatctgatcaacaaggaaaaaactttcttcttcccaccggtgtgcccaccccctctgtgcatttctttctttctatctgtcgtctctgtgcctcgccggccgtggggactacggcctcgcccgcctgcgtgacactgtctcaaagcaaagaaaaaccaagcataataaaattttgccctaaatttgctggggctagtaatctgacaaataaggacagaacaaatcgtcaagtattacaaccgtttttttgacaaattggtccttgcaaaaaacttattttgaaactagtccctactaaaatctatatctagaaataggccgtcggctcagcgccagcgccaacgggactggcgctgacatcgcgccagcgtggcgggcgaggcgcgacgtggcagggcctcagcgccaatgcacttgacactgacaccttgcacaccctaaatagaccgatgtgctgcaatgagttaacaatgtcgctcgtggtgcaacggtaattttctttcttgctgtaccttaggactagggttcgaatcccaggtcagccatttttgtttttttttttaatcatcaatcaacgtgcgtacatattagtgatgatctccattttcgtttttgtcttcaaatcttcaatgtacttttttttgtttaaattaatttttattaaaaagaaatatcacatttagtacaaatttaaaaagtagaagaatggattaaaaaagtttagagacaacttttaaaagaaatatcacttttttataaaaaagaaattagaagaatggatttaaaaaaacttgagtttttttttaaaaaaaataaacaacaagttgagaactaagggtaagttttattctaaaatgtcacgtgttttaataaaattaaaacaacacttgaacttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatttatatttatatatatttaaaaaacagagagcatcattaatcatttatatgtactaatgtacgcacgtagattgaagatttgaagaaaaaaaaaagaacgaacaaggctgcccgtgatagggagtcgaaccatggtgctagggtacacaagcaaatgatcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcaacgccagtcccattggcgctgatacgaacaacctcagtgccaaagaggttggcgctgagccgacggcctatttctagatatagtttttggtatggactagtttcgaaataagttttctataaggaccaatttgtcaaaaaaaggggtattacaaggtcatatgcttcatgccttcattcacatacagcactgcaagctggtaaaaggaacgaattgtcgtggttctgccagttcattaagcattccagtgataaattcgagtcaaccacataaatccataagaaatgccttccactgaaaaatgtttgttttcctgtgtttacaaccagtcaaccaacatgctcttgtttgaaatttgtttcttttgtacaaaaagaatcagtaagccaaacccaaagactttaaaaagatactccctccgtttcaaaatatttgacgccgttgactttttagcatatgtttgaccattcgtcttattcaaaaaatttaagtaattattaattattttcctatcatttgattcattgttaaatatattttatgtagacatataattttacatattttataaaagttttttgaataagacgaacggtcaaatatgtgctaaaaagtcaacggtgtcaaatatttcgaaacggagggagtattatttaggggcatgtctcctctatcaaatttgcagcgcgttacacctagacaatactttgctccgatcagctacagctaaaatttgtggtagtcaggtttcagcacccatattgcatcatttgcacctccttgcaacgttgctgttggcttcagcaggttctcaaacagcagtatatccatggatagaatgtggttcttgttcttaaaaaaaagagttcttgacatgttcagctatgcccattgagcggaatgaaccaccatgcagttttatgaaggtgtagattggcagattaggacttcaggatgaacaagtatcttcctagtaggaggccttaaaacagttcagcagggaacagtgatttgcagacagagaatggtgctccaacagcaccacagcaccagctcgtccaatgatccaatccatgtagcaacagaaaaattgttactccatgataggcataaaccttaaaagcttcagcttctctttatgccgcctgtgaagcttctgcttcttctaggcgcagcttctgttaatcgttagcatgcattatgtccgcatgattgattgcactctgagaaaagtagaaaaaagggtattcttttcagaaacaaaaattgatccaaattatttgtgttagagatcataatttttttttcttacatgaatccctgagcacaaaaaagactcttcaaaatgttggatacttcgtccataccaggatgagctcagctcagtctcagaggttgtcggcgcagccaaagctgcacatagctgatcttattgcttcatttggaatcccggtattgacatcttcagacaattggctgaaaatatttgatgtttcagttcaatcattattgtcattgtcttgcagcgtgaacaaatccttcacatctctagctttaaaaaaaaaatcacctctgctaagagtatttcagtacttcgtttcacaggaaattcttgcatacctgctgatgataggctttctcctctatcgccacatctctaattttccccgtagtctgtaccacatataatttaagctggtaagtatggtattcaaatacaaatgcaaaggaaattggaattcaaacgcatagggggttcaaatgcaggcctccattgctgctgttgtaattaatcaacagaaaaataataatttgatcatacaaaatttcaaaaagcaaagcgctaatgtctagcgctgcctccacgggagacccgactgtatgtatgccgtatttgacatcttaacgtatttatatggatgcagcctaaccggcaggcgcctgccgtgccccgtaacgggaggggaccttatgactgctccatttttaatttttacagcagaaggtgtccgccaaaccgtggccacggtggggatcttaccgctgtatctagtcggtgtgggtgtctccggggaggcaacacaacagaatcaaccagagtttataaagaggtcgctctgtcgcaaaatcagcgaggtgggacaaaactaattgcgggatggattcagtgcgagccgaagcgcgtcgcgcagaccaagctaggagtagagacgaggcctacctgctctccacggaggcccggcggcaagggcgccgttgatctggccggagctgaagcttcgcgccgcaaggccgccgccgtcgccgatgccgcggagaccacggccgatggatgcgggtcctccaggagcagagatggcgcatccgcagctggctgcttgccgccggacgtcgggaagcgccgccatcggggaggagagggacggcaggacgggaagcgagatcgagccttccatataaggtgggccatgtggtaagattaccatgagtccagttcacgtcctccaggcccagttcacggctgggcagttttgcccccttttttttcttttttttttaatgttttccccaaggattgttgtttcttgtatgtgctcagattggtactggggttgtttggttagtactagtcattccgttccaaaataaatataccaatctagataagaatttgatataagctatgacaacgaatgcggacaggttatatcaaatcctattcaagattcgtttattttgtgattgataaagtatgctctatgtgtttcttttttttatgatcacatacactcgaccgtaattagttctaaatatgagcgcccatattaccgatgaatacgagcatttgtactaccactttgaacctaagtagacaagtattactgcaagaaacctacctacggtttgtttgttgtatcttcaaaattttaaaaatgcatcaatgaatttttaatgcgattatagagttaagcttaggaatctaattgatacaccctcgtctctacccctatacacaacctatttgtaccaccactgccacgagcttggggcgctaagatttggccaccctaacctcagccacgtgttgatgcaaaaaaacacatactggcctgggagatctatttagctccagtgtaggtccaaaggttatatgcggcgtgccagtcagtttgatcctacaattgacaagacatgtaaacaacatatcaaatagctgattggctgacaagccggtggagtaattccagtcgatagccgatgtcaatggggttttgagtaatcggctatatatcatatgtagataatgatgtaaagacaatcggctgatgataataaaatataaaaataatataatccaatagaaaccaatcggctaataataatatgagagtgtaagtacttatccgaaggttaaagcatacatcggctggaggtctgatgtcataaaatctaaacgattagataaacatccagataattcattggctgaaaccccgatgaaacccttattggcaatcaggaagcaggctagagattatggttctaaacacgacttagtatatcaaacttaacctatgcaacactaagtttgtaaagaaacacaatatctagactatcaagcccttagactgatttctcagggtggtagatgtctaagctaatttaatctagcaaggcgatttagtcgataccggtagaaaccctaaagcgagaaacaaccgatagagctaaatcaagatgctaatactagattaacagatataaatgataaattggtaggcaaatatatcattcaaaccagagcaatccaagaggtcgaatgtactgatgcagccatgaacgacgccaacgtagacgatacaattgcctggggcggcggaaaattggatttagcccttccccggagatcgaaaaccggtgcagccccgcgtcaggtgccaaattccgcagtgataaataaaaagtggaaaaggtaaaaggtggcgatgcgccaaattgtattgatcgtggagatagtttacaatgaccccgggtgtccatatttatacccatgggtagatactagtatttgtaggacaagaaagaaacttttgtaaagataaaaggaaactagcaaaatattcataattaatactccctccatctacttttaatagtcatatttcatcatagcacacaaactaaggataagtgattctacttatcatccatttaaacatgctactagtcattcctcgtaaacaagcgattcattaatatttacatttctcgatgcccatgtagccaatcctgtgtggaagaaggagagtcacgcattaaatccgagaaagtcattaagatgataggttgttggattgaaatatgtctatcaaaaataaatttttcagatttggaaatatgcctatcaaaagtagatagagggagtagataacttgccacgccgcatcctgattaatttccttaactgaatatagcatgaatccggctattgacaacgtgataattctcttagggacttaccaaatttcactgttataaaccaatgtaggtaagaatctgataaaagctatgacaacgaatgtggatagctatgataaccccctcccattcccccacacccccacctcagcgagttcaccggcggtgaactccgccgcctccggcgtccccccactccgccacctctgcaacgaactctccctgtcagcggcctctcccctctcctcgtcggcagcctctcccctctccctatcggcgcctctccacttctggcggtgcggagctcgatgctgggcggagcggcgatggcgacgacatcctctcccctctccccttccgcggccacgagctccggatctagcctagcgttgggcggcgagggcggaggtcgatcttggcggcgcaaatcgggtcgacgagctccccaacagcagcgtagagtgagaggctgcagccgcctggctcgaggcggcgagggtggagatggatctcagcggcgcaaatcgagtcgatgagttctccggcggtggcgcaaatcgagtccacaagctcccgacggtggcgcaaattgagtcgacgagctccccgatgatgttgcggagtgggaggttgcagccgccgtcgagctcatccgacggtcattgaggcctccgccatcgagctcatgtgtagtggctgtatgtggcgagggagtggcatggagaacggcttttacagctttacatgtgcccttttcatctttttcaggcgaggaactcgcctcttcgttgaggaatgaaaagctctgcgaaggtgtgagagcccacaccctctctccacggcatcacgaagtctacatggtggaacgaaggaacgctccagtgtggatgcctgagccaatgcaaaatactgtagttcctctgcattttactcttcaacgcagaggatctaaagtatttcagtaatactataatcttttttttcttctattggactcttcttaaattctacttttcaccgtaaactcaaaattggtaattttcacttcaaatttatattttttccattttgcatttgtggaatgaaatgctcactactacatgataatcagctcttgcttcgtttacagctgcagcaaacaatgattaatcggtgtcgtgaacatttaaagaaaaatcttcaaatcggggagaaaaaatgatcaaaagaaaaaaggaacagaactccagccgagggcgtctctacagacacaccatacttggtaataggacaggtgaaaatcacacgtggagctgcatcaagcaaatttttcattttactacggaacatcaagcaaaggaaaaacaactttcagaacatattttcccattaatttcaaagcaaaaagaaaaagggttatacaaactctgctgcagtctgggttctaatctgaactcgcaagaaaacagaggatatataaattggatttctgagaaaatatgcactgcatgtacaaatactgtttgccgtgactaacggtgttcgtatttgaaaagtattgattgctcacattgacaactgagacatcatcagcttgacagggcaaatacctgtagtttgctccacgcggtaacaaacgagcatgtaaaagcaaataagattattttttgtttcttcagccagccaaagttcctagcagctcattctccacatgctgacatgcaatggtgaggtgacatgcatctgtaaccatggccctctcaacttgtaacttgcacttcaaatggcacccccgcatatgtaaatgacctagttcacctatatttccatgagaaacatcaggatagcaaacctgtgtcacaatccagatgatgctgaggattgtcagcaacagcgcaacaaaatttgagcaatggttagggaactaaatatgagctgccatagatttgaaaagataagatagattcatacatttttaagcagttccgtgttcaagacaatctgctccagttagctatatatctctggtttcactatagctggagcctggccttcaataatgcactacaatttcacattttcacttgacttcagcaatagaaaccttactgcttggggtgtagtgtagcacatcgcagttacgccaatatttactccaactgccatggtctttgactacagagagatcaataaagtgctttttaatattaaaacaatttttgaaaaaaataattattatgtgagccaatcaaattatcatgttgtatttgtcaagtgtggaatgatgacgtgtttatgttttaaatgggtgcaaacatgtgacatttcttaatcttcattgctacaattcgccctaactagtaatatagtgtcgccatacatagcacactcaaagagcaacagttttgaaaaattattgttataaattgtgaaactgcctatttgattgttctatttcctctgtgcttggattggttaggatgtcattttctgatacattgccatcattcggttcaatttttcacccccagaccttcctgcacaactcattgcatgacttgtccaatgtgttatttgtcaccctggaaaattgaggacttacttgtactgacatgttgcttccataccgttacggtacggctacgcccagaaaaaaaaatcaagattactttcactttacatcagtagttgactaacttgatactttccctttcccaagtccaggtccaggtcaacgttcttgtgagttgtgattatccctgacgtggtgttttaattcatgtgcacataataggtggtttttgtgtcatgaatttatttccttacatgagaaccaaacagttcattttgcagagcccaaaggaagaacctcctctggccaaacaatgtccccttatattatccctctgtgcctgattctcttcatcatcaaagctagtcattccatgggagctcagatcaatgagacaaccattcctcaaggttctgaaatcaacacagctggcccccaaagttgggtctccccctcagggcgctttgcgtttggcttctatcccgaaggggagggattctccattggtgtgtggcttgtcactgatccatccaggttcatcttgtggacagccttcagaaatgatcccccggtttctggtggttcaattctgttaaccgctggtggttcacttcaatggattccacctaatcaaggattccaagggaaggtaatatctgccgcccctacttcggctacttctgctgctatcttggacaccggcaactttgtgttatatgacgccaaaaatcaggtcatatggtctacctttggtactccgacggacaccctgttaccagggcagaacttgcctcctggcaatcagctgttctcaagtgtctctaacaccaaccatgccacaggaaagtatcgcctttccaaccagccagatggcaaccttgtgatgtatccgataggcgcgatagatcctgatagtgcatactggaatactggtacttatgcacaaaactttcttctcactcttacactggatcccaacggcaccctatggctgttcgaccgaaatagtccatatagaatggtgttgtttctgactaatcagtcattgagtgcctccccagattcagagagttactaccatctgacattggatgctgatggcatactgcgactctactcgcatgtgtttttcaagcaaggaggagcgcccaaaacaaaggtcgaatggttggtgccaccgagcaatgatcgctgcagtgtgaaaggtgtttgtggtccaaatagcttctgccaagtaactagtagtggagaaaccagctgttcctgccttgcagggtttgaattcttaagtgctaaccaaagcactcaaggttgctggagggcacagactggtggttgcaccgggaatagccctaatggtgacatcggactggtagccacaatggtcacggtgaagaacactagttggtcagataggtcatacaacgtcccacctcaatcaccaaccattgaagagtgtaaagcaatttgcatgtctgactgcgcctgcgagattgccatgtttgactcctactgctcaaaacagatgcttcctataaggtatggcaagagggttcctggtagcaacaccacgctatttgtgaaggtctactcctatgaaccaaaaaggactgcaagtgcaacttcaattgccatgttgacatctggcgctgccctcggcatgctctcacttgtactgctctcggtgtctgtaatgctatgcaagcgccggccatttttgaggtacacacgtgctccacaacatcatgaaactgaatttgatgaggagagcattggaatccgaccatactctttccatgatctagagctgtcaacagatggctttgctgaagagctaggaaggggtgcatatggcacagtgttcaaaggtgttctaacaaatagtgggaacaagggcattgcagtgaagaggcttgagaggatggcagaagatggggagcgagagttccaacgggaagtgcgtgcgatcgcacgaacacaccataggaacctggtgcgtttgttcgggttctgcaacgaaggtgcgcatcgccttcttgtctatgagtacatgccaaatggctcccttgccaatcttctcttcaagcgcgatgcaacactacctaactggagcaacagaattgcgattgcgctggatgtggctagggggttacaatacctgcatgaggagatagaggtgcctataattcactgcgacatcaagccagagaacatactgattgacagctcaggaatggcaaagatcgcagattttggcctggcaaagctgctgatagggaaccaaaccaagaccttcaccggtgtccggggcacgcgtggctatctcgcaccagagtggagcaagaacacagcgatcactgtgaaggtagacatctacagctttggcgtgatgcttctggagatcataagctgcaggaagagcatggcacttaagttggccggcgaggagtgcaacatctctgagtgggcctacgagtacatgttctcaggtgaaatgaaagaagtggcagccggcaaaggtgtcgacgaggttgagctggagcggatggtgaagatcggcatttggtgcactcaaaatgagccagtgacacggcctgtgatgaagagtgtcgttcagatgatggaaggaagtgtgaaagttcagcgtcctccaccaccagcatcattttcacagtcactacgctgaaatcatccagagtatttcatgtcctatactcctattgtcttaagtcagaaggcaaaggatgacaaatcatctagagtatgatcgaaattgtgcgtcttacggcaaaactgctagcagtaagggcatatcaaaacatcaatgtatctcctctgctacctatcttaatgtctagttgggtgtttattgtaagattctttcaagaaattaaacttctctcggctaaatacactgtttttggagtattatatatggagtaatcgaactatgcatccaaaggatggaatggtcaaattgcaattggttcgattaacccatgagtagcaatgagttcaacagaaaaaaaaatggacaaattgcaattggttggattaacccattagtagcaatgagttcaacagagaaaaaaatctaatgttacaaatttcaaaaagccaagcgctggtgtctagcgctgcctccaccgagagacccgactgtgtgcctctatagggcctcttttcggcagggggtcgcctgccgtggggatcttttcactgctccattttttttttttttgcagctggccggcagggggtcgcctgccgtggggatcttttttttttttttgcagctgaaatggtagggcggatacacgccctaccgctgcccattgcagtcggggtgggtgtccctggggtggcgatggagtagaatcaaatcgagctaataaacaggtcgtgttgtctcagaatgggcgatatggtacaaaactcataaccggatggattcagtcggagccaaagaacagcgcgcagagcgacctagggctaggagtagaggtgcgtggcatacctgctctccactccacgtcgagggcgccgtcgatctggccgtgctggtgaagtttcccgccgcccggccgtcgccgtcgccgtcgccgtcgccgctgacggccggatccagattctccggcagcatcaccagctggctgctcgccgccggtcttggggaagcggcggcgttgggggagagtgggagaggtcgggagcgagcgagaagccgagaaggcatatgcaggatgctgggccatgacctaaggacgatgagtccatccttctgacgacgcacgtggggctcgagccgaagctttcccaggcccagtttgctactaggctgatttatcttgttttgttttttttttagtttcattcgcgtccttcaaccacaaagaggtatatagcatccgtcaactgtcaaaatcggaacgagtatcatagttgtttaaatgacggtttcgactgatttgatgcctacctaaaatactcttatggacatataagtttaatagttgatttatatcattagaagtttcaaaaaaatataaaaacttttatgtggccaccttacacagtataaaagtttaagttttaattttttttcatttctactttttaaaaatataacttgttttttatatgatatataaaatattttttgtgttgttgtttttaatataaattatctttcatatgcaacataagatattatcttttgtgtaagctatttctatctgatataccatacaaaaatatttttttaaaaaaaaatatataaaaaatgaaacttatgtacatacttatctgttgtgtaaggaggccatataaaaaatttcatattttctgaaactttctaatgagatagagtagattctctcaactttatatacatatataaaaagtttatatgtatgtatgtaagtatatacatatgtacatataatatatattatgtatatacttttgatgtataaaaatacatatacatgtatacaaagtttgcatctaatttaaactttcaaatctttcaactcgaaaattttaaaaaattaattatgtatagattttaaaactttagattctaactttttaactttcaaattcaagttgaaaacttccaactcaccaattgattttattccttgttaaggacgtaggattgcaacgtcgatgcgacactaaacatgtcgtaggtgcgtctccttttgctacctacagtggcggagctagcgtgggggcggagggggcttgagcctcctctaccccgctggactccatagagttgtgagggaggagaagggggaaaagaggtagaggaagaagaaaatggggggagaggggggctggagggcgctcgatctccactttttttttctttttcttcggtttttctcttcatcatttctctttatttctttctcccattcttcctttctctttatttttttctcccattctttactctttttctagaaaaattaaaaataatttggtgaattgaagactagaacccatgatctcatggtttacaacaaactctctcaataaattcaccctatgaccctgtgtgatttgagatcagtgtttgttttctttgtatatctgttcaaattttgtgaacacaaacccactatgttactatatgaatcataccttgttcggtagtaacaatcgcatatgtgcagtaacacgacacgttactgcgagatttattaatagtttgaaacattaagtattaatagtttgaaacttatatttttctttaattggaatataatcatgtgatatcttgttataacgatttaattccaacaaatacaatggtggtggtggcggcaatggtcgccaaaacaactccggcggcagcggttacggaaattcgggtggcaacttctaccaacagcagcaggccggtcttcgtcctgccggcccgtggttctgcttcaatccatgggctgcgcaggcctctacatggcgccctcccagcaatcccggcaacagtgctggcctccttggcccgtatcctcaagctcacacagcttttgccggttcctatgtgtctccaccaactccaggatggcctccaatgccgcaagtccagcccaactgggaccaagctggtcttgttgctgctcttaatcaactatctgtgaacagtccaagtccatgggtgcttgacacaggagctacttcgcatatgtcctcgaccgacggtattctcgttacacgcctccctaactctcatacctttattaccattggtaatggtcatactattccggttatatgtcgtggtacttcttttctacctataggaactactaggtttgctcttaaaaacatccttgtcgctccctccttggttcgaaacttactttctgttcgtcaatttacccgcgacaacaaatgctcaattgaatttgacgagtttggtttctttgtgaaggaccttcaaacccagcgcgtgattcttcgttgcaatagtcgtggggacctctacactctacctactgccgtccctgccatcaccgcccacagcttcctcgccgagtcatccactttatggcatcgtcgccttggtcaccccagtccagccgcagtacaaactcttcataaattagctattctttcttgtactaggtctaataataagctttgtcatgcgtgtcagttaggaaaacacacgcgtcttcctttttctaggtctttgtctagtacttcttccccttttgagcttgttcattgcgatgtatggacctctccagttttgagtttgtctggttttaaatactatctagtggtgcttgatgatttcactcacttttgttggacttttcctcttcgtcataagtccgatgttcaccagcatctcgtcgagtttgttgcctatgtcaagacccagttcagcctacccattaaatgctttcaggccgataacggtaccgagtttgttaatcatgccacctcttctttttttgctagccgcggtatcgttcttcgcttgtcctgtcatacacttctccccaaaatggcaaagccgagcgtgttcttcgcacaatcaacaactccatccgcaccctacttatacaagcttccatgcctccttcctattgggccgaggctctagctactgccacatacctactcaaccggagaccttccacctctgttcgcaattctatcccataccagctcttgcataacaagcttcctgactattccaaccttcgagtctttggttgcctttgttatcccaatcttagtgccacgacacctcacaagctctcccctcgttcagcaccttgtgtctttcttggctacccggcttctcacaaggggtttcgatgcttggacatctctactcgtcgtctctatatttcccgccatgtggtttttgatgataagacgtttccctttgcggctattccccaggatgcctcgtcttttgattttcttttacagggtttctccaccgcggtagctccctcctctgaggttgagcgtccgcgattttcctcggtgactccctcccatgaggttgagcaaccgattcccgacgatgacacctcaggcaccgaacttttccagcttctgcctggacttcggtcttctgctgccggccgtcctcttgtcggcttgcctgttaacgctcgacttccgggcgggtgtgctaatggtgccgctaatggctcttcttcaagcaatccttctccggttatggatcctcctgctgcttctgtcgttcgaccagctccatctgagggaccaaatacatcgctgatttctccttatcggcacacctacgtgcgccgatcacagccggcacctgcagctattcatggcccgattcgctcctctcgagcgttccgtagtgctacagatcaacagcagcagacaggtcacaccatggtgactcgttctcagaccggccatctccgacctatccagcgtttcacttatacagccactcatgatgctgtttcgccggttccttccaactatcgcagtgccctggccgatccaaattggcgtgctgctatggctgacgagtacaaggctcttattgataataacacctggcgattggtacctcgtcctcctggtgccaatgtggttacaggaaaatggattttcaaacataagtttcattctgatggaactcttgctcgtcacaaggcacggtaggttgttcgcggctattctcaacagcatgggattgactatgatgagactttcagtccggttgttaagcctgctacgattcgtgttgttctcagtattgcagcatctcgttcttggcctatacatcagctggatgtcaagaatgcttctccatggcaacctcgaggagactgtgtattgtcaacaaccatctggatttgtagatccctctgcacctaatgctgtttgtttgctccagaagtcgctatatggattgaagcaggctcctcgtgcatggtaccagcggtttgcgacatatattcgtcagttgggtttcacatcctcagcttcggacacttctctctttgtttacaaagatggagacaatatcgcatatttgctgctgtatgttgatgacatcattctcacagcttcgtctgctactctacttcatcatattactgctcgtcttcactcggaatttgccatgacagatcttggtgacttacattttttcctgggtatttctgtcacacgatcttctgatggtttattcctttctcagcgacagtatgcagttgatttattgaagcgagctggtatgtctgaatgtcattctactgcgacaccaattgatgctcggtctaaattgtctgctacagatggtgctcctgtttctgatcctacagaatataggagtcttgctggtgctcttcagtatcttactctgactcgccctgagctcacttatgctgttcaacaggtgtgtctattcatgcacgatcctcgtgagcctcatcttgctcttatcaaaaggattttgcgttatattaagggcacacttcacattggtcttcaccttagaactacaccagttaactctctgacagcttactctgatgctgattgggctggatgtcctgattctcgtcgctccacatcaggatattgtgttttcctcggcgacaacttggtctcatggtcatctaagcgtcaaactacagtttcgcgttctagtgctgaggctgaataccgagctgtagcacatgccgttgctgagtgttgttggttacgacaacttctttccgaacttcatatttcgcttacttcggctaccgttgtttattgcgacaatgttagtgctgtctacatgactgcaaatccggttcatcatcgccgaacaaagcatattgaaattgatattcatttcgttcgagaaaaggttgctttgggacaggttcgtgttttacacgttccttcctctcatcagtttgctgatattatgaccaaaggcttaccagttcagttatttactgagtttcggtccagtctttgcgtccgtgataatcccgcttcgactgtgggtgggtattagaattagattagatttgtatagtctaagtatctctcgtatatgtatatatctcttatttaagagtttgttgtaatctctattgtatttggctatataaatataatcgccccccccacgttgggttgtgtggcgtctcataattttctacaggcaattctggatctagctaattagtaacattagagcaggtacaagtacaatagcaggctaagccagctttaagtatattttaaaaagataaatgaagagagaagagcagcgggctacaaatctgtagccagctgcagcacggactccaagacgtaacgagtgtatgacaggtgggaccagatattaatagtatagtaagtaattattgtatgaattaactattacattggctataaatgatttggagctagtagtaggctatactattaaacttgctcttaatgaaaagtccaaacactagcacaaataaaaaagtttacaattgtttcttaaacacaaccactctttaaaaaaagaaacaagttatgaagagcctcttatggtttgcatctttgttgcaggttgattactttgccaggatctttccaggagtggctcatggctttgcttgcagatataacggcagcaacccgtttgctgtcagaactgctgaacaatctcttgccttaatgcttgactggtttgagaaacacttgaaatgacaatagctaatcatgcatgcaatgcaaggccagtgcaattgtttatttccatcaaaatacattgccagtgtccatgtatatcctggtgttaagtgaaacttacataaataagcactagtgtaaagtgaaagtacgtgttgaatatggtgcgaagtgaaacaaagtgtactttatgaagtgcaaaatgcaaactccttttgttccgaagcgaccattagcatggcatattaaaacatcagtttgtaggagaacaaaaataatgtgtgcctctgttgccattttaacaagtcgatatgttcaatcaaatgttgtatgctactcatcttaagcacagcatatattgggtacctcttgactatttcttatggccacaaattagacagatgaaagtcgtgtttccaagaaattgctggcccttaactaggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatacctggtctcgccggaagccagtggcgaggttgctgtagatctggccagagctgtgttcacatgagcatatctccacctcatcctatatatgtgcgccgccacatccagtgccaccccttggttgggttccatcgaggaggtcaagggagattcatgttgccttaagcttttgacaagggtcgaggggcagctctttccagttcatgtaggtgcagaaaaactatcacaacttccgagcatccaaggttggcgtgtgaagcttctgtctctaggtgcagcttctggtcgtcgttggcattcatgattgatcgcactctgagaaaattaaaatatattttagaaacaaagtgttgaggaaaaccatttgccttagggataacaaattattgcttacatgaatccctgagcatcataaagacccttcaaaatgctggattcttcatgcacttgggcagagtatggtatattttaccctttgaattcctggatgaatttggtcctgtcccggaggttataactaatcttgttgctagtcattaagaagcttggtgttcaaatcttcagaaaactggctgaaaatattggattttaaatcaaacctttactgtcatagt

SEQ ID NO: 866 - DNA, 1008 bp, Oryza sativa
caacgcatggacgtggcgagtcacaatggaacatccactcaagtgattataacccatctccagattgtacatgcatgtctttctatagtgtagggtatgcgtgcctcacacgcagcgacggttactcgtagcaatcgagcgacagactactcgtatgggatgacgtctgggcaagggaggggagaaggggggtgggacggcacgcaccacatcgaaggcggtgtatgcggcagtgttgtggaaaatggccataccgattgactaatcggtcgtaacgttaaaaccaccaccgcgttaatgtgatacggtgtacatttattgttcacgaacgttaaaactcgtttttagcgattagttggtcgttttccgttaaatcacctgaataatcgtccgtatgttgtatttgatgatcatttagtgttgttttctttacttaatttagaattgtttttgttttgttacatatatttttatgttttacttatttaatgcaaccaattctaccaccatatgatatataaatccggtgttagaagagttaatgttttacttatctgtttaattaaaaaacaacatgaagatatttgatttatatagttaaacaaatataattcttcaaataagtatataatataataaaatttgtacatatattcgcgaacgtcaaatttccgtataatttcgattaatcggtgaacgataccctttttgtccgacaaccgtattccgtcttctacaacactggtatgcggcgaagccaagggcggaggccgtgccccacccgcagcgagaggccgctccatgtctagaggctgccggcccagctccctcatctcgatcgccctccttcgacccgcgcactggccgacgtactctcagacgccgccccggcgaccggcgggtggcgaaagttggtgggcggtttctggggaatttttttgagaattaatattatttttatggaaaatcgcaaaagtagtggccaacccggggaaaatcgtgaaagta

SEQ ID NO: 867 - DNA, 9406 bp, Oryza sativa
agtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttctttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgttcctatacaaatatgtgatagcggggtggatttgactgtatatgccttccatgatactagtctgaatgcaccagagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaacgagaatgagcggtagtggatcagatggaagtggaaaacgagaaataccttgcgcttgtagtggaaggagaagatacaacactgtgggacaacgaaactaacatacccgatgattggacgaccatatcattaagtcgtataaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcaagggttgagcaacatacgtgtttgttggagaatacctgtctggtgcacagaaacctgacagcggtatttgtggcacaaatggtatattcaaaggtggttagaaaaacatctttgtcccctttcaccataatgcatgacgttgagaaagagtacggatatgagatatcgtacgacaaggcttggagggcaaaatagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcagcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaccctatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatatgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagccaattgggttcctgactcaaatttattacttgatactaagggtcgtcgccagtcgcgcaggatcaagaaccttatggatgaagttgaagtgaaagatcgttctcgtcgtaagaaagcttgcattctttgcggggagaaccattcccgtaaagaatgcagcatgtacaatgtaaggcaagatgccacaggcgctgatgttcgtcgcgttccaaagggaagtcgaagaagaaaaataatccttagttcgctattatccttggtggactccctattttgaagatcgttatcgttcaatttatgtttagtgcgtctgtaattttaatttgaactttcttgcacttttattacccgaatctatttgtaatggccttgtaatttttattttgaactgcactgcacttttaatatcgtcatgtatttgtattggaattgtaatttaaatttcgaactgcactgcacttgtaatatcataatatatgtgtcgtgggcttgtaattttaaattgaaatgtactgaactgttcttatctgtatctatgtgtgctggtactgtaattttaaattgaaatggcatgcaaatttgttacttgaattatgttgcatacatttactgtactggtaccatacgtgcattgtactaatgtggttttcgatctgcaggtattgctgatcaatatgatgggcagcttatagacaaggagatcgataggaaccatcgatcgcgacgtcttagtacaggaactttctgcaatgtgctaaagatgcgaggaccggatcaatattggcgtattgatcctcgttgggtttcaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggcaagcagttggcccaacaatggtgaatgctggatgggcgcatgaccttctggccagttttggtggtgtgctgcctgttgcactggaggatctcacagatgggcacgggcctacgaaaagttggttaaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcgacggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaaatcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcccgatgtcaatgatcgtgcaccgcacggtctcgcggatctttgcacgcgagatatgcaactctggatgacgacttgtcacctcgtggtggacgtgcacgtcgagccacacaatgtccacagggttctcaaacagttgggcatgtatcaggacttcccttcgagagatggtcgtccttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattatgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatattgttaaatactcttaataaatgtgcaactggttaaataattttaattgccttgattacttgtggaacaggcggaatttgttgagcacgttcacgtggagtctgacaccctgttgcaaagactagaggtgagacctccagtcgtcaggcctgacgacgtggcgagcatccttcgcaacttccgtgcacgtgctgccgcactactacgtcgtgtctcctgtcggagcgtggcagatgtggtgcagacgtcgggccgacggccatcaccttcactaccccgacgttccagcgtggatcgcagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcgcttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccctagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagtgaggacctagcaagcgtgcgaagggcactgatcgtccttgacttatctatttgtattaaacttttagtcatttatgttctgtccgtactatttgagaaacactttacgattaacttagtactatcagaactatttcataaacttcttcggataattactcagtagcatacccttcgaatgaatcatgacaaattatcattcaaatatacaaataatgcacaagacgcgagcgtcgcagggccatgagaataaaatagggggaatttaaatataagatttcaagttgatgaattgaaaaaattgaaaatacttaaaacttgaaaggacgatcagttgagccgggccgggcaccgtagccagccggcgggatcaaagctagccactacggaagagccagcacaaggggtcccgggctttgacggcacccagagctcaactgcaagagtcctcccaggagtgaaccgaggcgacagcaggttcatgggccaaccccccgcttggcccctgagggccatggggaagacgctcgccatgacctggtcgccaccccccaccgcctctatgatcgccgtgcagatctggagggactcggaggggtcgacgtcgccgtcgtacttctcggtgaggcagggctggagctttgggggccatcagacattccgaagactcgccacaaagacctggcagccaaccttacccggtggggatgtggggggccttgccccctgcctagggtggcgtgacactcctgaggaggctgcaccttcccccgcatcggcagcgcgatgctaatcacgccggcggtcggaagaacctcaaaaatcacaaacgcgccccctacctggcgcgccagatgtcggagggttaactcctccaatagggaaccgtgaggccccccctttgagagttcggccgggggcagcgggtaattagcaaggtctttcgtaggcaaaagagacacaagggacttatacaggttcgggtcactgagaagtgtaataacctactcctgtgctatgctcactgagtgaaggattacaagatctccttgttagagaagaaggtggtgctgatgatcgggggtaagagactgctctagtgtctaaaatggctcatcccggatccatccatcgacccccctccccaagtaggtttgacctccttttatatctcaaggggttaccacatgggcccaaaaacctagctttggtggagaagtattacattctttgcattaaatgcatgtcttatttcttgacttgggaagcgggcgcacgtcatcttgatgttgggggcatgtcaaatcttgccgcctgacatgggagggcgcccatgtcagctgctattaatgggtgaagacttctgggctcctgcttacgccgggaaatggaaaccccaattgaccagggaggatggaccgaccctggccaggatgagaggttaagacctttcgccatcatgactgatgggataggacggggtgcacgccttctgacccatgcggtagtgcacctgacaccccgggtcctatcggtcattcgaccggtcacagaccaatttgggcgcgctgcacgccacattaaatgtggcgtggcgcgcctgctcaggttgccattaatgcgggtaggtgagcgctcgaaggtggccacctaacccaccgcacgtggcaacccgcagagggggtcgggggagcccgacccctagtcacaggagggagggccacgtggcgttggggggcagcctcctccggctaatctttgggacgaagtggccgccaccccgcttcgggcctaactcccctcgggggagggccacgtggcattgaggggcaacctcctccggctaatctctgggacggagtagccaccaccctacctcgggcctgactcccctcgggggagggccacgtggcattgaggggcagtctcctccatctaatctctaggagggggcagccgccactccaccccgggcgtcaccccctcggggaagtgccacgtgggtctggggcagcttcctccctccaaactcagtaccgtaagctgggagggggcggccgccactccactcatgcgccaccctcctcaggggacgccatgtgggtttgggggcggcctcctccctctaaacatgatacccccgggctcatatcaccgacagatgccgtattggttaatgtttctgtcttgtaacctgctcccatacaataaaaggtgggtaggaggccctctagggtgtagagattctcaactagaacgtcagatcaatatacactatccccaaacaggagttgggtattacctctcattgagagggactgaacctatcttccttatctccgcatctatccacttttaggtctcgtacgctaccccttttcatattgccaaaatcttgtttcgacaattagtgcgccaggtagggatgtatcgagttacctattgacaagtgcgatgaaatcaacttcataagtcaccgtcttcgtcttcgcttcgggaatttcgacttcttcgtcaccgacaacttcgacaagctcttgctctctgactcggatccaaaccaattaggagagatacaatttaaccaggcgagtttcagattcaattactggagctaccagctgtttgaattaatggatgggctaaggcccactcgaagattaattctttggaaaatcacaaaagcctacctcatgggatgacatgcatggggagtttagtaccaccttgcttattctaggagagggggacctccttaaaagggaggatgccctcctagccatttgaagcatgtgtggtggagagaagagggggaacacacgcgcgctcgctcgcctggcctggcagggcaggggcgggcgtgcatgacgtacgtgtcgaatggtctgcaagattagctcctcacccttgtgcagctgtagcctccatttgcagttttgttttgccgcgggaaattc

SEQ ID NO: 868 - DNA, 6134 bp, Oryza sativa
cgacaacttcgacaagctcttgctctctgactcggatccaaaccaattaggagagatacaatttaacgaggcgagtttcagattcaattactggagttaccagctgtttgaattaatggatgggctaaggcccactcgaagattaattctttggaaaatcacaaaagcctacctcatgggatgacatgcatggggagtttagtaccaccttgcttattctaggagagggggacctccttaaaagggaggatgccctcctagccatttgaagcatgtgtggtggagagaagagggggaacacacgcgcgctcgctcgcctggcctggcagggcaggggcgggcgtgcatgacgtacgtgtcgaatggtctgcaagattagctcctcacccttgtgcagctgtagcctccatttgcagttttgttttgccgcgggaaattcggatttgttttgttttggaaacattccgaaaaatccgatgcgtgaaaatggcgtggagtccggataagttacgcgcgacatatccggttcggttacgcggagtggagatcgtgtgggcgccctgatcaagcgacctatctctatataaactgagccgccgccttcacgcaacacacgcgaaatcaatctagggtttgcctcctactccgtgccgcactgtcgctcgtagactactccatcccactcgccggcttgcaccggcgatcgagagagcaggtctctggaacctctgccttcgacgtcctgcaccgggagaaggcgataatatggtttttgggaagcgctttgcgcgactgctctctgttcgtttgcgacggctcgtcttcctcttcgctcgcgtgctgcgcgccttcgtcgacgtccgcaaccgcaagtgattcctgccgagcaaccggttgttccgaaacctcggtacgtgttcaatatgttgcgcatatttaatctgttcatgttttactgcttagtttacatgtgtagatctaatgatgggttaatgctagtatacatctgaaatgtcatgctttatttatggaatatattaaatcattatatgcctataatctcaacaatccaaaaaccttattataggcactgtgattttactatggctggttttgccaatgcactgaggccggataaattcaccggtgtgcattttaagagatggcagatcagggtcactctgtggctgatagctatgaaatgcttctgggtgagtactggcaaggctatgggagttcttaatgttgaccagcagaaagaatttgatgaggccactactctctttgtgggatgcatttttagcgtgcttggtgatcgtctggtcaaggtgtatatgcatatgaccgacgctaaggagttgtgggatgcactgaatactaaattcggtgctactgatgctagcaatgatctgtacatcatgcagcagtttcatgactacaagatggctaacaaccgttttgtagttgagcaggctcatgaaatacagaccatggctaaggaactcgaactccttaagttgtcttacccgacaaatttttggccgggtgcattattgcgaaacttcctccatcttggagaggtttcagtactgcactcaaacacaagagacaggaatacttcgttgaggggttgatagcgtctcttgatgttgaggagaaagctcgggaaaaagactccgcgtctaagggcgatggtgggcagtccagcgccaatgtcgtgcacaaggcccggaacaagagcaaaggttaatacaaagctcagcagaccaccaacttcaagaagaagaacaacaacaacaatcctaattaggatgagaggacttgctttgtgtgtggccaacctagtcatctggctaggaagtgtccacaacgcaaggggatgaaggcacctgcagggcagacttccaagcctgctaatgtgaccattggcaacactagagatggaagcgggtatggtaatttacctactgttttttcagttaatcagtctactaattggtgggttgatgcaagggccaatgtacatgtttgtgctgacatctcattgttttcttcttatcaggtcgcacggggttccaccgtcctaatggggaataggtcacatgcttctgttcatggtgttggcacggcagatctaaagtttacttcggggaagattgtgcagctgaagaacgtgcagtatgtccctactatcgacaggaatcttgctagtggctcccgtctgactagagacggatttaagttggtttttgagtctaataaagtggtcgtgtctaaacatgaatattttattggtaaaggttatgagtgcggaggcctgttccgcttttccctttctgatttctacaataagtctgtgaaccatatttgtggcagtgtggatgatgaggctaatgtttggcattcacatttatgtcatattaattttagcttgatgtctcggctttatagcatgtgtttaatttctaagttttccattgtcaaaggttctaagtgccatagttgtgtgcaatcaaagtaatctcgcaggcctcacaaggctgctgaggagagaaacttggcacctctagaactcctacattcagatctctgtgaaatgaatggggtgttgatgaagggtggaaaacgatatttcatgtcgttgattgatgatgctactagattttgctatgtgtatttgttgaaaacgaaagacgaggctttagactattttaaaatttataaggtagaagttgaaaatcaacttaacaaaaagataaaaagacttaggtctgatcgtggtggagagtttttctcaaatgagtttgacttattctgtgaggaacatggcattatacatgagaggacgcctccctattctcctgagtctaatgggattgccgaaaggaagaaccgtacactgactgacttggtgaataccatgttggacaccgcgggactacctaaggcatggtggggggaggcattgttgacttcgaatcatgtgttaaatagagttcctaacagaaataaggacaaaacactatatgagatatggattgggagaaaaccatcactttcttacttgcgcacatgggggtgcttggcgaaagtcaatgtactaataatgaagaagcgcaaacttgggcctaagactgtggactgtgtctttctgggatatgttcatcacagcgttgcctatagatttttaatagttaaaaatgtggtacctgatatgcatgttggtataactatgtagtctcgtgatgttaccttctttgagagctttttcccaataaagaatacacatagtagttctaaccaaccctctaaaataattcccagtttaatcacaccaccagaacaaattgaacatacacatgaacatgtcactgaggaggatggcaatgaagctcctcgaaggagtaagagacaaaggacggctaagtcttttggtgatgatttcactgtgtacctcgtggatgacactcctaagttaatttcagaagcatatgcatctcttgatgcagactactgcaagacgctgtcggtagtaaaatggattccattatcgctaacgggacttgggagttgatagagcatctctatggatgtaaacctgagggatgcaagtgggtgttcaaaaagaagcttaggcctgatggtaccattgaaaagtacaaggctcggcttgttgctaagggctatactcagaaagaaaacgaagatttctttgacacttactcacccgttgccagattgaccacaattcgtgtgctactttccctagcagcctcacatggtcttctcgttcatcaaatggacgttaagacaacttttcttaatggagaactagatgaggagatctatatggatcagcctgatgggtttgtaattgaaggtcaagatggcaaggtgtgcaaattgttgaagtctttgtatggtctgaaacaagctcctaagcaatggcatgagaaatttgatagaacattgacatctgccggcttcgcagtcaatgaggcagataaatgtgtgtactatcgccatgggggtgagggagttattctgtgcttgtatgtcgatgacatactgatatttgggacaaaccttgaggtgataaatgaggttaaatcattcttgtctcaaaattttgatatgaaggatttgggagtagctgatgttatcctaaacattaagctaattagaggtaagaatgagattacactcttgcagtcccattatgtggagaagatcttgaatcgcttgggctacattgatagtaagccttctccaacaccttatgatcctagcttgttgcttcgcaagaacaagagaattgctaggaatcaactggaatactcccaaatcattagctcgcttatgtacctggctagtgcaactaggcctgatatctcctttgctgtgagcaagttgagtcggtttacctctaatccgggaaatgatcactggcgtgcgcttgagcgagtaatgcactatctgaaaggtactatgaaattggagcttcactatactgagtatcctgcggtactggaggaatatagtgattctaactggatcagatcaaagccactagtggatatgtcttcacactaggtggtggtgctgtttcgtggaggtcttgcaaacagaccattttgacgaggtcaaccatagaagcagagatgacggcactggatactgctactgttgaggcagaatggctgcgtgatctactaatggatctgcctattgttgaaaaactggtgccgactatccttatgaactgtgacaatcaaacgataattgtcaaagtgaattgttctgaggataatatgaaatcatctagacatgtgaaaagacgattgaagtctatccggaaattgagaaactccggagttataacgttggattacatccaaacagccagaaacctggcaaatcccttcacgaagggactatcacaaaatgtgatagacaatgcatcaaaggagatgggtttgagacccatgtgagttatattatggtggtaacccaatctatgtgatcggaaatcccgtgaattaaaacctgggaagaacaaacattagtaaactagaggagagtaccaatctataccctctctaagtgaagatgcgtgtactctcgtgagctgcaaggcaggttggctataccttaatgagttctgttggctttaactagcgaagatattgtcctgcagagcattcttgaaagaactcacctttgtgagcttgactattggtcgcagtctatggagattttgggtgaatcttctaggaagcttactaaagacctaggagtatgtcttatacgctccacccgaggggtagtctacagacggtctagtaccagataagactctaagtgaaacttgcttgcacaagacttgcaattcaagacgtagtccattgttcaagttgtgagtaagtgtagctttagttctaggtggatgttcaaccttaatcggtcttcatcgaaccgctggtatataaacagtacattggaaaaggcaaatctcagtgggattttgagatttggtgggggattattggaattaatggatgggctaaggcccactcgaagattaattctttggaaaatcacaaaagcccacctcatgggatggcatgcatggggagtttagtaccaccttgtttattcttggagagggggacctccttaaaagggaggatgccctcctagccacttgaagcatgtggtggagagaagagggggaacacacgcgcactctcgctcgcctcgcctcgcctggcagggcaggcgcgaaattggctcctcacccttgtgcagatgcaggctccttttgcagttttgttcggttacggggagtggagatcgtgtgggcgccctgatcaagcgacctatctctatataaaccgagctgccgccttcacgcaacacatgcgaaatcaatctagggtttgcctcctactctgtgctgcgtgctgcgccatcgcttgtagaatactccatcccgctcaccggagtgcaccggcgatcgggagagcaggtcttcagaacctctgccttcgacatcctgcaccgggagaaggcggtaataaggtaatggtccgcaaaattggctcctcactcttgcgcagatgcagcctcctttt

SEQ ID NO: 869 - DNA, 23240 bp, Oryza sativa
agaaggcggtaataaggtttttgggaagcgctttgcgcgactgctctctgttcgttcgcgacggctcgtcttccttttcgcacgcgtgctgcgcgccttcgtcgacgtccgcaaccgcgagtgattcctgttgagcaaccggttgttccgcaatctcggcacgtgttcaatgtgttatgcatatttaatctgttcatgttttactgcttagtttacatgtgtagatctaatgatgcgttaatgctagtatacatctgcaatgtcatgatttatttatggaatatattaaatcattatatgcctataatctcaacatcagcacattaccttcatccccatgcagacttgtttcgggagcttgggcttcgccgccgatactggctttgccgttctaatcttgaaactggacggtgtggatcatctgttccttgagcaagcgtaccgagccgaccgagcacttttccagttccaagcccgaagctttcccgccgtatgtgcagcagcgttgtcgatatcgaatcggattcacgcaactactgtttgacgcaacgaccatacaagcacaactggctgatcgttgatgaggagcagaggtgttcagtaagagcaagtttaatagtatagccaactactagctccaattcatctataaccaacctaatagcttattcatacaatagttacatactaccctattaatacatggtcctacttatcatacacacagtatgtcttggagtccgtgctacagctggctaaaaatctgtagcccgctgctcttctctctccttatttatcttcttaaaatatgtttgcagctggtttatagcctgctattgtatctgctctaaaggccttgtttagttttcaaaatatttttctaaaaacatcacatcgatacatgcatagaacattaaatatagataaaaataaaaactaattgcacagttatgggagaaatcgcgagacgaatcttttgatcctaattagtccataatttgtcataagtgctacagtaacctacatatactaatgacggtttaattagtctcaaaagattcgtcttgcggtttccaggcgagttatgaaattagtttttttattcttgtccgaaaacctcttccaacatccggtcaaatgtccatgtgatatcaaaagattttcatttcgcgaattaaacagggccttagttccccaaaacttttcccaacaacatcacatcgaatctttagacacatgcatggagtattaaatatagataaaaataaaaactaattgcacaattatagggggaaatcgcgagacgtatcttttgagcctaattagtccgtgattagccataagtgctacagtaacccatatgtgctaatgacggattaattaggatcaaaatattcgtctcgcggttttccgacgagttctgaaattagttttttcattcgtatccaaaaaccccttccgatattcggtcaaacatccgatgtgacacctacaaatttccatttccctaactaaacaagcccaaaaaagaacggaggaaagcatgtacaagatccctgcagtagtcgagcaattgagagcaaggctagaagagagtacaatagcaagatacaggtcagctgtaagcacacgtagagaagagaagagaagaaagagaaggaaagaagagagagaagaaaagcgttgtagctacctgaagcacgaactccaatacaatatgtgtatatgaaaggtgtgactatatattaatggtgtagtatatgcttataggtagaataagctattatattgattatagatgaattgaagttagtagttggatatactattaaacttactctaataatatagcatgtttgtcggttgaaagattctttgtagctttctcttagactacccatataatagctagctctttataattaatacatggccgacttgtctctttcatatattttcttggttttgtgtacaagccagctgctagcgatataagtgtgccacgtcatgtaaagcaaattaattagtagctagagaatacagtaacaggctattggcacgttaaacaagattaagaaattttactatttttttaccgcatggtgcctttcctctctccctcagtgttctttgttttgcttcaacagggatgcagttaatttgggtgcctaggagcctgcgtgtagtcggcgacagatttgtcgcccgcttgctctctcttttctctattaattatcatatcatcgattttaaattgatttaaattctaatgatcatatataattattctatccccaacttaaaattggtttaaaatctaataatcatatataattaccatatcctcgatttaaaattgttttaaattctaataatcagatatcgccatacaacaatagaaagagatgaatcttcaatacattttaaaacaaatttacatcatccatacaacagtctaggctaatacatcggttttcctcacgtactttctcctcactaatgtttcctccttatgatcagctcgtgagtaaggggtgtcttcatttgataggaggatgctcaggtcaactgtcaccgcgaacggaagttgcccgtcgaactgattgtaatcttcgtcagtcttatcatcgactccgacgattttccttttgccagggagaaccacgtggcgcttagactcgttgggccctttccccttctttgctttgctagtcatgtccttcaatgtagaaaacttgcgttacatcattggctaggacgaatggttcgtcggagtatccaaccttagtaaggtcaaccgttgtcatcccactatcatcgatcgttatgcctccaccagtcagcctaacccattggcaccggaacagagggaccttcagaggtcaatagttaagttcccatatgtcgtcgatggcaccgtaatacgtgctggttgggccattctgtctaatggcatcgatacgaacaacactgttctggttcgtgctcttgctgtcttgggctattatgtaaaatatatacccattgatctcatatccttgccatgtcgtgagccagatggtcccctctccaagaaggcaagctgttggttaatcgtcgttagctatgagatgttgtcgtagccacgctgggaaagtatcaatgtgatgtcgtgcaatccaggcatcggacttaacgatgtttttggaccgaataatcgccatgtgctcctcgatgtaaggagccaccaacgaagattgttgcaaaaccgtgaaatgtgctttacagaataaatcgttgtctactgtcacgcccggaaattcactagtaatttccaaacttatttgtgcataaaatcctcgtccaggaatcaaccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaaataaaacagtggagtagttaatcagaaattttaatcaacactgaacagcacacccatgctgcacaggcccaaccatcctgaacaaccatacccggctgtacagatttaactccaaaccaggagctaaacaaattattaccagtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaacccaccacagtgcacctttcctggatcataatcaccccctcaaaaaccagaggcatggactccccagcaacccccgtgggcttatctccgccacttctcagtctggtgctctgcaatgaaccatgctatacgaaaggtaaagccgttgcccacgctggcttgtggttggcatgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagttgaaccaatatatataaagctcaactagtcaaattataatatcccaaggtatcaaggaatagagtaatcaatgcaaacaggccataacaaaggaataggttcacaccacccggtgacattcgaaaataaatgtacagttgaaataaatagaaaatttaaatataggatcaacatgctcaaaggattgtgtttagcatctgtgtgacttgccttgcaataatcggtcttcaattaatcttcttgaatacttccggcgcactcacgaaccttcgcaacgacggaaacgacaagctaacacgcaaaacaaagaaaaagactaataaaaaccaaataaacaatacataaaaagtaaaccaacatgtagatcatgattttagatgaatttagcaacctgaaccactcaaaaccgagttacgatgatttagttatgaatttccgaagatttaatctattagaaaaacaggaaaaagaaaaaaacgatgatgacgtcagcgatgacctcatcaatggtggccggctcggatggcaagcttgcgggagctagagcggccggctgcggatttggaaggcatgcacacgtagaggacgacgagacgaacccaacggtactcaccctcgaaccaaacgacgaacgacgacggccggcgacgaagtgggtggcggcggcggctcggtcggcggtggcggcggagctccggtgaccggcgatagcggggagggagcggccaggcttctcctcgctctcgcgcacctaacagtggtggcggcgaccggcggcgacgacggaggcgacggcgcggcgcggatggagtcagccggcggcaacggcgagctaaacggcggcggcgcggcagctacgaggcacgggaaagctcgggagatggggcaaacgaaagaggaggactaggggggtcctttatatagccatgggagctcgggtccgggcccaaatcgacgggaaaaactcgggaaagtttagggttctcgccggaaaaggaaggatttgatccgcgaaattggaaagaatttccatagaaaattttgaggatttcttagggaaaaggaagaggagattgataggattccattcccgcaaccaatttggaaataggagcaacggggaggtcggattttggaagggaatcggcggcactgtgcacggcacgggagacagtcggctggaggaggaagatggagtactgtagcgccagggaggcaaaacagactttcggcctggctgagaggaagggagaggggaaaggagggaatgggctggattcggcccaagctgaggaggaggatttttattactttttccaattaaattaatcaatgaaatgatctttgaattgttaaaaatacttccaatgctcaaataattccaagaaaaatcttgaacatacttggacactcaaagtacttaacaaaattataattagaccatttaatgattaatttaatatgtgggtaattaccgaaatgctctttgtaagattaaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatctacagtcataattgctttccttccaagagtcccctttccccgtagcctcccttcatgtcgtgatttctgccaccccgattggacgaaggtcttcaataaattctaagaaaaactcaatgacctcctctgttccataccccttggctatgcttgtttccggataagaatggttacgaacatacttctttagaatacccatgtacctctcgaaaggaaacatgttgggtaggtacacaggcccgagagccggagaatactgatctctttcacaatgtgacttggaagatgcgtcattatgttgaagaagaaaggtggaaagatcaactcaaagctgacaaggcattgcaccacatcattttgaagggcttctaatttgtctggattgatgaccttctgtgaaattgcgttcatgaaacacatagctttgttattgttgcccgggcattgtcagggagaatacctcgaattataacatgaagcagttgtgtcatcaacacgtgacagtcatgagactttaggtttgtaaacttcttatccttcatacttattattctatttatattagaggagtacccagacgactctccaagcattcaaacatactttccttctctgccttgcttagagtgtagctggttgggctcaagtactggcttcctttctcctttggttccatgtagaggtcctcgcgttgactcatatcttagagatcattgtgtgcttcaagtgtatctttcgacttcccgtatacacctaggaagcccagcaagttgacgcagaagttcttagtgaggtgcatcacatcgattgcatggcggacgtccaagagggtaactcccaaaaaatagacttcttcttctacatcgccgcgtgaccatcttcgctggctatgggttggctgccaggtccctttccaaacactactttgagatctttcaccatatcgaacacgtatttaccgttgcgaaatataggcttcttacggtagtccgccttctgttcgaaatgcttgcctttcttgaggacaggttgggtcacaacaagaaatcgacgatggcccatgtacacaacctttttacaatgcttcagatacgtactttcagtttcttccaaacaatggaagccttgtacccattgtttgactgttcggataggttgctaagggcaaaccaatcgttgatggttacgaacaacaacgctcgtaggttaaattcctcctgtttgtcctcatcccacatagggacgccttcttttttccacaacagtttcagatctttgaccagtggtcttaggtacacatcaatattgttaccgggttgctttgggacttgaaaaataatcggcatcatgatgtatttcctcttcatgcatagccaaggggggaggttgtagatacacatcgtaacagtccaagtggtatggccactgctcatctctccaaatggattcatgtcatccgtacttaaaccgaatcttacgtttcgtgcatcctttccaaagtctttaaactttctatcgatgtttcgccactgtgacccatcagcggggtgtctcagcatcccgtcttgttgacgttcttctgcgtgccatcgcatcattctttcatgctctttgttcctgaacaaacatctgagccatggtattataaggaaataccacatcaccttagcagcaactctcctcttcgaaggctgtctgtcaacttcacctggattgtctcttctaatcttgtatcgtagtgcattacagaccgggtatgcttctaggttctcgtacttctcaccacgatagaggatacaatcattcggacatgcgtgtatcttctgcacctccagtcctagagggcagactatcttcttaccttcgtatgttgtttcgggcaacttgttttcctccggaagaatgttcttcactagttttaatacgttgccgaatgccttgtggcagacaccattttcggccttccattgcaaaaattccagagttgtacccaactttttgtgcccctgttcgcaacctggttacaatgacgtcttgtgatccgctaacatacgctctaatttctgagcctccttttcactttcgcagtcctccttgacatcctgcaacatctgaccacgatcatttgcagcgtcattatcttcaacagccctttccacctcacccgttgtatttccttcaaatctaccatattgagctcagtccggaatgttctcgtcttctacttcatcttcttccatttgatcaccttgctccccatgcgaggcccaaacattatagcttggcatgaagcccatctcaaacaagagaatatgagtagttcttactgcaaaatactccctctggtttttgcacttagtgcatggagaacggataaaaccattattctgcttgttagcttcggccactctcagaaaattatgcacgccatcaataaactctttcgaccgtcggtctgcgcacatccattgccgatccatctacacaaaaagcacaaaaatcgagaaaaataattcactaaagccaaactaattaaacaatcatacaatagttatatataattattcaaacaataattataaaataataccacaaattattcatgtttaatgtgttgtacttaatttaatttaaattaacttagttttctattcttttagattaattttctatctttttctttctcatcacttttatcacaagttttttttttcaaattctaaataaacaaatttgattataaaataataccacatattattcatgttttaattatatttgaagttgtaaacaaatatttaatgtgttgtaattattttaattttaaattaacttagttttctaaccaattaaacaatcatacaatagttatatataattattcaaacaataattataaaataataccacaaattattcatgtttcaattccacaataaagttgtaaactatttaatgtgttgtacttaatttaatttaaattaacttagttttatattcttttagattaattttctatctttttctttctcatctcttttatcacaagttttttctcaaattctaaataaaaaaatttctatattattccatctctacacaaactttctctctcatcatctcccattccaaatttatagaggcaaaatagtgtacaaaacatatctctaaatgcaaatgctaaccacaaaatagaggaggatgaagttgctaacctttttgacacctccaagttgtatattatcaccaaaacaaaatcaccaaaaaatttggcagcacatcccctcaaactcaagaaaattttgaagccttcgttgacggtcgttagcgatcagtttcgaccgtcaatattaccaaaatagaagagaactagttatgcttgcaatgcatatttctgttagaataataatattccactagtatttggatcactaaccttttgcagtgaataactataaagtagaggagaatcgacatcaaataagacgattaatcaatcggacgatgtcgaaaatcagacttatatataaatggcttaagaactcagaaatgacacgatcaattgggccaaaattcacaagtcttcggagaagagaagtccagaaggccaccagccaaattgtgggctggttgggccggcccctggttcggccgaaccagacccacctccaccgttggatgtggggtttggcagggacgctctagatcttctcctgatgacggttgcagggtatttcagacatttcacagcagttacaaccgtcatacctgcctatttaaggacttcaccttctcatttcactcacacatctcaagcaaagctctctcatattctctcaagtttagtttagtgttctgaagctagtggagtaggaatagagtagaaatcggagtccggaagccttcggaagagttcaggtatggctctagtagatctcctcttctcttttgtaagctttttgcttttattagaatactcttctttatacatttatggtattgaaatactttccaagtatatgaatgccaactttgcattatgttcatgttatactgattatactgctagcttatctgggagatgcatcagtacgggtatagcgtttgcttatgcaattactctatgtcatgacgatgatattagagtagtatctggtagtttaggcgtagtgtctagattacgggatatcattatttggattatatgctgcggatgagaagtgggccgctgatggtgacagctcagcacgggtattcctccgcgcgtgtatatagtcctaagttaatttcctggggagggtactccttcgtatttagccctggttgtatggtcatgacgggctgccgtgaggaactcggcagtcaggggtggcttctcgaagtaccaagagggcatcggatagagagtattagctagttaatcttataactagaatgtatgtatactatgtatactagaagtataggaatagattctctttctattttctttccacttagcttagatattttagtatgagaatgagtagctccctccttgtgtgtcactctacccttggattatcttaacctctgcttagactctgattatttcaagtaacatataaattattagtccggttctctctactatgatcttcccacgggattaaataaatacaatactgtcagggttttggataccacatacctaatagtagttcactaaatctcagcaggacccaccacataccatgtcttatacagaaacaatcttcggatataggaggagttccgcataaggaaggatgaatatagttctacatagaaacgacaaggactactcggattgtatccatattggtttccctagttctatttggacaatgggacacctatgggtataaatacaaggccccctatgaggaaaggggagaggggaacgatagatcaatatacaagccaacatacgccaagacaagacgccggatatctatgttagagatttgtctaggaggaccctcgtatggtacttacgactaccgtcaggagggatctagcactatctctgatctcgccgggcacggattcgaggaggaagactaccctgttgtcgactacgtgatgatacttcaagccatcacgtcgacaacaaatagataggctacccccaaatattgtactggtgtgattatggtgaataagagcaatgaccggcatcggccaacaggagtagggttattacctgacaattcagaggcccgaacctgtataaaaatcctcatccccatctcttttacctcaatctcgcatatatcctagtacctatgatccccatactatgcaaataccggaatcgcgacatcaaacgtcgacagatacccttggaatactctcgggtgaaatgctataatggtatatccgtgcgcttgcgaatgaactctgtaaccataatataccagaagtatttctgcgccattgctcggagttatatttctaataatatcgttaagaaataccaacagccttctcgggctagctagaggaagaagaagactatatatggatgggatctttagtcccggatggtgttaccaaccgggtctaaaaatcaccatgatctttagtcccggtttgtaacataaatcgagactaaagctctcatctttagtcctggtttgtaacaccaaccgggacaaaagatcccctggcgcctgacaacccctgacgcatttacaaccgggactaaagatgacatttagtcccggtttgtgttaccaaccgagactaaagatcatatcttcctgttgcacttataaaccgggactaaaaataatttttagtcccagtttttgggtgaaccgggacaattgtggtttttgcccatcctggcaaagatcacttctccagtagtgtcctctccgtccgcgcacacctcctcctctcgacaagctcacggacgacggcggccatcgtggccgagagaggcgaggaggtgcccaccgtggccactcctccgcggtcacctagctgttggcaccagggccggtgatggccgagagggcttcctcctcttcttcacctgtcagcttcgcggtggggcagagaggcaactgcggccgcggctggaggaggtgggggagagggggcgggaggtgacggggggtgctgctgtgagcctgcggctgagggtggggctgcctcagcgtggagctgatagggtgggggaagtggatgagttacaggagcgtgcgtggtgctcatcaaggtacctctacgccaagcccaccgcgagttgtgatctggccaatctcataggtacgaatgttgagacttgtacattaaagttgtaactttttagatcatgttcatgtgcgacacgaagtccgtgtcgagatcggatttcaattattttgtgtttcagtcttgtacaaatagaataatttatctggtgtaatgtgaaatagtttgttttgaaaaaaaattacctcttatctagaacttgacaaaagattgtattcgcgtgcaccgtgaagaatattctcttaaaacgcttggatcatgaaagtgtagttttccatagcaaggcatggacatttttctagtaaatataaaaattaaaaaatatgcaaggcttctagatgaattttttcgtccgtcgcaggtagaaacctcacgcgcacggaagcctttcaaccgattcctatttctagtactatggttgggaatcaccaccaccgctacccatgccgcatccgcctcccgccaccggccaccgccaccagccaccaccacgcggccgcgccacctcagcctcgttgtcagcgccttcctcctccctttccctctcggcatctcctagcacagcggcggtgcacctttgaggcacacacgataaaaaaaaaatcctccgagttactccctgctgccccaaatgcaaattaatccccatccccgaatcacaactcacaacatacaatatgcaccgacactaaaaaacgaatccaaaattttaagtatcatagccgaatgtataaaagaaataagaacagaaactaatcgatgcgggatggagcataagtcactaccaacatttttttacacacgcattgaccaaacttagaaaataaataaaacaattaagttttttttctagagattacagggaatcaataatcactaaattgactcaaaaatttaaaattctccacggattgtcggttccaatagccttgatgaacagaacgcttgcccaattaatttctttgtacacttgatgggcttcaagtcttatgatccatgtttcgctgatgcgtgtaccgaatagttggttgaggtgttgaattcggataattgatgagtctaatctaaaatttactgtcacagcctgatttttcgtttcaggatttataatttattcaataaattattaatagaatttatattaaaagttcattaatttacaagtgaagttaaatgtgggaaataaaatttcctaaacataaagcatggctggatttaatttgtattaaattctccatgattaattatactctctgaaattttctcggatttttcagagctcaattcctaattttaataatacaaagaacagttcagcaattatttaattaaaaaattaatcattaaatgatatgtttttaatattgttaaataattagagtgtccaagtatgttcaagatttttcttggaattatttgagcattggaagtatttttaacaatgaaagatcatttcactgattaatttaattgggaaaagtaattaaaatccccttttccttttcgggccgaaacaggaaaagttcaccttcagttatcggcccattcttgcttcttttcggccggccttatccattcccgaagtccattttgcatccctccttcaatcgtgccaaggaaaaggaagcccagaacaaaagtctaatttgcctccctccgatacagtaccttcttcaacctctggacagaggccgagcctgtgcagccgtgccgatctcctcctccaatccggcctccccgttgctcctttttccaaattagttgcgggaatggaatcctctcaatctcctcttcaatttccccaagaaatccccaaatgtttctatggaaatcctttccaatttcgcgaatcaatctttccttttaccggcgagaatcctaaactttcccgagtttttcccgtcgatgtgggctcgattccgggttcccatggctatatatagtgcaccctccctcccctctttcgaccgccatctctccctctctccgtagtcgccggaatcgctctccccgcgcgctccttctctctccgccgccggccgccgtttcagccgccgttgccgtcttccctggtcgccttcgtccagcgccgccacttccttcggcaccgcagcggcaagaacaagaccggcctccacttccccgaagccaaaatccaccggagctccatcgtcgccgtcaacccgaagctcgccgtcgcgttttgatctccggcgaggccctgctgctccttccgtcgtcgccaagcttcgccgtcacctccattggattcgcagctgcgaggagaacaccgtccaccacctcttcttcgccgtggatcgccggaaagccaccgctaccgttgatcagtacctcgccgccttttcaagctcatcgccggccatcttccgtcgccgtctgtcatcgtgtaagtgtaagtaagaatcgccgtcgccttctctaccttctggtgccctccgtttgctttattgtgtcgtggttcgccgccaaccgccgctcccatgctgttcatcggtgcaggttttctctagggccttaatccaatctaacctagtccattgtctgtatagcgtcgtcgtctccgtgtgttgccgccgggtcgccgtcgtcatctctccctctccgaacgtttgggttcggtgcgacttctatctgtatcccctcgggttaggtttcaatccctcggtcgtgtcgccgccactgtccaagccgttgttgctctaaccctagcgcagccactgtcgcgtcgcttgccggctgctctatgcaccgccgctgccgccgtcgccttgttgccgccacgtcgctgtttagccgctggtgtgccgctgccgtgcacaccgcttgtcgtatcgctgtgccgctagccgcctagccgccgccgtgccactccctgcctcagccatgctgctgctgttgtgcatgccgtgttgtcgttgttgtgtcatgtcgcagctatgtgtcgcttaaacctagccgccactttagcccattgcttggtaatcgagttgtctagccgtaggtgtaaccctaggttcctatcggcctatcgtttgccgtaccaatgcttttaccgtgaatcgtgtctagccatcggtctagtcgcagccgttgttgagtcgttcgctcgttcattcgaacgaggtgttccccgtgtttcgttcgttcatccgtgtggagtcgtcctttagtttagagctgttcagagccgccggttccgttcgccagtttcggttgatcatttgggtgatcccgtgtcacgtagaattgactcgttgagtcggtatctcgtgaggcccgcttgccagatcaatccaagcattccgatattggtcgactaggtcaagattaatctcagccgtccaaaatcaatataaatccgtttcctcttttcagtaacatattattcctttttaatatatgtcatccactaaatatattctaatctttttccggaggttgttttaatattttatctcagttataaatcatttgtaaattgtttaattaatttggaatagtcttttctttaatagatttaattggagttaaatcttgtaaaattcataactaattcatatgaagtcggaatgaggctattcaagtctctaaatttatctaaaattatgatctacatgtttgtttacttttatgtattgtttatttggtttttattagtcttcctccttgttttgcgtgttagcttgtcgtttccgtcgtttcgaaggttcgcgtgtgtgccgggagtattcaagaagattaattgaagaccgattattgcaaagcaagtcatatagatcccaaacacaattcctttgagcatgttgatcctatatttaaattctctatttatttcaactgtgcatttattttcgaatgtcaccgggtggtgagcctttcctatttaattatggccgaagatgactttatttttctatgggtaataatttaattagctagaaccttatatattggtttggttcagctagatgcttataatagattcttagccatgcttagaaacaatagctcactaatgggataaatcatgcttcactatcacttttggatatttaatggaagctcacgatggtcaatcgtgagtggttaattaattacttgccaactaaaacttgataatggtgggttgtgagcacatggttttgatggtcgtgctcatgacaattaaggaccggttcacgagtttcggttatgaaacattaaccgtgccaaccacaagccagcatgggcaacggctttaccttttgtatagcatggttcattgcggggcaccagactgagaagtggcggagataagcccacgggagtcgctggggagtccatgccttgttttataatggggtgattatgatccaggaacgatgcgctgtggtggattgtgttgtgcaagggatactgtcacagctcctttccaaggtatcgtggtggtatcgaggcgcatggtgatatgttgtggggctgtgttttgtgggtacagtggtacacctctggccagagtaaaactattcgaatagccgtgcccgcggtcatgggcgagtctaacaatatctttcgtgattagtctcacacttctcaccataataactgatcctataactggtaataatttgattagctcctggtttggaatggtacattcctggtttggagatagatcggtacagccgggtatggttgttcaggatggttgggcctgagcaattgatgattaattactctactgttttacaattcttaactgtttgctaaatgctgcttttgcaaatgagctctatattatgccatcctttggtatccttgtgcgcttgcatatttgctgtgtggcttgctgaatatgtcatatgctcaccttgcaataatcaatcaaatctcagttgaagacaagttgcgaaggagaagagggagtggagccggagcttcgctagaccgtaattccgttgttgttttctcttttcttttataagtatgtaacgttattattatgatgattctgtatattaaattatcagtttgtgtgtctcggctgatttctggacgaggattttatgcacaaattagttcggaaattactagtgaatttctgggcgtgacattttcccatccttattatatgcggtgcatgtatatacaatggcattgacatgttaaattatacagaaacaccaatgaagggcacccgtatatgtgccgattcatttgaaaccgatatttatagaacatttttcaatccatgttactcttaggaaagataaaagttaaaaccgatccctatgaatctctatatatgtgattcttaataaaaactgacaaatataccggtttttataaaaaagaatgggagtacttatacatctttcgaaagatttttatgatcgtatcacacagatttttaatctttggattaaaatccgatagatataataaaaagtaaaaagcaattaagaaacaccataatggacactaaattactatatcctcaagaaaaagaccaaatccaatacaaaatttaaaatttacatgcgaagattcaaaaattatagtgtaacttacaaaagttacagtgtaagtttcataaattacactgtaacttacaagaaaatgcactgtaaatttaagtgagaaaatcgagtgagagataagaaaaaatcttttgagtgagatatagcaaaatcgaaaaagaattgacttatatataataaattatggatgctaacgcccatccgaacgttgatgcggggaaggaaattacgtaggatatataagtcctactcctaccctcatccgaaaaaatctcagggcaggtttaccccctcatctcttcgtctccggtttcccattctttagctctcctcggaggagtcgagctcaatgtagcagagaaacttaccagcatccatgctcgcatagtcgcatgagacgtttatcgagaagaatcgtccaaacatcaacgttatttataaccctgaaggctcaactgcacgaagaaatccttgaaggctcagtcaagttcagtcaccagcaaaaattattagtgaaattcactatacaaactaaactcaatggcatacaaaatctaatcattgaataacttcatcatgaggcaactccttgcattgcagttcaagaagcacattggaattgataacgcacgcaagtaccctaggggagaagccctcctgccgctcagcctcggggtggcacgggcgggaccacttctcctcctcccctccgcctcgccgccgcccgagcggccactggcaaagtcgggcgggcgcatggacggcggcggcgggactccttgcctcctctcgcaggcacggcggctcggggcgctgccaagacggagggaggaccccaagtggtggtcatcggcgactagcttcgacgatggtggggacagatctgggcctctcatggtcggatccggtgtcccagctggtgtccacacggaggtggtcggtgtgcgcatggaggaggccggcggcgcgctgggcggaggtcgacgacgtgtcgggaaggctgcaacgacggtgaccctcggcccgatgatggggacggccagttccggcgccccttggccagatccgccgtctggatgatgacggcgagctgccaaggcgaggtgggggccggcgtggcctcgccggcgtggggatggctacgggaggccggccacggagggaatcgagcgcgtgtgacggaggcgggggcctggtgctgcgacggagggggcgggcgcgccaccggcggttgcgggaggctctcgtcggcgcggagatagtggcagccactggctgcgcccaccgacggttgcggtggtgacggtggcagcggtgcagcggagtgtaggcgctcgcggtgacgttggcttgtcaagctttgacggccggatccacggccgccttggccagatcgggtcagtgcagcagaggatggcagcgggttggcagcacggtggactcgtgagcctgcctaagttgtgggtggtgggctaggcttggtggctagagggatgatgtggcggtccggcgtcatacgttgtgcgggtgggttgtgtggttttggatgacgctggcgaaagccttggctggcctttggttggcttgacgacggcggcgccattaggcgtcgttcccctccttggaggcgttgctatggcgtctccctcactaccaagaaccttttccatgcaaggatggtcgttcgtggaccccctacgtcgaagctctataagcctagctattcggcgaggccttcgtctcttgggtgccgctcttggatgtggcaagtgtccaactttctccgttttcttctaggtgaagtcggagctactttatcggggtgcgatgaagcttgacaacgataacacgttgaagttttcgagggaggttggtgttagctgtgtacaagtagtagtgctcaagtggcttgggttgatgttcaaagtggacagtcggtgtcttgctcgttttctgcgatgcctttggtaacgatgatgtgatagctgtggagtcgaagctgctgtgtcgctaggtgacaagctcggcaacgataacacttgccacgcgaagtcgaagcctttgtgtcgctttcaacaagctctttatcgatggctgttttgggcttcgccattctttcttttttcgcggtgttggtagcttatgttagagtgttgtggttttcgtccagtttttcctaattaactgcgcattgtaaggttttgtctcgttttcttcttaaaatgagacacattcttctttatataaaacgtcggcaacggtctgactgttcgaaaaaaaaagataacgcatgcacgtgatttatctttcattcagtaggacggcagcacggtgtgttccatgcgaaaattggaagtttaacttaaaattgaaagtttgaagaaaaaagttgaaagtttatgtgtgtaggaaagttttgatgtgatggaaaagttggaagtttgaagaaaaagttggtagggcttagcttgatgccttgactccaattcccggctgccactatgagctcaatggcgctcaacaccgcgtggatggtccgacccaagctcaacatctcaccagggtttcccttaccgccggtaaccgggcttaccgcggggatacggtaatataaataccgcggtaacctccttaaatttaaataaatttaaaaaataatttaaatttttgataaattttgcacggttttgtacggtttttcacagttaccacggttaccgtgtggtaaccgtgcttaccgccggggcacggtaaccccggctctggtggtttgggaaaccctgcatctcaccgggagaaaaaaaaataaagaattgggaaccacatggtaggagagaaggaggggggacatgtgtcgctttagaggaaatcaagtgtttgggatgagactagactagagaagagagcggcgtctcaatgcttggccccatcgaccttattatctctttccttccccaccttctctcctctctccgcggcgcgttaattcctctccctcagtccctctctccggccccctcctcccccaccggcaacgccgcttcccctacccttcagccagcgcgccctccctctccccccaccgacgacgtcgcttcccctaccactcacccagggcgcccttcccttcccttggcagccggcgtctcagccgcggtgccctccccctggctcctcggcggcgtcctcaccctcttctccgccacaacacaacggacggtatcgacagcctcggcggcggcaccctcctcgtagaagcggcgtcctcgcctcccatgaccagtggcgtcgctgatttagtttttgtgagttaattttccctggatgattttggatttgtgatttcgtgattcattttctatcgtttatgtattgtgtcttggctcagatggatcgaattgggggattagatttcttgggatcaaattcatgatatctaggttaaatttggtattttcgtgctgtttttggttgattgattaatttgggtatctagcacggggatttttttttccttgaagaccgacttggactcaaaacatacagatgacagacgaagcggactgaattttttaattaggggtaggtatatgatagatttatatttttattatattattaattataatataggtaggtagatatctatctatatctaatctatatctatatctatatctactagcaaaatgcccatgcgttgcattgggtgaagacagaaatagtaattagtgtgtgggagcataaaaccaccaggtaaattgaggtctttatagtcgaatcgaatctttctagtgcaaataagacgctaacatgatataattatttgctgctctaaatgcactgacatggatactaaagtttgaaaccacaaaaaatatttacttttttgtcatgtattattatgagtcaattgcagtactttgttatttttttggtactcgatattgataagcatttttttcatattgtaaagagtagccataatacaagaaataattttttgctagctatcagatcaacctcattgcactccaattgcataacctttcacttaaataattagaaggaaagaaaaaaatgtggtatatcgcagaataactttcactctaaataatagaagaaattatataatgaatggaaaaaaaagtgatgtgattaggtgtcctatggcgaatgagcaattgatgaggggaaaaaaatccaaatgtaaacacgattcattttgttggtgattacttctttttttaaaaaaagaaagacacatgtgattatttttattttaaaaaataatttattttgtcggtaaataattcattttattggtgactacattggtgactacatgttttaagtaataaaatcgcttcttttattatccgattcctgcttggcgtgagtccaaactttattcgtgttcggttgctacagtgttgtgcagtactgtgctgggctggtgggctgcttctcctccgctctgtgggctcgctggtgggctgcggctgctatctgggccggcctgctgctgctttgggtgggctgcctcgtcactaatccaatccgggctgctttggatgggctgctccacaaacaaggttttctctttttatttttcttttctcctttatttgcaggcgtaagagatcgtggccacgctttcggatcatggattagcgacgaattatcgtgtgggcccactcttaatgacggacgaaaagattaaccggaagccttacttattttttaattaggtatatagatatctatatctaataaaaaaattcgtaaggcttccattagtccgcttcgtccgtcgtttctatatagatatatagatatccaataacttgatgagtttaacgtatcataccttacccataaaccaaacacaagattgtggagatgatgggatttgctttgagatttgtgatggaacacgtgtcacctgtggtcgcgaattttctttcgcgagagcgagacacacacaagtacacaaccgcatctctactgtgggcccccttcccctcctcgcgtcgcctctccacttcgcctctataaagtcccatccaattctcgattcccaatctagcacagcacaaaggctcctccttcgaccgcagctgtgctacctacctccaatggggctggtcgtgaagaaggaagagagatcttccaggctgatcccttctattggtacgaaagcagctcactggagctttgc

SEQ ID NO: 870 - DNA, 17173 bp, Oryza sativa
ctcattctggttggaggcttcggcactcgccttcggcctttaacgctcagtttcccaaagcctcttgttgatttcgcgaacaagcccatgattctgcatcaggtaatatgtggtttcgctagtactctgatggagtaataagagcacttaatttgcaatgccaatcgatgaattgggcacaagttaattagtacagtattctttaccaacattccaacactgacactggcctctccatgaaaggagggagagggtgttaaactggtcaaagaacattaatactatttgatttgtttataacccccacataaacatggtgtaacaactaaacatccatgataggtggcatttgcatgtgattgaatgcacctttttactattcaactgtttctttccttatcaatttggttacatgattttggagaactcttttggtatcacaccaaattttctgtccttgaaaattccaatcagttatcaagagtacttcatttatatccaaaatgttggctccagcaaacatgagcatgaggattgaggagagtaatgagctctgaattaaaagttttctggtttatgcagattgaggccttgaaagaagttggagtaacagaagttgttttagccatcaactaccgcccggaggtaaaaaggagataatattttactgttgtctcatggtataagtataactatcttcgcattctaattggtttgttctgtatccgtcttttaggtaatgctcaatttcctgaaggactttgaggataagcttggcatcacaatcacgtgttcccaagagactgagcccttgggaactgctggccctcttgctctagcaagggacaagcttgtgaatggatctggtgagccattctttgtcatcaacagtgacgtcataagtgaatacccttttcctgagctcatacaatttcacaagaccaatggtggtcagccaccaattatggtcacaaaggtagatcctttctttgaccgctttcttgaattataaactcgttgattgtgtatactgactattattccaatgtaggtggacgagccatcaaaatatggtgttgtggttatggaggaggccactggaatggtggaaaaatttgttgagaaaccaaaaatatttgtaggcaacaagatcaatgcaggaatttacttgttgaacccgtctgtcctggaccgcatcgagctaaagccaacttcaattgagaaagaggtctttcctcgaatctcagctgatgcaaagctctttgctatggtccttccaggtttttggatggatgttggccaaccaagggattacattacaggcttgcgcctttatctggattcacttaggaagagatcagccaacaggttagccactggagcacacattgttgggaatgtgctagttcacgagagtgcgaagattggcgaaggctgtctgattggtcctgatgttgctattggtcctggatgcgtcgtggaggatggtgtgaggctttcccgttgcacggtgatgcgtggcgtgcgtattaagaagcatgcttgcatatcaaacagcattattggatggcactcaactgttggacaatgggcacggatagaaaatatgactatcctaggagaggacgtacatgtaggtgatgaggtctataccaacggcggtgttattctcccgcacaaagagatcaaatcaagcatcctgaaacctgagattgtcatgtgaaataatcctttttatgttatggtatactcaagttcttttaatgcagtatagatactttataattgtgatccttccaagatgttgacatagcatgtatgttactcacattctgataactgcttctcaatgagaattcagtgagccatatttgattgtaccttcttttggaccattcattaaagttctcaaccctgcataactgcttctcaatgagaattcagtgtgccatatttgattgtaccttcttttggaccattcattaaagttctcaaccctgcgccaagaggaccagaagaaactctttttcctataaaagaagtggattactgtcacattttgaaacaaatatatactgctatatggatagatccataatgtatggcacaatttgtagcaaatgatgcaaagttgataataataggatcaggcagatccgtataaaatatgggccaattatttgtacaagctcattgcaaaacctagaaaaaaaaaagtagaactactggcatgaaagtatgaaactgcaatttgctcatgctgctgtaatgagcttcgcagttgtggttgtgatttgtgatggtgattgcattgttattctctgtataccaatgagtgatggtttatgaatctgacttcagcatctcaatcaataaaactgaagccaacgagatgagaaaccatcctagaccatgctgcttattcttccatcggcctcaatcctgcaaggcattgtgaggacgaattttttccatattatttcccactccacaagatagcttccagaaatggttagagatatacatatggtcaggagaaacgcaggaagcgaatatgcattagaccttttcttggttgggataaaacacaagtacctatcatgttgtcctctcaaaaagaaagaaaaaaaactatcatgtgctgtaaaaagggctgggatgactcaacatcatgtggactggaggcttagtaattgaaaccacgtcactctcggatacggttcttgtcgtttggtcatttagatagaacatgtttcatctcagtgcgcctactcccttagtcccaaaataaattaatcttatacaagatttggcacatcatagtactacgaatctggatatactaggatgtgtcacattccgtacgaggttggtttattttgggacggagggagggagtatctcggatgcctaccgcagtatctcatgaccttataagtttatccgttcttcattcagttaaccattgttgcggtggagaaaatttcgtttgttacgttaaaatttcatttactccttccgttccattttaaatgcagtcatgaatttccgtatctaattgatctgtgcatactgaagttaggacttcatgggctcgagttcccacactgccgctggctttgagccaccatgctgttgtaggtctcctatcagcttgtgctcagatttggaattaagagaattggggataaatcatagtgttctaagctggctattgtactactaaagggactaggaatatgattttcttagttcacattccacccaactcccatgatatatatataggccgggtttaattagttgattacaatcaagtgtaatgaaagaaaagttctgaaattaagaacgggttaaacacatcccgataaaaacatgatgtcaacgggacagcctggagaaaacccatgtctcacatgaaccatcgttctcatcctttacgctgtgagccattggattccctttaagtcaagtcgtctaatcgccgcccacattgccaacttcttatctgaacctgacaaatctagagatagtcctattttctgaactttggccgtgacatctccattacagttatcaacaaagcatgtgtatagttatagccttctatctgatctaccagctgcttggtcccttgatgtgaatgtaaaaaagggattgccgataccttaaacgggtattggaaagaacatgtttcttaatatttctattgggatgcattaactcagataattgccttccatgtgttgttttgttagatgtggcaatattaagataaacctcatatttctatccttttgacaaggtcatctttattaatcttaaggtgcagacaagtggtgaaaatgcatatctatagctcgtgtgttgtgatggttggctaggtgtaatagatgaagttggcatatggatatttggaggtaactaaatgcattttttttctgaactgctgttttgttgtataacctgtttaactccacggtattttgagtggaccaacattggtggaatacttaaaattgtattctttgctacttacctcaaagatagcaaacttttcttgtaattgttacaataaaattttgactttgattgaattgattagcctttgtcgcaatgcatcctctagcttaatttacttattcattgttgtcacatttgagttgcaggtgtgtgaaaaggattccaaggttatgaacaaagaggcttcaatacagttgcggtcctgattgcttatgtaatttggaaggaacaaaataataagtcttcgactaggaaaacaagaacggctggaagaaccattgccgtgggtacctgctggggactgactagaaagggagtcttggtcttctatgtcacaattctagttttgagggtagtttatttatctatactaatataaaaagtacgagttcatccccaatcctccaatccttcggttccactatcgtgtgggaccaacccctcaccctctacacccgaaaaaccgcgcacaaaaaagaaaacaaaaacgaaaatccatccgctcccgcacgtttgcatcgccgctaacctccgcctggccccgcacgcctgcgccgccgattccctccgcctgcaccgtcgttctccccatgccgcaccgccgcttccctccgcccgctcctctcccgcgccgccctctccacctctcctcacgtcccgtcacgcctgcccacctcagccgcagcccacaagcagggtccccgatcccgtaaaccctagcctttgcctcgccctcgctgcctcgctggctggatccccactatctgggcgccgtcgatccgtcgccgtctggtctccatcgagccgcatcgccctcgcgtctccaccacacctcgccgtcgattacccgcagtccggccgccgtcgatccctcgacatcttgtgtccgccgcgactcctctgccccctccgcaaactcatccggatcacgtctcccttgctgctcctgtgtaagacaaatgtgaatctatgttgagttccatccggacaactgtgggcgaaaaggcaaagattttaatggctgacgaaggccagcgaccggaatttgacgatgaagtagcggtaagtggaattcctctgttccatagccaattaccttctcctcccaagttattctctatgtttggtgcctctcaaaaattaaaattaacttaggattttttttaatagatcgatagtggctgcacagattaccatgtgcgtgcaatggaccctatgaaatcacaatgtttgggagtaaatttagtaaaagattgctatttcactgtcaatgtttgggagtaaatttgtgcctgcagaagtttggttttatcccctatgcaatacgagtataatatatgtctgattggtgtctttgttttcgctcgtatcaagccaaagattgaaagaaagagagaaagagatcacaacctggtggaatatctagcttcagcggaatagaagggtcttccatcgcgtttgctcagataacagaaaagtggcgcagttaagctggtaggagtttttcttgacaggaaaattcagtcgctttctcttccatgtaatatcctcaaatttttttctgtaatttcttcccgtcatatgaactcatgattctgtggtggtgccctgatcttgatttctgtgggttgttccaggtggatctatggagagagatggagcaactgcaccaccgctaatggtgaaacacaatgtgtttgaggagaaggtgattgacttgcatggcataaccatgttacggtgtaaatgttttcgaacaaaagtgcaaattatgcatttaaacaaatctgaatcctgtttacacctgaatcaaccttaactggtggtttagcttgcaattttatgagcagctcaattatataattctgaatcagggtcatgctaacagataggtgatgtattgatacaatggattgtttccagcaattttcttgagatggccaactaattcaagaagcaaattgaagccataatttccaggtaagagcttcattttatttcgatgtgattgcgcctacaatatattttgtataagagtacctttgggtatgcgcacattgatatttacaagtcatttttgtatttattttttcatcatgtttcagataaaacaacaggctgcatactattttctggatttttctatgggcatgcatgctcaccagagtgggagtatattgcatcccatgactaaatttatatacatttgtcaacctgctgaccacaggttttttagcttcttattcataactacagttagcaagcaatggtttcaatatgttcgtacttgagggaggccatatacctaaaataagtatatgtcagtattttcaataaagcatgtgaatatgtttgaaaggtggtgcagagcttgcaagttatcttctcattttatccaataaactatttatttagcttttagtagctctgtatttttttttctatcttcctttctctgtaaagataaagatgaaatgcttttagtagctctgcatttttttctatcttcctttctttttcttctttcttttcctcagtttcataagaggtataatatgagaattttgggtataagcaattttgcaacggattgagtggatccatgcagcaaaccattagctatagtctgtgtgcttactttttttgtttaagcacttcttttcacatttctaaaaaatgtgggtgataacgcatttctaaaaattatgggtgataaaacttttgtttgtgcctagcttaagatcctgaggtattctgaaaagaacatctgtacgtgttcttagctgtaaaatctgagatatttaacagaaatatggagacatttatgaaactttattataactatggatgctaggtcaggtaacttacatggagataataccttgatggggtagagggagtagggggtcgttattagtttgttaatttgcaaataatcctgatgaatggatctgctttgagatttgacaatgataagttggtgatgcttgactaaattttttgatattgtggttaaagacagttgatttccctctcaattcgataattaaacacaggactaagtataatgggattttttttgtgaacatgtgctcctttgtatgtcctgccatatatacatacatatcctaattgtgatgctagccgtggataaccattctacaatgttttatttcaggttcaatcacgaaaacatgcatctgggatatttaattttccagcatgcaagctagctataaactgcactgaacatcattaatctggcattggcagattttcaggtcagcttatggaagccttatgtgtattccaactaataagctccttactttgtattaaggtttgtaatttttacataattatcaatccagtaacccccttctattttcaggccagtgccataaagccccttgaacttgtcagtgccatatatagtaacttgtacaggtaatacaagttctgttatagtaacttgcgtgcaatttggttgcatgtgtggttgtatttcggtttgatcagatatataacactagcatttcggttggttgcaatttttaccatcaaggcctgcatggtgattacagaatctgagttagctatgcacatatctctgaaatttgcctagcatacttccacatcattctcccaggattggcttgttatatatctccctaacaacaagcaacctataaagatgccataataaaaaaaatgctaagaattatgcttgagttttgacttctaacaatcagatccctacctgatataatatgtactctaaatgatggtaatatagccaatagttttagaatgcatgtgtggtgaccatctaggattttcatacggtacttattacctttaggtaacaactttagcatattgtaagggctatctgatgtgcaactttagctatctgatcaatgctactattgcaattatctttgagctgcaaaccacaagaaagctacactgttcaaaaaaaaatccccttttccttatgcatagttgcattactttcagtattacaaaatgatcatgcaacattcctcttgtgcttattatgtataacatcttttctaggtgggatgtggctgatagctgaaccaattctggcaatgtttcacattttgttgaagaactgcatgtagaatagcttgctttggatggagaaatctactggaaggatggtaaatcgtcttttgtacatgcaaagccatcaaaagtagctattttgtgtttgcaggtgccactctagactagattgggtgtttgtggtgcgggcatctgacctgtatttcttagattgtaatcagatgcattttgtgaaggataaagtcatcaacagtaaattaattgtgtaaaaaagatgtatttgtttcatgatcattaatttaattggtgcacttggcaatggtacattcgatgcaacatattatattttgtttttttttaaaaagctggttcttagtgtctaattgcatgctaaacagggagacaatctgccaggactaatatcttttgccaggaatagtttgtctgccagtaattcattgtctgtcgggaaaactaaagaattgccggtactcttccgccagtcaaaaagatatctaactctcaatttttttcataggaacaaaccattagtggtgataattgacatgttgtgtgctaactatgtttggttaactaaagaaataatgtttattattttccaacggagccaaaattctatgaatatcatatcttttatgtcattgacaatggaacgaattattaatgaataatgttagatttatgttcatgaaacattcaattaatgccagctataaacattcaattattgaaacattcaattaagtcagctataaacatattttaagcagataaaagaggagagatgtgtttttatctctcctcttttatctacttaaaatatgtttatagctgacttatagtctgctattgtagctactctaataaagtttagtctttcattgtagcccgctattgtagctactctaatgacgtgaagtttagcctttcattgtagcctgctgcttttatctctcctcttttacctgcttaaaatatgtttatagctgacttatagtctgctattgtagctactataatgaagtttagcctttcaataatgaactggtttccggttatcattcaatgattcatcaatatgtgaaaatgttggacagtaaacggaaatggaaagaaagatacttctacaaattattctatttctatgaaagtgtaaaaagagctcagtatttattttatattttctattttgaaattgagatggaaatgacacattctattttttacattaacattttagatgggaacaaacaacatatgttagatggatcttaagattctaattttacacaattgataacttcagcttcaaaagatcataaatggtgaaaaacgtgccttgcacgtgcacgctcactagttaatactaaagtccttgatgatcaacaagtttcttcttgctaaaacaaaatgatcttctgatacagacaagaagcttcttttccattgccaatggaactggttgcacatgctcttgtcttcctgcagaagtgttgctggcatctatgttaccccgatacgaggatacggatacgcgatacggggataccgggatacggcttattttgaaaaacatggatacgaggatacgtctatatatacataataaattaagaaaaataatgcactcctcaaagaaaatgggagaattgattgaggccaaaataatgaacatgcaaataattgaggaaaaagtacgaattagccccccgaactatcgcggtcgtccgaattacccccctaaaccacaaaaccggacattcttcacccccaactatgcaaaccggatgaattacccccctcgatccaatccacggtggttttggtctacgtggcgtacacgtggcagtcttgtcagcattctaattataaaaaaaaaagtgggacccacatgtcatattctcttccactattcctcttctctgtctcactcttcccctctctctctctcatacgcacgtatagctttgaccagaccaacagtactgcagtagtactggatcttcaaaagtcacttatggctttgtagtctactttgcggtgtccaaaatcacaacatcaagatccaggatgcactgaaccatcaatacgcgagacctcacttgaatgaagcaatccctgacccggagcagcggtggtgctgcgcgcgctaagctagggggcgtgcggcgtgcggcgtgcggcggtggctccacggggcatggcgacgatgctgcgctcggcggcgtgcggcagcggtagtaggccccgcgttgcggagtggtggctctacctttgcctagcttcagaacgacggcgccgttgggtagaaaaagatggacgcagcgaggattggtatcccatgagaagctaggattagatcgtactgtatcctgtatccgtgcgtatcagagaagtatccctaattatttcttttttctgaaaatcgggaaaatagaggctacgtacgggatatgtatcggagcgtatccgtatcagggtatcctaggctggcatttgtgatttctgtatttgattttactgataaaaagtgtggatcatgcaatttattgataggggcaatgtttgctggctgaaaaaaaatgagatgtgatttcttaattgtgatcgtttgggattacattttaaacagataatgtcttgtcggttgacattcagtatatggagataagaatctaagtatataattattttgaaaattatagtatgacaatatttttcatttgtcaaataacaattttcttgaaaatgcgttacaatacattgttaaatatcatcgtagcgttagcacgggcatattactagtgtttatttattacacacgtccactacacacacatcacacacacatttgctaataccacttgtcgaaccatactgttgaatttataagcacataatgatttaatttatttcataaataaatcataaaattgcatatgtaaactagtataaacgcatcatgagatctacacatgtatattagacagtaaagcattaacagatcaaatatgcgcaacatactgaacacgtaccaagggtaccagaagaccggttgctcagtaggaagtactcgtggttgcggacattgatgacggcgcgtagcacgcgtgcaaagaggaagacgagccgttgtggtcgaatagagagcggtcgcgcaaagcgcttcccaaaaaccttattgccgccttctcccaatgcaggacatcgaaggtgaaggttccggagatctactctcccgatcgccggtgcatgccgacgagcgggatggagtagactacgagtgacggtgcaatacagaggaagaggcaaaccctatattgatttcgcgtgtgttgcatggagacagcgggagatatcaggacacctatacgatctctgctccgcgtaaccgaaccggataagtcgcgcgtaacttatccggacttcacgccgtttcacgcaccggagtattcggagtgtttccaaaacaaacaaatccgaatttcccgcagcaaaacaaaactgcaaaaggagcgccgtttcacgcactggagtattcggagtgtttccaaaacaaacaaatccgaatttcctgcagcaaaacaaaactgcaaaaagaggctgcatttgcgcaagggcaattttggcggaccattcgacgcgtacgtcgtgcacgcgcgccgccatgccatgccaggcgagcgagcgcgcgcgtgttccccctcttctctccacctcacatgcttcaagttgctaggagagcatcctcccttgtaaggaggtctccttctcctagaataagtaaggtggtattaaactccccattaatgctatttcatgaggtgggcttttgtgatttttcaaataattaatctttgaatgggctaaggcccctctattaattccaacagatacatgaccgagtctgtcctgtgttattggataatctattttcttttttttaaaaaaaaaaccaacatactgctacagcagaagggttcgacaactaattttctcttttactgcttttctataagtgtgaagaaaatttgtatagcttccttgcacagtacagaaatttgtctatatgttttaagatttttgcatgttttagttgttctcaaagtatagtctctcatattccacatagaatattctgtgttgttgatttgtgtatgtgcatcattttttgtacgtttgtgcaaaatatattttatagccattatcttttgggtaagtggttcttttttcatctgccgcataagaatatttgcttcaaaaaacaaaaatatgaaaaaaaaagaagaaggagagatcttaaaacacatacactggcttcttttctgtgcagggaataagaattgaagtgcatgagttaaaaggcttagcatgagattccaaattattttgacctactagtactatcattcatcctcttgcttcattccatagcaacacttatcctcctcttgtttttcttttttcttttttttccatttttctctctaagtcttagagtctaagaagaacatacacttacacttgttgatttgtgtatacgaatcatcttttgtacgtttatgcaaaatatattttgtatgtgtactagaacatagacatacacatacacttgttgatttgtgtatgtgaatcatctttgtacgtttatgcaaaatatatttttgagccattatcttttgggtaagtggttcttctttcatctaccgtataagaatatttgcttcaaaaaacgaaaatatgaaaaaaaagaagaagaagaaggagagatcttaaaacacatacactggcttcttttctgtgcagggaaaagaattgaagtgcatgagttaaaaggcttagcatgagattccaaattatttggacgtactagtactctctccgttacataatataagtcacaactacttttttttgatgttacataatataaggcatgaatgcatgcatacacttaactaggacatcttctccattaaattatcacttttttaaatcctccactctcaagatctctaattctactgtttgcatgcattatatttattagggtgatccaaactaggagatgataataatggtttcttggtttttgggttgagggtggttgtgccttatattttggaacggatggagtactatattcatcctcttgcttcattccatagcaacacttatcctcctcttgtttttctttttttttcccctttttttcctctaagaagaacactttattagttatccaacaaaatgaccccacaaaaggtcgattccaacttccaagcaccattagtactaccaattaggccattagaatcacatcatcacaaccgtgttaaacatgttgagttgtgtaggccaaacccccgaagtggcaggcaacctttattcccagttcctgtcccacaaggccatcccggacaagcaattctggaatttgctgagctgaaaagcagtacagctagtggaagaagtagcagcagccattattcattgttcttgcctcttctacttcatgtccaccaccaccagcacaaaatactcagcagctttattcagcacaagattgatcgtaatccctggctttcatcattgaagatttggcattgtgcttcagtgcaggaataaaagggtttttgtcaactggaggccatggctagtgatgctgtagaaactagtggctgttgctttcagccagtggcatttcttcggatggtttttttgtaccatttgaagtggaaaagaagggcaaaaagtggagtgatagttgacatgatttgacattatcggttagtagtagtagacattcactaagttcaactattcaagtgacaaagggcctgaacaatcggattaaatttcattatcggtaaaagttcagtcctgatgaagaacctgagccgctcatataaaagaagttcactccaagtgatgaagagtttgcactgtcggataaaatttcattatcggaaaaaagtttctgtttagtactcctagtgatgagaggccaactggactgaacttgcaagaatttgggcactgttttggtacgaattctaacagagattttttaaaaaaaaacatcctgcatttacttagcagagtattccgttctcgccgtccagccaggggggacaatttcattcaaatttcaaattccttatcagggtagtacttgtagattaaccgcaagattttacttttaccaacttactctcctatacttaattacagtgagacgccagtagttgacagcatcattggattgggcgtgcagcaaccaaccaacgcgtacgccaataagaacatggcggatagttaccagctgaggctgagctgttgtgctcaataaattcagcgtgtacgactgaaatctgatacccaagaacagcgaagcacacagttgtcacccgcttgtctgcttccctgcactgcagtctgcaccacatccaaacctcgccgttgggcgttagattcatcactaactaaattaatcatcttgtgctaatcatcgagttaataatcaaagcatcctaccaaaccgcgtcaaacggacgaacatgtagcgtgcggaatccgaaacgggtcaaacagctgcagataattttactgtttattttgttcatacctgagagcataagcatgtgctcacttgctcagcatcagcaacaaatttgacacccttttctttttcagtttttcacaccgcccaactgtgcaagatgaactctagtagtaataattggatcgagtaacaagaagaagaaaaaaattggcggcaatagtaattcaccatcaacctgtctctgtaactgtaacaaatggagaacgaatggatggcaaaatgtacatggatcaagaagaagaagacgaagacgaagacgaaaacaagaacaagaagcaattacaaatcattgccaagaactcatcaatggaggaggatttgaatcgatcgagttcaaaatcacttgcggtagcactcggcggggaagccctgggggaagcgccagccgtcggcgcagtagttgtaggacatgtagttgcgctcggcccacgcgacggtgccgagctcggcgccgtcgagctcgcggtggatccacgccgacgtgccctcggggcaccacgacgacgaccacccgccggcgggattgttgttgacgcacgcgttggtgctgtacccgcggtacgacaccacgaacggcgcgccgctccagtcgatcttgacgtcgccgtgcctcgtcgcccagtagctgccgtcccacagcgtcgcgtgcagcctcatcggcttgctctgcgggtacgccaggtcgtcgtacttcttgaacgtcctcaccggcacgtcgtccacctggaatctgtatcatagcggaagtaatcgtaattcagcaaattaacacgatgattgtttgattgacgaagagaggattattgagttcgtttttgtgatgcgtacatgatgttttggggattccagatgatcttgtaggtgtggaagtcggcggtggggtcgaaccagaggtagaactggtgctccttcttgccgtcgccattagcccagacgttggtgttcatgacgtaggggttgccgctgaggttgcccatgaactcgatgtcgatctcgtcgtggccgtcgccctcgccggaggagaggtagaaggaggtgacggtgccggcggagttgccgccgacgagcttcatctggacgctgaactcgccgaacaggtaggtgtccttggaggtgaacccggacccggagctccggtccagcgtcagcgccacctgctgcgtcttcccgtcgtcgctcaccaccctcacgtggtcgccggcgcccaccacgtcgaacttctcgtagaaccccgccgccgccgccgacgacgccgccagccacgacacggccaccgcggcggccacggacagcgcgagatgcttcgccatggctactgtacttgcttgctttgtctttgggtggtggatgagtgagtggcacggcgagggggaggccggatttatactggcgcgaggaggaggaggaggcgctgctccggcggcgggtggtggtggtggtggcgcggtttggtgacgtcgctgtcgggtggggacgaaggcttgtgggctgtggctaatctactacgttaacaatgataattagcaaataaataaagatgattagcgctaatgttgggaagtttcgctacgtgtcccaaaaggcagagtaccggtgctctgcaaaaagaaagggaaaaaaaagaaagaaagaaaagaaggaagagcagagtcagtcagtttgagttgctctgtgttcttctggagggggttgggaacaccttcgttcacatgcaaaatggagtgacgaattaacacatgattaattaagcagtagcttaaaagatttaaaaataaattaatatgatcttttacactaacttttgtataaaaaactttttttaaaaaaccacaccgttcaatagtttagcagacgtgtatacggaaaacgagagaggtgaggttagaacctcaatgaagaacacaaatttggttccaaaattaggatcggagaatctcttggtgacttgtatgattgcagccgagtgccgacacatactgggggtaaattaacaacttccaaaatgtgtacttttttttttgagaaactgtttcattggttaggtgtatacatgctggaccttttgagtcatctggttggtgccgattgatccaaattcatcagttcgtttggttggtgccaattagtccaaattcatcagttcagttcaatgggttggtgctaattaaatccaaatccatcagtttaagtattggaactatacatctggattaattacaacatattcgtaataaaaataattcaagtttaaatgaagattgagataaacaatttatactatgaataagataaagcaccttggacacaagtaggggaaacaagaactgaaaacaaacttaagcaataattacttgtagcttttttaagataatgaatagaaatttgcatgatgatatttttagcttcacaaga

SEQ ID NO: 871 - DNA, 1782 bp, Oryza sativa
ttccccccccccccccgctcccggcctcacattggccaccgggtgaataacctgagccacccccgatcctgtagaggacccgacagttgagtgggccccgcagctccgatgaggggaagggacgaagggtggttgcggcgtcacgctttgataggcagggcaagccgacgactcgaaggagaaggagagacggagggtggttgcagcatcacgcgctaatagcccagggccccgctgggttacccgagggtgaatataacctcccccaccgccgctcacccatgggtgtgaaacctgacttggcctctgcccccattagggtggggtcctagccccagcagggaaattggcaccctatgggcaattagttaatttttcttatcttttgaattagtttgtggaatgctttcaattatcacacaatgttctaaaatcaccattttatgttaaatggaattataggaaattttcaaccaataatatacttactctgaatttaactaataaaatttatgctcaagtcatgtttatagtcatgtctgtgtgcgcggatgcacgctgcgttcccttctagttacggtaagatcagatcagtcttcgatacaatatatagacaagtaagcacagggttccgaactataattattagctattggactagtctcaaatagagtaaacaatacagtaatgggttgggggagaatggaagcaaagtacggtcacatggcgctaaccatgtgacacatgggaatgggagacccgtacttttagttcgggtaaacttttacttgtcatttctgttatgaaaaaagatgtacaatggagacacgaatttttacgtgaaaaacccttgcgggaaaaaatcacgggcgccgaccggcaatgatcactatagaggagttgattacaaacgtaggatagacatggagtcctactagaaaattaatctgaatatattatgggtccaaaatttggatcacatatttaacaatttctttatctttttatggcttgcagcttgttgtttggtcgatagactttactctccgtcccaaaatatagtaaccttgtactgtatgtaacacatcctaatataacgaatctagacaggatcttcagaaccaaacccggtactaacaatgtttccccactagttcaaaaatgattttcctaggcaagcaatctaataggttgcagatgggccataagtgtccgcgtatgcaaaaatcggccctcattttcgaatacgactccataatagacccgcacgaaaaaaatcaatgtttccaaatggcccacttaaaacatccgcatgcaaaaataagggtattttcgcaagtgggtctcttaactcacccacacgcgaaaatattcgtccaccccattttttattctaccctctccctatctctgtctctcccacctcacacttcatctcctggcttcactcctctcctctctctcccggccacattcctctcctcttctcccacttggcggcgacaacggcggcggcggttggcgtatgcagcggtgacggaaggggtgggcgacgcctagcgccggcctactgcatgctctcccgtgcatggcgagcccctccagcggtggaggcgcgggatccggcgggcgggggccgtcgccgcacggatccggcggccggctggtttcccccacgggctcaccctcgacggtagtgtgcgtggccactcccctccctctccatctatctcccctccccttccctttcttaccttcctgcgtggtcggagggggagcgcc

SEQ ID NO: 872 - DNA, 5496 bp, Oryza sativa
ggtaacttatatcaatcactcctaattgatgaatggttgatggttgtgtggtgaaggatggttcatggctagttgctagttgatgacaattagctgctctattcctcttcctattccgttggtaacctacatcaattactcataattgatggttggttgatgattgtgtagtggaggatggttgatgggtaattgatgagaattagttactctattcctcttcctattccataactcttactcttcatcttccattcctcctataaaatgagaacggatttgatctctctaaggagaagtgagacacactttcatccatttccaaggctattgctgctacggtaatcccatcccgacgagtgtgtgcacatgctttgggagaataggccttcgaaaccatgcactgctacgacgtttgcatggacgggtgggcgattaggttttcggggagcacaaggcgcaactactcactgttcgtcaacgtctacttcgtcttcaccaacatgtcgaacactggagacaacggcaacactagagacaaggagaaggaggcttctgtcaacaccaacggtgacaatactatctcaaactccagcggagaaccattcttggggtataaccttcttacattatttcaattagaagttttacggttaatattcatcgcaatgtaaacattgcgttattatgtgattgttgatgcttattctacattaagcatgctcatgttgattacatgctactatcactggatcaaatcccattgtaaataacatgtttattatcttgttattttggagtaaaatatgccgaattatgatcaaatttccaacagatatttggctccaagggtcatacccgcctgcggaaaaagagacccaacgtcggcaaaaatgcctttttaagtagtgcttgcttcgtaatttctataaaaatcctgcaaaatagtgtctatgttttaaaaggagtaaattgcacccacggttcaacaacttggcaggtgggtgcaatttgatataataacttgaaaaatgaggattctagtgcaacaacttagtaagaaggtgtaatttagtataggaatttataagtgatcgtataaatacaacaacttgcaaggtaggtacgattttgatacaataaaataaattaagaagtgtgacaacttaattatttggagtattttttatataaattcaaatttttaagtacttattttgacaatatactagcgtggatttgtataagcatatttatatttttatcctaataactaataactctaataactaataactaaaagtcaattaaattggatgtagaaattattatatttcggttgatatttgagaaggtaaagaaacaaaaaattcttaaaggtaactgaatgtaaattgtatgtgcaatataattcttaaagattaaattcaatattataaggtaacatccgtaggattactatgtattggcatattgacatcgtgaaaaacctcacctagcatatgtttagccaaattgattcaccaaaatactaaattgtcaagtacttgtactagaacgcacccacttgtcaagttgttgcagtcagacgtttaattctcaagttctttcactatatcgcacccacataccgagttgttgtaccgtgggtgcaatttatagattctctaaccacaatccctccgatctaataattcatccactatttagagagtcatcattctcttcggattcacccgtattgaaaaagaacatcaggccggttaggtgcatgatgcagcgcattatcttcttaatacgacgatatacatattcattgacgggagtaataaggacgttactttacaggtcaagtcaagtaaagcatgaacgttatcgaatcctgatttgcttctgactcatgtgttgtcaccgagccgacgtcagcaaaccgcgtattcagatggaatgcacgcgtcttccagaatctgttcttcaggaatctccgtatttaagttcagaacacatggcgatgttgtgcttgaagcagaactagctagctcgatcttgcacttgtctccgacttccttctcgtttttgtttcattccatagctgaagcaaaatggtatgtgttgttcttgaatatttgttgctgcactcggttgtctttctggttcaaatcaacattttttttggtgatgtatatatacttggtagggtgacaagaaacaagtgaagctaaaggttcggggtgcaagcgagactgaggtcaagaatgtacttcgtcaagaattcaaaggtttaattaccatcttgtattttctgttgtcgaaaaggaacgagcaaaactcagaggtgtagagaggatcagctaaaatttcagtgacatacaaggaatttcctttactaatacctgtgttgttcatccttctttctatgttttttagaatctatcgagtatagaaactacagcaaaaatccagagagcagcagtttgaaggtggaggtgcgagggactgtggatgtggggaagctgtacgaacgcctcaagaagatggcatccagtgtcaagattgaatcggttattccggtatgcatgtactatttgcatcttaattgatcttgtgcaagattgacgggtacatcaattcgttaatatatcttttgggttattgtttgaatctttcatgcatccaggatgatgtaaaggaagaaatagagagatacaagaaagaccttgaaagaatgaagagacagaaggaagatctagacataaaactaagggaaaaaagggaagaaaaaaaagttcttcaggccgacaaaacagctgccgaggaagagcagaaaagattgaagagagacaaagaaaatctcaatttaaaggtagacacaaagaggaaagagaacaggcgtctcgaggaggagaacaagaaattgcagcgaaaaattaaggatctcgagcaaaagcacaaggtattaagctaaatccatgctatgatgctatactgcagggtacagaaatttcggaatatccccccatctccccccgggcaagcaaatgtctcatccgaaattttcatttaatttctttcaaaagcaatcaaaatttggtaaaattccaaataatttattgcagaaaaacaacgaagttcctggaattttggtttttacgaaattgcaaaccctcatgctacagacagatgttgtacattttgcctcagtccatccaagcctgcattcgtgctgctgattttcctcttcttttttggtctgcagggagggacatcaattgagtatcacggcgtggaggtgcatcagaagatgaatcatatgcatcaggaggtacacatgcatgaagtcgttcgcaagcttaagatatcggacaacgatcatggaaacgctaatgggagggggcatggacaactcctgcagcagcttggccacggaagaaattgatccgcttataaatattaccaaagctagatatatgtgtgtgctttgtgggtgccaacctattttggtgtatggtttatttgcttgtgtttctcggttgtgagttttttctcttccataacatgtctaataataaaacaataacaagaaagctgcattattaggaaccgttttgttctactgaatgtctgagctgagcctgaaattgtaatgatgtgaaaagggcaatgtaatgtaatggattgatacgtcaaacgttttctcatgttcggctctctcgggtaggattattagacggcatccttaaggtagtgtttggttctgagactaggtgggatgggatgaaaccatccatgattttgaggttgggatgattccacttgcgtgtttggtttatagaataggacgatcccagttttttgtttggttgaagggacgagggagggatgggatggacgccgtttgccaccactgacgacgccgtttgcaacaaccatggccgccgctgcctctgccctcacctctatctccgccaccgagctgcggtcgcgaagggacgcgatgcggcgggtgatggcgtcgaccttcgcgcggagcagccatggctcggcgacgatgatggcggcgaggtccgcacgggagagggagagggacaggctagcgacggacgacgacgacgacgacgccgagagcttcggggacgacgacggacggccgggccgccgccggatccgtcggcgcagccctccccatcgtcggatccgccgccgccgccttccccgccacaggatccagtgccgccgagcccctcgacgccgccacttccgagcttgtcgccaccgtcgcccgagccgtcttccgtcagcgcagccctccccatcgtcggatccgccgccctggagccttccaccgtcgctcgagccatcttccgccacccgagccctccccattgtcagatccggcgccgccgccttccccaccacaagatccggcgccgccgagcccccggacgccgccgctgccgagcctgtcgcctaccgccgccgtggagtctgccgttgtcgcccgagcctgtcgccaccgccgctgccgagcctgtcgccgccgccgtcgatgagctcgccgccgtctcctgagggcgagcagggtgagcgcgcgagcagcgtcatcacgccgttcgctcgtcccaggtgggacgagtttgtccgccagttttggccggatgagttggtcccggatctgagaggaatattcctttctagggaccaacccatgccactcacccctaaaccaaacacccctgaaagtgggttcatcccatcccatcccacctcatcccaccaaccaaacactacctaagagtctccaagacaagtcaaactagcttcaattatcaacccaaccttgcatttctgggccaagcagatctatttggcctttattttatcagaaagtgtcttaattaattacatcatccttacaaatatgatggtattctcattgctggcagcccgttggagccattggaatactggatgttccatctctcgctctaactacactattcagcacgtggactgaacgaaccaagcatgtgacgctactcaaaagaaagcatttttgcatacaactaaaacctattttttcatgcggtaagactgtccgtctgcccgaagatgtttgtaaaaatcaatacttttcctacggttggtgcacccgcacgcaaaaattaatttcacaaaaaagtgaaaatccaaaaaatcacatccgccgtctccattgccgaagctgagcacagctcatcatcgttgtcgtcaaagcccgacagctcctcattgtcatctgtgtttctgagtccccttcccggggaactccccgccgccgaatccacctctgtcgcacctcccaaccgccaccgccctccccattaccagatcagctgccactgaggtccccaccgccgacgtccctcccaattgccgccgccctccccgttgacagatctactgcctctgtgctccctaccgccatatccaccgctgccgagctacttgcggctccta

SEQ ID NO: 873 - DNA, 487 bp, Oryza sativa
ccacaagcggcggcataataggccagccgtgtaggcggaggacccactcggccggcgacggaggcaggccgccggtgaagtcgtagacgcccaacagcggcggcataataggccagccgtgtaggcggaggctccactcggcggcgacggaggcaggccggcggtgaagtcgtagacgcccaacagcggcggcataataggccagccgtgtaggcggaggatccactcggcggcgacggaggcaggccggcggtgaagtcgtagacgcccaacagcggcggcataataggccagccgtgtaggcggaggatccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggagg

SEQ ID NO: 874 - DNA, 1070 bp, Oryza sativa
aggcgcgcgccaagcacacgcgcggcgcacatgcgcggcagggaggcggctcgggcttggcgcggcttgggccgattggccggcccaagagaatagaagggtaggcggcctgggaaaaagaggaagaagaagggagtggcccgggagggaaagaggggcccaagagaaagagagggaaggaaaaagagagggaggaggaaagaacttcggccacgggccgagggagagagagaggactttgggccagacttggcccaaaggaggaagaggacattttttagatttttttctttttaataaactttgttaattgttgttgttgtttaataattatttccggcgctctgaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgaattttatttcgggatgaatttatcaggacgtgacattgggcgtctacgtcttcaccgaccggcttgccttcgccgctgccgactggtgtttccgcctgcatggctggcctttatgccgccgttgttgggcgtctacgtcttcaccgaccggccgcctcgtccgccgccgactggtgttttcgcctgcacggctggcctttatgccgccgttgttgggcgtttacgtcttcaccgaccggccgcctcgtccgccgccgactggtgcttccgcctgcacggctggcctattatgccgccgttgttgggcgtctacgtcgtcaccgaccggccgcctcgtccgccgccgactggtgcttccgcctgtacggctggcctattatgccgccgttgttgggcgtctacgtcgtcaccgaccggcttgccttcgccgctgccgactggtgtttccgcctgcatggctggcctttatgccgccgttgttgggcgtctacgtcttcaccgaccggccgcctcgtccgccgccgactggtgttttcgcctgcacggctggcctttatgccgccgttgttg

SEQ ID NO: 875 - DNA, 1079 bp, Oryza sativa
tcatcatattttacaaagcagtcggtatatcacttggatcatattattcagggattcacaccgcatatgctacatattaatattaagtcgcttggttgactataattatcaaaaccactcggttggttggattatttattccttgactatatgtttggtttgttcgattaaccacattgtcgggggttacacctattaggtgcatctagtcgatgcacctgactatatttttcagccctccacagtcttcagatttggtaaaagtactcgggagaccatgacgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtggggggaggccctctagggggcatatatatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacgagcgcgatggaatcaatttcatgaagtcgcggacttcgtttcgctttgggagtcttcactttcttttcggcgaccacttctttaagcttctttttttttacttggaccaaaataatcaaggggaaacttaatctgaattttatcaatatttaacaaaatgaattttaaactcaaaataaactcttgctattttttggtggtggtcgcatataaataccccgcactattgaagggaatgacgcttgtcat

SEQ ID NO: 876 - DNA, 8292 bp, Oryza sativa
ccaaacaggagtagggtattacctctcattgagagggcctgaacctgtctaaatcctttgtctccacatccatccacttttaggtctcgtgcgctaccccgttttattattgccgaaatcatgtttcgacatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaacaattacaagcagagttgcttaagttaaatcttgacgctattaattatggagaattaaatactttggagttgaaacctacacatatggatcagataagagagcatcaaaaagatgacccagaaatacagatttttaaggaacggaaggtgcgaggaaaggctgcagatattaccgaagacctagaaggaatattatggtacggaaatagaattgtcgtaccacaatcaggaaatctaagagaggtaatactaaaagaagcacatgactcagcctactctttacacccaagcaatacaaagatgtatcatgatttaaaagatctatactggtggccaaacatgaaacaacatattgcagaatatgttgcattatgccatgtctgccaacaagttaaagcagaataccaaaagcctacaggattattacagcctttacaaatacctgaatggaaatgggatgaaacagaaatggattttatcactggactacccaaaacttcttctcgatatgactctatatgggtaatcattgatagacttacaaagactgcatgattcattcctgtgaaaacaacttacactggagcacaacttgcagaactttatatgacaaggatagtatgtttacatggagtaccaaaaagaattatccccgatcgtggtacccaatttacttcacacttttggtagaaattgcattatgaattgggaagttatttggattttagtacagcatttcatccacaaaccagaggacaaacggaaagactaaaccagacattagaagatatgttaagagcctgtgctctagattttgctgctagttgggacaaatgtttaccttacgcagaattctcatataacaatagttatcaagccagtttaatgtcaccacatgaagccttatatggaagaaaatgtcgaataccattgatatggacagaaaccggagaaagaagtatattcggaacggaccttttaaaagaagctgaagaaaaagttcgacttattaaagacagacttaaagtagctcaatctcgacaaaagagttatgcagactctagacagagagagttaacttttgacattggagattatgtatacccaaaggtttcatctttactagggataaagagatttaaggtaaaaagataaactagcccctcgatatattgaaccctatcaaataattgctaaacatggagaagtagcctatcaattggctttatctggctacttatcagacgtataccctacatttcatgtctcgcaatcaaagaaatgttgacgcattccagaagaagaaatatcagtaagtactgttgaactgaataaagatttaacttatccagaatatcctatcaactgaataaagatttaacttatccagaatatcctatcagaattttagatgaagtacatagaacaactcgtactaaggcaataagaatgtttaaagttcaatggaatcatcatacagaggatgaagcaacttgggaacgggaatattatttacaattggaattcccgtatctattcgaagactcctaagcaaatctcgggacgagatttctttaaggagggtaggtttgtaacatccttaaattttaaactaatatttgactgcatcatgctggttttaatcttagactagcaaaatcaaaattttctttaaaagttctctttttattcttgattttggttcaagtattacccctagaattcccttaacctagtttaccaataaaccataaattgttgccctatcttaaaccttagtgaatttagcaaatttccttcaaattccaaaacttagaaactttctctagattacccttctattagtgagacattgttatagtgcataatatttgcaaaactcttccaaagatctctagataaattcaaaatattcaaaattcctaaatagttcttttgggccgaaatccttttctctcccttccagcccttctctctgtcttggcccaaatcagcccacagtcaaaccgcgtcgtcttcctcctcctctcctgggcgccgctggattgagcgccaacgcccacagccaacgccgtgccgtgtccatctaccgccgcccacaactctctgccgccgccgtcgtcttgccttagacgctaagaaatcgccgcccaacgtcagcgccacctcatgccactgacgtcagccgccgaaccgaaccgacatgcccagccaatcaccgaacgaagccggcgccgctttcttccgctccactccaccggcgccgtgtttcccttctccctctcctttgcaaaccgacctcctccgcctataaatagccgacgagatcatccttccctcccccacatcactacatcagagcttgaagctctcttctctctctctacttgccatgtccggccatggctgccaccactcgatctctcttatcggagcattgccggccaagccctcgcgccaatatatttgcctcgacgaggagaacccatttcacccctttcccccaacccttccaccttgagttaagccaccaccgccagctcccaaatcggccgaaccaagcacttgccgccggcgttccggtctcctccctctccctctccgccagccaccgccctccataggtgcgtggcgctcgggaacaccacccaccgacggcgtcgtcgccttccgcccgccggagagccagcgcccctcctctccttctcctctgttgctcggctggaaagagaagaaaagaagagaggaagaagaagatgagaggagagagaaaaagaaaagaaaaagaaaggaagattgacaggtgggcccttcaacagtaaattttcgtaattttcctatttaatgtgaattccaaaatttagaagcccatatcttttaaaatataaacccaattccagtgaaacttggaccaaaattcttctaaaatctttctctattttttgaggctatttttgctattttatcattttatttcattttttcctatttttggattttattcgaatttcttttgaatttgaattttacaagcttaaccctaggtcttgaggagtctcctaacctattagataatctcaatcaatctcaggacatcgagcaaggcaagttactatctaccttttgatcatttaagcctatattttacaaattatttatttatagccttctattcaacactctattttataggcataattcaaccatagaacccagataatttagtattgcttatcttgcttacaatttggttaaaatattttatacttagattgggacagtacgtaagaattggatgatttccgggtggctagtactgtctcgatcgatatagttattaccaggtagttatgtcaaacgaacgggtacgactgcagtttctagaatggggacagacctagttattatgttaattagcaatatggcacctctgtatagtggttcttatttttaagtcctcgcgtatgaggcaactatagccgtgaagggcaacttttaaccattaccatgtacaagtaaatggttcgtgatactcgagtataaattatatggtatattctaaaccctgatcgagatgacgtggtgtcatccagaactccttttgctgcaattaacattacgttcagagcatatgaggatataagttcatggaacaggtgccacaattgttaataacctaatactgggccatgactaaagctgatgattatcagcaagtcgtggactgcgggtaaagcgtacatctgctgcagtagaatatcattaaaactattcaaatagccgtgcacacggaattgagtatcgggactcatatggtaccctggttagaaacctaaagtatatgttttacaaactcttgctttaatatttctagattgtctattattgctttctgcaaagaactccactccatgccaacgcataacatatttccatggtaacttgctgagtattccgaatactcacccttgctcttattaaccctttttcatatttgggtcaagaggaggacccctgtgattattattatgatgactgataacttagaaaatccctagaggttataccttcctagtcagaatgtactagaacttccgctgtgtaatattagcacatatgtttaattaggtaagtacctacccttgtaaaacccctagtattgtaaactttaacgtatgcaatgaagaaccagctgtattacatgtatcaatatttattgatccagggattgatacattaatcaaagtcggatccaagttattagttttgggacccgacaagagccgttcagagtcgccggttccgttcgccggtttcggttgttcattcgagtgttcccgtgtcacataaaattgactcgttgggtcagtatctcgtgaggcccgctcacccgtcaggtctcctgcaggggcgagggcggctcaggttattcacccggtggccaatgcgaggccgggagcgaggggaaaatgcgggggcgttcctgcccaacccggtccagccccgccccgctgccacccctaattgccattgggaacatgtaccatgttcataccattacttgcctggtatcccacatgtacattaattaaaatataaccatcaggtttataccatggtcactatccctcgctcagctctcgatcagtggctaacctacaatctctgaatatttttcagacgtgaacagtaactgaagaactgaaacgaagaacagagtttttttggtgctgcgtaaccacctgcagcttttctgatttctcttcaatttattccctcatcttgtgaggttgttacatgcataacaaacaccgatttcaccggatccaaacgagtgaacgcgccatccgacgctccagatctagttctatcgatactaacagaaaaaacgggaaaaactcagctgcccaagactgaatcttcctgggacagccgttacaatgcatgcagcatcctatgcctaagaattcaaacttactaactgaaatcaaacaaattattgcaaatgcacaagattatcttcaggctaacacgctaacggtatataaatagggacacataatatgtcattgtttatagagtcaactgattaaaaagatagatcaggttagcattgagtgtgagctataagcctgttgggctaatgaaatgtaaagcacatgcatagacgctaattaaatgtaaagcgtatgcagaaacacaaccggccactaagttcagatcttgtcccgtgttcttctttcagttgtatcttccaatatctcaggcttagtccgtcagtgatcaactgcaaagtgcatactcgccatcagattccaagagcattcggtacgccctgtctatttctcgtaatttatctggttttgtgtcctggatttatatggtttttttcatcaatattaattcttgctcaactaacacacgtgttagcatcagacgatgcctggatggatggttcgcacggtgttcttgctcaattcgtgggtaatccgggcgttggtagtattcagcttcgcagcgcatgtcaccatcatcttcttggccggagtccgccgtcgtagggctatcggcttgccgataaccatcctgtgggcggcgaaccagctgggccggtgggccgcgacgtacgcgctcagcaagctcgccctcggcagcacgacgcaggagctggagctggagctggtgacgctctggggggcgttcctgctgctccatgccgctggtccggacaacatcaccgcctactccttggaggacaatgttctgtcgacgcgccagaaggtagaaatgatcttgcaggtatcaggagcagcatttgccatgtacaagaatatagtcatcagaagcgggtccggtacgatggtctggatctcttctttcatgttcatcatgggcatttttaagtattgggagagggcgaaagctatgcagctcgccaacctagaaaacttgcgaagctcaatcaagaagaagaaggagacaaggagacgacgaagcttgagaaatattaggcgtccaagcagttcaaagcatgataatgacgaggaggcactgctggttgctcatggcctgctcgacatcaccaaaggcgccttcgtcgattcttcaatcaacgagcatcaaatccctgtctatgctggcaggagacgagagatatttcctaagagtggctgggggatgatgtacaaggtggtcgacatggagctctccctcatgtacgacattctctacaccaaggcggccatggtgcacacatggcatggctacgccatgcgtgccgcctctccgttcgccacatccatggccttcatgttgttttggtttgacagcaagcaaggtcagcggatgaccgatgttttgataacctatttcttgctgggaggtacagtcctcctagacatcatatggcttctcagagcagtggcatcaacatggacctattcgttcctcaatgataggccacacctgtgggttcatcacgcgtttttgtgctctgggaagtggcgccagctccatcgttccattgtctccctggatccgtcgttgatcctcgccaaggaaccaagtagctacaggaagtggtctggaaaaattggacagtataacttgttacacaagtacactcatgacaaggacgaaaggaccagagattacttgagctatgtggtagagaaagtagcatcggaagacatctcgatggagtacgaataccacaacttgaggggtattcatatttctgtggatttcaagaagaacttgttggattgtatttgggactatatgtatttagcatacccagttgaagacgtggaggagaagaagaaggagaaggaggagaagaagaagaagaagaagaagggaacggcggagaagaagccagatccgccgatgaagccggctgagcaccacaatattgagaacattcggaaattggaagaagctctggattttcttcctgaatttcaggagtccattcttatcatgcacatcactacgaatgtcgtcttcatgtacactgaatctgaacaaaatgcagaatcgtccaagtccaaagacaatgtggaggtgaatcaaggcattgtcggattacatgatattccttatcgcggtgcgacccaccatactacctggtctcaagctgcgcagcctgtatgaagctaccgaggatgctcttgccaaaatatggtctaagaaagaatcttcccgctgcagctccagatcaagacaaaagtgtcttgctgacatcctgcgatgcatggagaacaaaaggagagagaaaaggccggataaatccgacaactggaggctaggctacaggacccggaactggcaaccagactatacaaccgacctttacagcattagtattgttctgtccgatgggattaaactagctgatcatttgctgcaatggctgcatcgtaattactgggttaaatttcccaaatctgaatactcgtacgaggcaaaatttgcacagatgtttccgaaattgagaaaaatcctgaacgggcgctcgatgtacgactaccccgataaatggtcgcgactgctggaacacatcttcttagagtgggtgcgtctgctgattaacgcgtccgtcaagtgtacaagagattctcacgccaagcagctgagccgtggtggtgagctcacgaccgtcgtttggatcctagttgaacacgcgggcgtatttcgcgtcgaccgtcaaaagagatgaaactgtttgatgctacaattcctactgaatcgaggggttcatatataagttgagatgtctgtcttctcttgtcctctgtacctgtaaaactcaaaactcaatttgtagatcacagggttctcaattatatattacctgtacaatctttttctcatcgatatgataaatctaccatgggtccaaaatattcaaaaatatagcctttacttgtttctgatttaaaaaatcccaaaattcaaacgggaggctataagtttaccaacaaagatgtcaggaaaattttaa

SEQ ID NO: 877 - DNA, 11646 bp, Oryza sativa
gcccctgccgctgcctcggctggatctgttcgcgggagccaccgccagatccgccgcgggagaagcttgggacggagggggaggagagggggtagaggatcactggatctgcccagcggaaacgccactgccttcacctccgccggatccggccacgggagcaccgatgccgccgccgctgtcgctggataagcttggtggcaaagggatgggagagggagtagaggaccgccggatccacccgtcgaaaatgccattgttgcgtcctccaccggatccgcccatgtgagccgccgacgccaccgccaccaccggatcggctgcggaaggagcttgggggcggagggggactgggagggggtagaggacagccagatccggacagtgggagccgtcgacgccatcgcttccatcagatgtaccgccggtgagggatgtgagagggaaaggaggcggggaccagagagagagaggaggggatggcgggtgggggacagtgacagagataaaaagaggcgcgggtatatgggtggatataaggataaggactgggaccgattggctcgtctcggatttttggtgttggattattaaaatccagtataatatattataggtgtcggttgttttaaaaaaaatggcactatagtatttatgtcggtcctttttttttcaccctgcaggaatagaaaaagtctataggtgccagttttagatattccggtatttatagtgatgtatatactttatgtgtttatgtagtagtgagacttaggggtcaaaatttaccaaccgggactaaagatggatctcaaccgggactaaagatgggcatctttagtcccggattgctactcccggttggaaacccgggactaaagggggttcccaaccgggagtaaaaaaggtttctccaccagtggtagtgtgaaactggaatactgaaacaattgaaacttcaggatataactgcggtttcgtactatagtctatatatgattaagaatcaatccatatgttaggatacacgtgtgtgtatatatatatatatatatatacatatatatatatatatacatatatatatacatatatatatacatatatatacatatatatacatatatatatatatatatacatatatatataaaatatttgaaattgcaaaaatatggaataacttatgataatttctgtgaaaaatgctaccgcatggaccacttgttaccaattgacatgttggctgtcacttgtcatgaaaaaatatagtctgactaccaaagaaacatggtggacttggtaacaatgttatgagaacccctttatctatttatatgtcaagtgtgtttttatggatgtgatagcaatgttgaggatatgtgtgctagccactgatcatgggcctgtacgtacagtgtacactccacgtatttggcaattctatcccgggtgccgaaaaaattagtactttgataaatgtaagaatcataattatttatgtattatgtttacattattgttcctaattcttaaaatcacaacccacgatgaattcggctagctgggttcgtgattctcagtccaaatcatcgacccagggtcatcgacctgcatgacatggagtcatgtccctcgaccgatactttcgaactgggatcatcgtcccagctttatcaggatcgtggtccataacggtcgattggcgtcccgaggaggtatactcccgtcgtaccacacttttccaagtgtcgctcctcgtccgtcgaccctgttcctcgacccagtcgacccatatttttggtgactatgccttgaccacagttgtcgtggtcgcgtgcggtcgaggtctcacgtggactgccacgcttcgtctggatctgtgccgccgtcgccttgatccggtgtcagaacgagcccccaccatcgccttccagctcgtcgtcatcgctgagccttgccgagccctgccttgcctcacctcgatctacccatgtgtcaccgcctggattcgccgctaagccccaccgagccttgcctagatctgccgtcgagccctgcctcagacccacgccgccaagcccgtgtgctgccgagcctcacacctcagatccgcacgcccgagcgccggcccctgggtgtgtcgtcgccccaagcttgagagcgacagagatcgagagggtgtgagggagaagaggagggaggagagatctagagagaaaggaaatgtagctaagggagaggtaggtggctgtttttttatagggcctttagtttattttttatggcggccagttaagagaaccgcttggaaaaatctatttttataattataaaaataaaaattggcttataagcttataagcggtgctcttatctggccacaggaaaaaaagttatttttacaagcggtcgtcttaaaaaaaccattcgtaaaaatatagttttgcaagcggttattacctagggacctccaattgcatcttcacaaactttcttattttcttaggcgaaataaaaatggtgactccatgaaaatatttttttaagtaatgtaacttctcaacgatccaaaaattaatctctacttatactttttttttcatttcgatatagaatgatgcctatattggctgacaaatttcttccaaaattacacattctacataagccaagtctttggcggctgtcagaaatactatacctaccttgcaacctactccatgcgtctgcttgtgatccccaagatctagactgctcacagtgcacagatgcctgtcaactttacaaagattccgacatcccacaaatctgtccaatgagctgactcctttaacgatgacaaattaaggataatgatgatttggcaacaagtgtgccacagatatgctaatgatatccacacattgtccctgttgcgtttctttagagtcgaactaattaaacgccgaaagttattccatatttttttcaatgaaaaatgtattatataatttgtcctaacataaagattatttaattagcctaaggattgccaactagaaggcctagaaactcagttattttagtccccatgtttcatactactaaataaagaaaattgaccttggtttttctttagtgtcgtggtgtgtttgtgcttatgttgactaaggatcatgctaagaaaagagtcaaacacatggcaaatgggcactgatatgatattttcataagttgatatgtattagtaccgaaatgacaagaaaatatttaaaaagtggatatagaaaaggagaagaaaatccattcttcagttcacaagaagatttgtaatcctcattctactgttcatgtcgaactatccatcgcatcacgcatgcgactgatgatacaagcagctgggtcagcttatccgctccaggtggggaattgccggctagccaagtgagaccgtgggggcaatgggccgaaggcccatctagaccagcaaggcagggagggctccgaggttctctcgtgcagtgcgtgtctgccccagcgagtatgtagaatatacgaaaccgatacgatgacggtgttgtacaaaaatttgagataaaaacacctaaaacttttataatagtggagataaaggaataggttaaattgccggtccacacgtaaactgagtgtagagaataattgagaaccctgcaaattagttaattactccctccgttttcatattataagatattttgactttggttaaaatcgaactacttcaaatttaactaaggttatagacaaatatagtaatatttatataaccaaattagttttattaaattaataactaaatatatttttataataaatttatcttggtttaaaaatattactattttttctatgaacttggtaaaatttgaagcaatttgactttaactaaagttaaaacatcatataacctgaaacgaagggagtagtagctacaagtcgatcgagttacacaagtacacacaggagaaatgaaaaaaaaaagttctaactaaaggagatcaaatgaacacatcaatcagagacgctatggatatctgtcagtagcgagacacatgaatgcctagtctatcgtagctatctgctggtttcctcttcgtcgtctttttcacacgaagaatgcgagcgtgttcagcgaggatccacacaacggtagtgagctcaccaccacgagcaagctgcttggcatgggaattcctcgtacatctgatggacacgttaatcaagagacgcacccactctctgaagatgatgtccctcacttccttgggcatttgatactctaattcagtctcagtcgcctcaccggatttcatcaaatccggaaactgccgcttaagtttgtcttcgagtactttgttgtctccaatttcgatcttagaaccaggtttccaatttagcagaagattggctagtctagctccgtcagatagaatataactcgagtcgtaaagaacacttagataggcacctggtgacagtatctcagttttgttcccttgatgccacttgaatgttctcatgggtgtctttccattcttcttcatctccttatcaagcagacttttggcaagacacttctctctcgccatggagttgttgaaggaggaagaattttttatctccttccattgttcacccaaagcatcaaggagagcatcgtaccggctactgagtgcaaggcccgggagcatggtcggtcgcaccgcgacgaggaacatcatgtaatccgacaacgccttgatcgccttcccccactccgattgatcttgattttgaccggattccgtgtgaaagaggaagatgtccgtggcgacgtgcaggacaagaatggtctcttgtaaatcaggagtgaaatccagggcatcgtttagttcctgatcaataccaatagtagctttcgcagcagcctccgcagcaaccgtcgcagaaggaaacggatcctccacatgtatccattttggatccgataactgcacaggcggtatccgttcaggaaacgctaactccatgtttttccaaacacggtcaaacagcttgttcctgaaatctcttgaaatatgaatgcctctcgagttgtggtattcgtactccatccatgcttcttccggtgcattcttcttccaccaagagctccagaagttgctggtcttctcgtcctcctcccgagtgcactccctcaacaagttatactgcccaatggttcctaaccacatcctgtacctagttggtttcttattattggcaaggaaccgaaatagattcaaagagaggatgaatcgacggagcatgcgccatttccctgagcacagaagtgcatgatgaagccacgatcgtggcctatcattcaggtaagaataggtccatgtggacaccactgctcggaggagccatttgatatccaagatgacggcgccacctagcaagacgtaggtgattacaacgtctgccgtcgcctggccttgcttgctgtggaaccaaaacagcaggaatgcagttgctccgaggaatggagaggcgaaacggatggcgtagccaccccaagtttgtaccatgactttcttggtgtagaggatgtcgtacatgagggagagctccatgctgacaaccttgtacagtgtctcatcccaggtaccagagagtgcctcttgctcgtcatcactccttttgtccaaaaaatccatgaaggcattcttggtaatatatagcatatcatgagcaatgagcaggatctgctcatcatccggcttcctgcctccccggctagtattttggaggctgctgctgctgcttcgtcttctcatgttctccttcttcttctcctcctcctttcttgagcttctcatgttctccaggtttccgcgctgcagcgcgtagtatgccccctcgaaatacttggcgatagccatgaggcagacaaaggaggaaatccagagcatggagtcgccaggcatggcgaacatattcaggtacaggatataggcaggcgacacgggtccaaactgttatgaacgacgtatagaaatatgaagtaaacgaaaaacaatcacagcggagacacacgatttaacgtggaaaacccctttaatgcgaaaggggaaaaaaccacgagcaccagccagcaacaatctcactatctcaagagttttgggttacacgcctatggcggcttacaagagaatcaagtctccacgaaaccctagctccggcccaagcctccggcttaggcctccgctccgcttcgtcagaagcccggccaatatcttgaagtgaatttagaacaactccaacacaaacacctgagcaatcacatctaccttctgtcgcagcgagaggacgctgtcttccaaggcgtaggcggcgatgttgtccggcctggcagcatgcagcagcatgaacgccgcccagagcgtcgcctgctgtctctcctggaccgtgctgccgatggttattatgcccagcgcggcggtcggggcccaacgggcaccctcgtttgccacccacaggaggaatgtcgccccaccggtcgcttggcggcggcgaactccggcgaacaagacgaggacgacatgagcaatgaagctgagggctaccactccccggatcgaaaaaagaaagtctctgatgaacatcatggtacccatccatccaggcatcgcccctgctaatgcatgtggttaggacgtaatttataaacaaactagacgtacgtcaaacaatcaaccaagagacgtacgtaccggccatgcgctcgttgaatctgatggcgttacagttaatttgccactgatggactacgcctgactggatagtatatatcactatatatcaagctggttcgaatctacaagggctagaacaacagcaaacaagatgtgcactggtgccttgggtgtacgtgtttaacaatgcttgtagcaatccaggtatacttatagggatctgggcatttcattagtatctcgatctgttattgcacgcttacatttcattagccaaaagtgctacttaatatgctacagggcatgctagcattatgatcaaaccatttttcatacatttgcgctattctaagcaagggtgtactagcgcccggtttagttcccaaaaatttttgttttgggtgtcacatcggatatacggacacacatttaaagtattaaacgttgtctagtaacatgagcatcaccaccatattagagaatatatgggatcccagttgcttctgccacatttgtattaatttgctaaaactcctcttttccacaacctccaagtgaatatagttagtagttaactactctctccatcccatatataatcacttttggattttgacacggttttcgagatactactttgacttaaaagtaatatgttttaaatagaaagaactgcatattaattatgatagtttgtttaatgataaatccagtaacatcaattttacttaattgatctttttttatatttttgttattaatagtcaaagttacaaatatttgattgggcactatgctaaaaatgattatattttaggacagagggaataatttcctggaatgatgttctcttctcagaatcatagagaaggaatgtttgttcttcatttcattttatcaaacaacatttcaaattacagcatcttaatttacaccgggttttaatattactgcagaaattaaaaacattttctgcgtgcataatgccataatgacggaaatagaactacttaagtttcggacatactccctccgatccatccaaaaaaactcaacttctaaagtttaaattttattttaaaaaaccaaattctaacatcctacctaccctcagcatataaaacgagaagttttatctcttaaattccctttacctacctattaccattgctacttttttcaataataagagatattttgcttatttttactcttcactattttctccttgggatgtgctaggaatagacttttttttggacggcgagagtattctaagaacataaacatttttttctgaactgaaaaaaaaattgctgcaaaaaatatattctgccaggtgggccgacagataactaatatttcaatccagcatttaaaatctgatcgacgtcctaacgaactaattttaggctgttcttcccctctttttctaactcatctgcctcgtttttcgcgcgcacgcttttgaaacttctaaatgatgagtttttttttaaaagtttatatacgaaacttactttaaaaaaatcatattgatccagttttgaaaaaaaaagctaatacttaactaatcacacgctaataaactactttattttccgtgttaagaatatgggttgccaatccaggctgccgaacacatattgcctgttgataaataattggtgttcatctaattcggtaaagcatcgacctccttaattaattatcaacagcttcgactccacatattgcaagagtggcgaggtagttaataatacacctgccggtagggatgaaacggtcggaaattgtcagaaacggtatattattttattatttttttgaaaacaaacgaaaacggtcagaaaattttgatatttatgaatttatctatttaatgtcaacttcaatgtcacactgacataaattaaaaaaaataaattttaaaaacggtaaccatcggtaaaaatattattattatactagttctgtggaaatcataccgttttcacctctaagtgccggtatgccccgcacacgttaactgcctcgccggcttatacatcctcgggtgtgagtgatttccctgtctccacgttaataatacaaggctcaattctccacggatgcatgcatctagtatggttctacacaggccggtagaccatagtagttgactatatatatagtagtagctgctagcttatgttgtttgtttttatatccagctcccgatctaatttttttctccttttcttattcatttgatttcttgcatatgtgccatcacatatatttgagtgtcagctacatgactcactcttagctcctaagagcaatgtcaatagtgtcacccgctaatggctgtaaaaatgactacatcagtctcttatagatattactaaaagctaatatatataataagtagatttacattgactattatttatttttttaatctttagctagcttccccatctaattttttaattttattgccgttgtttcgtccaaccattactgaatcgtgtcagctcgcgtggacccacaatcgcatgtcccaatcaaagctagcctggtgttgctacacttgcgttgggacgtgtgagtagccggtgataatttagtcgcagactcacgctctctctcctgtctagctcattgacaaatccgatgtggcagttttattgctggctaaacaggtttattatactttctctaatgcatataatcgtaggttgcccatggtacatgtaggtactaggtctaattaatatctaacaacacaaattctaattaatacctaacaataccgataccgatggatactagcatatctatatgtaccaggcgtgacacatatgggtatatccgatactcagctaccaagtctgaaactgatatatactgtaatggtacctacgataccaaacataattcatatgggtattatatttgaaacacgtgggtatcatgtttgatacctatatatactatatatgatatctatcagtatcagacatggtatatataggtatcaagtataatacttaccaaccttgatacaataatactataagataataggtctgactaagtatcaagtatgatacaagataatattagagacgataatatgggtatctggtccaatatcttcgatgttacattattatcatctatgcaccgtatggtctctgtgctctaggaagagattttaaattaattaaactaaaaatagtaaatagaacaaacaagtgtttcccttgttttgtgcacccgacagaatttatttgtagcaattgagctcatatatagctcactagctcaatggacacaagccaaaaggcccagagttataaaatccatctattaatctaatgaactaactaaaaaattcacactcacagtctaaaattttctcagattaatcgaagaaaggaaaaaaaaagggtttgagtaggtacacaattcaaagcatctgaaattcggagtaaaaaataaaaacaagagtcaacctggaaatacacactgcaggaaaacccttcattagtcccggtttgcaacccctttcgtcccgggttgcaatccgggactaacgatgctagcgccaatgttttttttctttttttattgtttatttgctgcttgcattttgattttcccaaatcgagttgctccctacgtatccctaaatcaaagtaacaacatctcaaatcatatatttacatcacaaattctcaaaaaaaaatcacgaattctaaaagaaatacattacagatccaatgaaagacaaattctaaaaaaaaaagaaagaataacataaaaaaatctagcgctactgcctcccgccaccctccgcccacctgccacctccctcccatccgcccacctgccacctcccttcgatccgcccgccgccaccctcccctacaccagcccctgccctcccatccgcccgccacaaccctcccctccgccagccgctgccctcccctcccgccgctcatggtgcgccgccgcgcaccaccgctcgccgccgcaaaccaccacctgccgtcgccctccgcacaccatggagagggccaggaagggaaggaggggatcgaggagaggggagggccggggaaggttgcctcggagagggccgggaacgagaagaggaggagtggatcgaggatagttgtggatcgaggggacgaggagtggaggaggaggggcatgagtagataaggatgggatgtgtgcgaggcatatgtcactgcaccttttttttttcaatttttgtcccagttggtataaacaactgggactaaaagtgtgtggggccgggggggctgacacggcctaaccacgttttgaaccgggactaaaaataaacaaaaatcgggactaaagatcataaagtgttgtgccgcttttgaatcggggctaaagatcttgtttagtcctgattcttatttaaacaggactaatgtgatttttagccaacccagcaaagatagttacaatttagaaaaataaaattgtattgtggcaagaaatttttaaaaaataataataagataataaaataataaaataggtagaaattctgtggcttggattatagctgtcacatgaatccttcgtacttggacaaagtggaatgcaacaactgccatcaaatgagacatcattctcaacagtgtcctcaaggacaaggacacaaggtagtaccaggatacaatccaaggtagcaagtactaatggagcacctacgtaccgttggacacaagatcatgactaattaataaaccgtacactgggtaggtgtcacaagtaatggagcacctaccattgaacacaagagcatgactaattaataaagggacaatttaaaccatgccacacaaattttacaaaatttgtgatatgc

SEQ ID NO: 878 - DNA, 5504 bp, Oryza sativa
  unsure (1)..(5504): unsure at all n locations
tatgccaccctgacccacatgtcattgactcatgtgggtcttacatgtcattgagatacgggtggtatatctcaaattttgtaaatatagggtggcatggttccaacaaacccaataataaaccacactgtacactgtataggtgtcataagtaatggagcacccaccgttggacacaagcagcggatcgatcagtgtcacaacctacgccagctttcaggagatcccgactaataaaccacgggcctgtttggcacagctccagctccaactccacccctccttgagctggagctcagacaaacaatttcagctccaccaaaactaggagtggagttgggtggagctctctcaaaaaatgtactagagttgtggagctgggtttaggcagctccacaactccactccagactcaactcctggagttatatttaggagttggagttgtaccaaataggcccgtgtcattgggacagaagaaattctggaagaactactcaatgaggcataataacaaataggtaaaacttgctatagaacattcaaaaaacatgtaatttgctatggaacaccgtaagaacgtgtagctgttgtaggacatcgcaaaaactgataattagctgctggacacccgtgacattattttattatttttgaatgaataggagagagaaacaattattaaggacaagttcgccctttgctcaaatcaatccaccatgggccccacatgtaaggccctctttccagatgggacggtggggcggcgacgagcggagtagcaccggatcaagcaggtatgggacagcgggcgtagcggcggaccaatagcacgacgccacgtcgttagccgcaccgcgcgcgttcctcgcacgcaccttgacagcgagccaacccactgttcctgcgtgcgcatttgaaaccgtgtgggccccgccttctcctatgcgcgacacgtcgttgctcctcgcccgtgccatttccctcgcaccgaatgcgagcatgccacgcgtcctagcgtggagaccgcgtccgcccacgcctgcctatgggtcccgcgtgtcgtacgactcccgcgcttgcctcgtgaatctggggtcgccatgtcgccggctctgaagaagagaagagaataaaagagaggagaaagaaaggagaagcaagaagaagagtgtcatgggcaattcaggactctcaacgctctttctctctctattttcatcggaaatagtaaaatatgtcacgagtgtacaccagctaattactatatttctacagtacccacaagaaaataagcattctttagatatctcatagctaattacacattttttgagtgtcctatagcaaattttgccgaaatagttgaggaccaagttccacttgaggagcagaacctgcaccaaagacatagaagtaccaagatcgacgtacaaagacctaaaaaataaagtcagtggtacaaagctactacgtagctttcaaggatcgacaccacccctagttcttagctaggttgcccgccgtagttctcccatagcttcccttattttgaatcttcgatcgggtcaagatttcttttgagtgggtaggtttataacaccccatttttctcatgctattaaaaactatttaaataaaaccttattgtgaaagtttggatctttgtgtctgatcaaggatctaagtgccaaagatctcaaaatctctctttgagacccaaaatttctttccaaactcaaatcttgggattcaaattttgaaatttgaatttccctttgttctttccaaatctcccaaatcctgaagccatcaaatgtctccaacaaaaacatcaatttttctttgaatgcccttccttgggctcctcttgagtttatgagttcaaatgtcaaatttaatttgaattcaaattgaaagtcatgatcatcaaattctgttccaaactctcccttgaaaattcccatgtgctactgtccatatggaccacatcatcctccctctttccttctgatcctggcctgcaacctttttatcctcctcctccgcacggcccatcactctgtctctccacggcccatgtcctcgcctcctcccgcgtgctgcttgctcactcacagccaccatgcacttctttagtgtgttggccaatagaccaggcccaccctgcgcccgatagcggacgcgcggccgtcccctacctgcccaccgcccgttcgacgatgcgagtgtgtgtcggccaccgagccatgcacgaccacgtctcctcccacgcatgcaaggctccatcctaggggtagcaatgcagccacattcggcccccagaccttagggcaacacattcacatcagtggtgccggcgcattagcagccatctgtcttgccattctcccttctccgatgagctcccgttcccattccttcctccttcctctccttcccgaaaataccacaaccaaccatcactgtcccgagcctaatccccacccccaaataatcgccgctggcgaccaaaccccgccaccaccgaaccacttccccctcttgctgcctgccatcccccgtaccctcttatccaatccaaactgtccatcttcatcgtcgaccctccctcattccattatcgtgctctgtttcccctcccacgacgccgttcgctgtaaaaccgccagccgccatcggtcgtcgatacagtcctaggtcaacgcggacccagaccaccgatgcggcgtggttagccatgcgctgcctcactcactgttaacaacgaaattttgtatcagattcggagaagaaggaacaagatcgaagtggatttgatgaagaattgagttgagatcaaagttggaccgcgcattggctggcatcgttattgatggtcgttacaaaccaaattcgacggtcaatataactaaaataaaggagaattagctatgcttgcaatgcatatttgttttaaaataatatatttctatttgtacttggattctatctatctatagataaagagatcaaaattgnagagagcccggcagcaaaacactcgaacaatcattcagacgctgtcaagaattagacttgtggggaaatgggccagaaactcagaattgacatgatcaaataggcccataactcactgatttggattgaggagccaaagagaagatggcttgctgaacagggggcctgttgggccagcccatgttcagccgaaccataggcccccttagcaccgctggatgaagggttttgatctgacggtggggatttactcccaatggcagttggagggtattactaacctttccaactgccacaaccgttattcttcagctataaaagggcttcacctctaccactccttcacacactcaagcaagctcaattatctcttctacactttagtttagtattctagtgttaagtggagtagaatagaatagctcccggagtcatcggagtcttcggaggaattttggtatggttgtaatagctttccttctttcttttgtaagactttaacaattgatgaaatattcttattcatatgctctcgatacttcagttcatctaagtattgtttttactttatatctgtatcgatacaactgtatagttagcctaccagcaaggtacaatggtgtgggtttaatgttcgattattcggttgctctatgttatctcgagggatgtagagtattatttaataatgtagacgtggtgtctagattattaagtatcattatctaggcatatatggtacgggttagtcgaggtgggccgctgatggtgacagctcagtacgggtattcctccacgatagtatatattcctaagaaactttcctagggagggtactccttcgtatttagccccggttggacggccatgacaggttgtcgtaaggaactcgacaagccgcggtggtctctcgaagcactaggagggcactattagggggtattggctatatagttgtatactagcagatgtagactaaagttgggtgtatattataattataggaatcgattgtttttctatttcttcttccacttagtttaggaatgattaaatgagatacatgagtgctttgcttcgtgtcactctacccatataaatatcttaacccctacttagactttgattatgcaagtggcatgtatatatattattagcatagttctctcttacaatcttcccttgggattaaataaataagatactttcgaatactcctgggtgaaatgctacaatggtatatccgtgcacttgcaggttctttctgtaaaccatatatatactaggtccatttctagcatcatggctaggaatttatatttctagtagtatcattaagaaataccaataagcatttttggcgccgttgccggggaagattaataaagagattactataagctaataatttatacacaccacctctgtatatatcactgtcctttgtaggctaaccttggttgttttcacttttcgtgtgaaaatagggtagtgcacatctggtttcaacttgccggaaaatttcaaagacaatccagagtctttcttctagaatgttaagccgcgagttagaaaaatcacctgaccaagaaaccaaccatccccgcgtcaccgagcttgtagagtatggccgagaagacactccgcgagttcactgccccctcagctgacaacgtgcccgttgggccgcaagtcaacttgtgagatgcatactttgatttgaagaccagcctcatcatgatggcgcaggctagcccattctgtggcaagcttaacgaggatgccagtgatcatctgcaaaggttcctggatatctgcagcacgtacactatgaaaggagtcagcccagatgtcgtcaggctcaggctattcccattttcccttcttaggaaagcgaagcagtggttctatgccaaccgtgctacaatcaacacctgggatacatgctcaacggcatttctatctaaattcttctcgatgggcaggaccaacacccttcgcggaaaaatttcaagcttctagccgacgagggacgagtcaattcctgcagcatgggagagactgcaggagtaagtggtcgcctgtcctcatcatgggatggacgatggctgatcctgcagagcttctacaatgggctcaaacctgcatcctgcgaccatttggacgctgctgatggaggggccttcttctccaagacggtcaggggaaccgtcaagctaattaagaagatggtctccaacatgggctggggtgcagaacgactccagacccgccagcgaggcatgcacaccgtcaaggagacggaaatgctcgctgcaaaattggatctccttatgaaacggttcgacgatcaagagaagaaaccttaggtcacgtcaaggctatggactcgtatatgacatgtgaggtctgtggcagaacgggtcactcggggaatgactacattgagacccgtgaggaggaaatgttcatggggaacaaca

SEQ ID NO: 879 - DNA, 4766 bp, Oryza sativa
gttttcgcgcaagccaaaaccactgatgctcttagcaaaaagctggccacctatgacaagatcttagagaacatatatgttaagctagaaggcttccgcattccaaaaccagctaagcttcaacaagatgatagagatacagctggcacagttagctgctctagtcgctacaaatgagtctaggaggattctaggacaacccgaaccttccttagagtatgttaaggcgatcaccatgagccggggaaagtctactcgggatccgccatatcctaaccctgcaggaacacagagcagtaacaaggaggcatcacctgctagtccggctgataccgacaaagcagctcaaccaagtaaaatagtgccgcaagagtactgcgacacatcggctgcttccgtttccccaaagatacaagaaaccgttagtggacgagcagttcgctcgttttgttgaagtaattcagaagatccacatacacgtgccgctgctagacacaatgcaagtacccacttatgcacgattctgaacaaaagagatcgctgccaacaacggaagtggtcatgctgacaaaggagtgtagcaatgctatactctaccggcttccggagaagaagaaagatccaggggtgtcccacgattacatgctcaatcgggacacaactattcgaccaggccctctgcgaccttggagcaagcgtcagtgtaatgcccaaagaggtctttgacaagttcaacttcacggtgttggcaccaacaccaatgtgtctccaactggccgactcgtcggaccgctacctagcagggattgcggaggacgtgccggtcaagatttgagacttcttcatcccggtcaatttcgtggtgctagatatggactcggataaggaaacaccgctcattcttgggcatccgcctctgagcaccgccgaagccaacatagacatgggagtaggcagcaaacgtttccacatcaacgagaaagagaattttgagtttcggctaaggatgaaacaatgctccacggtgaggatcaagtacgggccgaatccatagaatattaaagaggtctaagtgaagccgcccaagatggataacctcatgcattcatgaagaacttcctagagaaggaagtgtcaatgaacaggccctgtccaaagaagacaccggtgaaaactagtgcactggcaaagcagcctgatgaagcatgtatgcccccgttgttaatttggtaattaatgacaagcactaattgtggactaaccgttctattgagttacatattttacgttaggatcacataatgtgtgcatatggatgattatcgcggactaaaattgatggcgcaaaccaaaaggaaaagaagacggtaaactagtgttttaattgtaaattgatcgaggagttgtgcgatcaaaatttgctagtttatttttagcttcgctatactattatggggtgtaatgacctagacaaagagatgatcgaaatgccacattaggtcatttgcatttagacttgtgctcaatttatatacatttgagattgtctgactagggccggtctgaccgaggcatagatgccggtctgaccgatgggtagcggccggactaaccgtcgggttaaccacggtctgaccgcccccctggaggttggcggtggtgctttggggaggggatccagagccgcagccggtcagaccggtagcacactgagttgggagatttcgcccccgacggctagttttggttggtgggagtataaatactcacccaccagcaacaaggggtctctcttggcacttgcttcacttgcatacaccccttgcatctctcccacactcaattaagctttgtgttcatgcatgtcacacccagagttttcccttcccttagatttcaaatcactaataattgacttcaagaatttgctttggttaaccaggataaaaccctagttaacgatacatttaataatcggaattgtcagggagaatttttttcgaattctctttgctctgtaaaccgctaacaggacttaaagagtaaatatcagatcaccggaggcaatgttgctaagttaaaaagtgtcaagctaatctccttcctttacctttggtcgtgaattgtgcccaattcactcccctctcagtccgcactttccttttgcatgacgaaccgtattcgtgtcagttcgtgggatcgtttcttttcctttcctaaaacagcatcgcattgtttttccttttcgggaaagacctagtctcccctagtttccatttccctccccctctccccaaccagccatgccccctcccctactcgcatgcgcgcccctcctcccctcttatccggctccctcccctcctcctagtcctacttcctctacgactccaccattcctaatccaaccctctcctatatgtgtgtcctccccttgtttttttttgtttttcccgagtcctagtcgcaagccgccaccgccgcttgctgtgccgccgccgccggccggtgccgccgccgccgtcgccaccgttgcgtcgccggtactccgttccccctcccctttagatgtatttggtcctgcactcatcaattcatctatctaattccttccgttcaatcttttccagcgtcgtcgtcgtcgatcccgagctcgccgccagaaccgccgccgccgtcaccgtcctttctccgctcatcgttgttctccggtgaggttctccgtccttttagggttaagatttttctgttcctagcgtttgtgtcatgtgtcgttgccctatccctagagctgagccgtcccgctgttggcggttattaaatgccaattttataccgccaacatctgcataaagtccagataataaaacatccaacatagtgataggtgttaaatctcacatatttcacaagtgttaggaggaaaatcagactaaagtgtgggagaaatatgtatccatacaagaatggtttgtgaacttcatcaaaatacaaaagaatcagtccaacactcccagaaatggatagaggaggaccaggggaagagatgggtcgaatgccaggccaggtgggcccagcccaggttcggccgaacccgagccaggggtctcagccgttcaagctggggtttggcatggacgtcccagattactccctgatggcgattgcggggcaattcagacaattcacataaggataaccgtcatacgtacctctatataaggagcttcactccttcactcacacacactaccaagcttgagctgaattgtaagaggctctattgtactatattgtatactagaataggaagagagtagagtagaagaagtcggaagaattccggagttgtcggtaatcttctctcatttattttattctgtttattactctgatttcaatagagttatcttcctgagtaatttagatttatcttgtgagatttatctcttggttagttcctaaatagcataggggattattgttcactataatcaactaaaatatagtgattgctttagtgagttataagcactaaagtagatcttaattgcttagacgtggtgtttaggtaattgttatccaataattgatgtgtatcccgcagtacgtttgaggtagatgtagaggtggtgacagccctcgagatcacttaagttctccctgtccgggtacgtagtagagcaacatctgggaacagtgggttgccagtgcctgaagtattgtgttaggattaaacttaagcttaccctagacacactgattctcactagtaaatcctctctatactagcctatctttgcttggtgtccttggatgaaccggagaaaaggtctgatcacatacgttcccttggattcgatacccatagaatagtccataggggaagtgctacatcggcatatccatgcgcttgcggatttctatctgtgaccgtaagaattaccaacaagcatttctggcgctgttgccaggtaacggttgctgatcatttccgaacccagttcatcctcgtatctcttttcattttctattctacctttacccctgctacccagagaagtattcctgtcaaactcttctcgactatggagcaacctctcttcgagctgtctgttcctaggggcgaattctatgagccacttccttcattggagccaatttatacatctggctatgaaattcgccccgaactaatcagtatggttagggaaaactctttctggccttgatctagaaaatccctaccatcacatataggactttgagcaagtctgctcatgccttcagattcgtagcatgaaggaagaaactgtatggtggaaatttgtcacgcccggaatttctatccaaaattccaaacgcttacatgtgtgtgaaccctcgtccaggaatcagccgaggcacacaataacaaattgataatagagtacaattattactctaattaataagcaaataaaatgtcattacagaggtagatagttcctctcaatcaataaagatctaagcagcggaaaataagataaacggcgcagacggctccactccacaggcagcttgaccaaggctacacctaatcctccacaccatcagcatcattgaagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagtt

SEQ ID NO: 880 - DNA, 720 bp, Oryza sativa
tcagatcaaccatcccggctgcatagttctatctccaaaccaggaatataccattccaaaccaggagctaataaaattattaccagttatagcatcatttactatggtgagaggtgtgagactaatcacgaaagacattgttagacccgcccattaccgcgggcacggctattcgaatagttttactctgatcagaggtgtaccactgtacccacaagacacaaccccacatcatgttaccatgtgcctcaataccaccacggtacctcggaaaggagttgtgacaataccccttgcataacacaatccactgcagcgcaccttcctggatcataatcaccgccttaaaaacatggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcataaagcaatagtgagtcataagttatcccaaaagtgagctaatgtttctaagcagggctaagcaattaaatctaatatctagtt

SEQ ID NO: 881 - DNA, 7970 bp, Oryza sativa
tatgacgcaataatgaattatttttgaaaaggaaaaggaggattattgcgtcagcgggctagggtttcggtggaccgggcgcacgggcgacggctcacgcgaacggacggccgagatcgacttgatccaaaacggacggccgagatcgaacggtccacgaccggctcacagcaaacggccccgatgacgtcggcgatgacgtcaccaccggcggcggcggctcgggcttgcatgctcgccggcgaatgacggcacggcggcgcgaacggaaggcaccaacgggtagagcgcgacgcggtgaactcaccggtgaccaaaagagcggcggaagatcaacggacagcgacggcgacgaggaggaagcggcggcaaacttcgggtcgtcggcggcgacggtgctccggcggtcttcggcggcggcgaaggagcggacgaggacggcgacgtgacggcgaccacgacggcggtctacccgagcgacagcgacgtctggaacggcggcggcgcacggctggagcgacggctacgacggcggcgctaggttgcacggcgctagagctcttccggcgacgagaggcgaaggcgaaggtggcgacgggtagaggagacaccggggaaccttttaaaggggctcggaggcgacggcgaaggcccacggcggctggcgatgagaaggaaggtttagggttcggaggagagagacgaatccgattcgacctcgaatcaaacactttccaagccgttttagccgatgtttccaaaagggaaaaggtagaggagatcccgaggatcatttcccctctatcaattcggccggagaaggaaaggagcggccggatttggaagggaacggcggcagcgcggcgctagggttttgggaggcggccgacgcgaggaagacgacgacttgacaggcgggccccacctgtcagcgagcgagggcgcgcgcgcgcgggcggctgcggactgggccggctgggccttgagagagagaacggttttgtgccgactttcggcccatagccaaaagagactttttcaaacctttttcaatttaaattattcatgaaatgcaattccatttattaaaaatagttccttagctcaaataaatctcagaaaaatctaggaattatagaattaagcaaagtattaaatgaaattttatctggccccattttatgttggaatttattaattaaaattagatcttctcttcaagacttttaaaattatttctaaaaattccaattaaacaacaatttatatattttgaattttcagggtgtgacaaaattgtttacgttctcccttcatgagagagtgaagcaatggtacacatctaccgttggatgtgtaaacggtagttgggaaaagttgcgagacagattttgtcttgctttcttcccagttactcgtattacaaccctttgagtagaaattctcaatttccggcagattgaaaacgaatccatcggtgtagcctggtccagattcactaatttagtgtagtctggaccaaccttatccttacccgactatgtgcttttgcaacattttcatacgggtctaaataaggaatctgcattctatctagacataaccgtcggaggatcattcatgcacaagatgccatcagaaggaaaagtaattctagacagcattctagaaaatacttccttcatgacgcaatgcgatgaaccccagctagaggcatccgtgtccaagatagaggaaccttcaacaatcgagtcacaacctgaaccttccacctctaccgactcgattgatgaaaaagttcccgagccatccgttgagactgaagaaattcagactccggatcgtgccgcaatcatgttcagggatggttttgatgaagactatggtaacaccctgaactacttcggtaaaaagaaaccactcgtccccttgccacctcccgatcctatggaacttgggttcctaagagaaactgtccgggagttgaaatctataatgagtgacgaatggctaagggagacagagctttcatctgaagtaattcaggggcataagccaaacgacttctccttctggaccctttttcttcaactgaggtttgattgaattaaatcctgtaaaattcataactaattcaaatgaagtcggaatgaggccgttcaagtctctaaattcatctaaaatcatgatctacatgtttgtttactttttatgtactatttatttggtttttcttagactttttcctcgttttgcgtgatatcttgtcttttccgtcgttacaatggtttgtgagtgcgtcggaagtattcaagaagattaatggaagacctattgttgcaaggcaagtcacacagatcctaaacacaattcctttgagcatgttgatcctatatttaaattatctatttatttcaactgtgcatttattttagaatgtcacaaggtggtgtgaaactattccttcgttatggccaattcgcattgattaccctattccttgataccttgggttataatttgactagttgaactttacatattggttcaactagatattggtataattgcttagccatgcttagaaacactagcacactattgggatgattaatgtttcactattatttatggttatattgaatgatagctcacgattgtcaatcgtgattggttaattaattatttgccaacttaaacttgacaatggtgggttgtgagcatatagttttgaagatcgtgctcatgacaactaaggaccggttcgtgagctattgttgtgagacattaaccgtgccaaccacaagccagcatgggcaatggctttatttttttgtataccatggttcattgttgtgagacattagacgtggtgtttaggtaattgttatccagtaattgctgcatatcccacaatatgttttaggtaggtgtagaggtggtgacagcccttgagattacttaagtcctccctatccgcgtatgtagtagagcgatatatgggaacagcgagttgctagtacctggagtattgtgttaggatgaaacttaagcttaccctagacactgtttctcactagtaaatcttctctatcctatatatatatatatatatatatatatatatatatatatgcttataccaaaggaagaagtgccagtggtacgagagtatctggatgtatttcctgaagaactaagtgaattacccccagatcaggaaatagaattcatcatggagttacttcctggaacgacacctatatcaaaaagaccttataggatgccaattaatgaattagaagaattaaagaaacaaatagccaagttagaaagaaaaggttttattcgaccaagttcttcaccttggggagctcctgtgctatttgtcaaaaagaaagatgcaagcttaagaatgtgtgttgactaccgagctttaaatgaagtaactattaagaacaaatatcacttgccaaggatcaacgatctatttgatcaattaaaaggagctagtgtattctctaaaatagatcttcgatcggggtatcatcaattgaaaatcagacaagaagatatatcaaagactgcctttgtgacaaggtatggattatatgagtttacaattatagcatttggactaacaaatgctccggcttattttatgaatctattgacagaaaactaatcttctctccaacgctgatgttaccaaatttgattgttaacagaatctcatgaacaatatatttatggagtatttggaccagtttgttgtcgtgtttattgacgacattcttatatacaccaaaaatgaagaagaacataaataatatctccgattggtactggagaagttaaagcaacgccaactttatgccaaattctgtaagtatgaattttggctagatcaagttgcattcttgggacataattaccaagaatggagttgtcgtagatccagagaagattaaagctgtgatggagtggaaggtatcaacatcggtacctgaaataagaagttttctaggacttgctggatattatcggagatttattaaggacttctccactattgcaaaacctattaccaaattacttaggaaggacaagaagtttgaatgtacactagaatgtcagagtagttttcaaagattaaaacataagcttactactacaccagtattactcttgctagacatccaaaaagattttgagatctattgtgatgcttctcgacaaggattaggatgtgtccttatgcaagaaagtaaaatagtggcttatgcatcaagacaattaagacttcttgaagaaaattatccaactcatgacctagagttagctgcagtagtacatgcggttaagatctggtgacaccacttgattggaaatcattgtaagatctacactgatcacaagagtttgaaatatatttttacccagacagatcttaatcttcggcaaagaagatggttagaattaattaaagactataatttggaaattctataccatccaagaaaggccaatgtgatggctgatgccttaagctaaaaagcttattgcaatttacgacaggaaatactgtcaaaacaattacaagcagagttgcttaagttaaatcttgacgctattaattatggagaattaaatactgtcgaaacatgatttcggcaataataaaacggggtagcgcacgagacctagaagtggatgtatgtggagacaaaggatttagacaggttcaggccctctcaatgagaggtaataccctactcctgtttggggattagaatccgccgggtgtgtattgatctgacgatcaggttgtctcatgccccctagagggcctcctgcccaccttatatagggtgggagcaggattacaagatagaaaccttaaccaataaggtaccgatttcctaaatctactttacaatcttatcaaaccaggattttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatgttctctcgaactaaattactctaaagccgagtgcttcaatcatcttcgccatggtctttcgagtacttttaccaaatcttaagactgtggatggctgaaaaataaagtcaggtgcatcgaatagatgcacctaataggtgtaacccccgactatgtgattaatcgaacaaaccaaacatatagtcaaggaataaataatccaaccaaccgagtggttttgataattatagtcaaccaagcgacttaatattaatatgtagcatatgcggtgtgaatccctgaataatatgatccaagtgatataccgactgctttgtaaaatatgatgagtgtaacctaaagttggctacattattgaaaattcacatagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgtagacatattaggcctaggccaaaaaatatgccttcgacaccctttaaaggatgacgcatgtaacatactcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctatcaatgaagatgaaagcacccagcgataaagttggtagccatggcagcgaaataattgacgtgatgaagatgacgatgtcggcgatccagttaatagcagtgtcacaactaatgataatgacgaagacgctcatcagcatttgcatagtaggtcaaccgtgaaggtgaaattataagtcggtgaagacataatcatccattagcaacagcggagatgtcagggccgatgaagcagaggtgctgttgatgatgtcagtgataataattcatcaaattaatgttatagctgttgtagatgcttcacttggaggagagttgatgctgtagtccaactcgtctaaaccgaaatatttgatgttgttgaagtagaatgtctgctccgaagcaaagatgaagataatgactcctggagttgacttgttggttgatgaattgatttcttcagcttgacataaaatttgtcaaattttgagccttgtatttgtgtagcccccgactctttgattagttgggaaacaactgaatatagagtcgagaactgtagcttcttgtcgtcgaatagtcattgcttgattgaagatatgtgttgaagatgtccaagtagaaatccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagcaatgaagatggtaaggccaatcaacactggcagaatcatgcagccatggaagtgcagaaaccagtcggcagccatggcaaacgtaggcagcttgtgttgaagatactgatgcctattagtagtgactgcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggagaaggcaagccggtcggtgaagacgtagacgcccaacaacggtggcataataggccagccgtgcaggcggaaacaccagtcggtggcggaggaggcaagccggtcggtgaagacgtagacgcccaacaacggcggcataataagccagccgtgcaggcggagacaccagtcggcggcggcgaaagcaagccggtcggtgaagacgtagacgcccaacaa

SEQ ID NO: 882 - DNA, 1774 bp, Oryza sativa
ctcggtgatggcagaggtggccaatgtgggaacaaagtcgtccatcaataacaatgaagacaccagtcggcggtgacgaaggcggtcgacggtgaaagcgaagatgcccactaatggcggcataataggccagccctgtaggcggagataccaatcggcggcggcaaaagcaagccggtcggtgaagacgtggacacccatgaacggtggtgtgaccaaccaaccgtataggcgaggacaccagccgtgcaggcggagacaccagtcggcggcgacgaaggcaagccggtcggtgaagatgtagacactcatgaacggtggtgtgaccaaccaaccgtataggcgaggacaccagccgtgcaggcggagacaccagtcggcggcgacgaaggcaagccggtcggtgaagatgtagacgcccaacaacggcggcataataggccagtcgtgcaggcagaggcactagtcggcggcggcgaaggcaagccggtcggtgaagacgtagatgcctaacaaacggcggcataataggccagccgtgcaggcgaagacatcagttggcagcgacgggggcaggccggcggtgaagtcgtagacgcccaacagtggcggcataataggccagccgtgtaggcggaggcaccaatcggcggcgacggaggcaggccggcggtgaagtcgtagacgcctaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacactggtggtgtgaccaaccaaccatataggcgaagacaccagtcggcggcgacggaggcaggccggcggtgaagtcgtagacgcccaacagcggcggcataataggccagccgtgtaggcggaggcaccaatcggcgatggtgaaggcaagccagcagtgatgatgaagatgcccatcaacggtggaggtgacgtacccgacgacaaataaaacgggtcctctgcgtcgaactatggtaggtgcaggtcattgccgtggccgtgtatatcatccgcacggctcaacctcaatccaaccaatatatgcaaacacagaaacaccaggaagagttgattagcgatcaaaaatataaatgcttaatatctcatatgcatggcatgattagatgaattgtgcacgttgatccatgcacgtgttttgatggcatgattttgctagccacgggagctgataaggccgtgtcaattgcttgtcgatcaaatgctggtgctttttctttgcccgagtcacagcaaggctgaaagcttgacgatccatgatcggactcgccaacaatcgacattaaacagaagacaaaggaaagtcaggcattaacccgtgattagtcatcaagaataaaatattgataatcaatatagaccagaaggattaaattaaccagggaagggaaaaacagactcggactaatccggtcagtatatccatccggtggcttacgcggccttcaacatcagacacccggtgggtgaggttcgcacgacatctgcccagctagttggctcggtttcgccgactcgacctcccggtgacatgtctatgtgaattaaatcccggtcgccggcagtcccgagtgcaatcaacaacaattgatccgatgttctggttgctggtcgtctcgatct

SEQ ID NO: 883 - DNA, 742 bp, Oryza sativa
tggtcacaccaccgttgttgggcgtctacgtattcaccgccggcctgcctccgtcgccgccgattggtgcctccgcctacacggctggactattatgccgccgctgttgggcgtctacgacttcaccgccggctagccttcgtcgccgccgagtggtgcctccgcctacacggctgacctattatgccgccgctgttgggcgtctacgacttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcgtgccttcgtcgccgccgagtggtgcctccgcctacacggctggcctattatgccgccgctgttgggcgtctacgacttcaccaccggcccgcctccgtcgccgccgagtggtgcctccgcctacacggctggcctattatgccgccgctgttgggtgtctacgacgtcaccgccggcccgcctccgtcgccgccgactggtgtcctcgcctatgcggttggttggtcacaccaccgttcatgggcattcacgtcttcaccgaccggctggcctacgccgccgccgactgatgtttccgcctgcacggctggcatattatgccgccgctgttgggcgtctat

SEQ ID NO: 884 - DNA, 850 bp, Oryza sativa
ataaaggccagccgtgcaggcggtgacaccagtcagcggcggatgcggcggccggtcggtgaagacgtagacgcccaacaacggcggcataataggccagccgtgcaggcgaaaacaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggtataaaggccagccgtgcaggcggaaacaccagtctccggcggcgaaggcaagccgatcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgctggcggaaacaccagtcggcggcgacgaaggcaagccggtcggtgaagacgtagacgcccagcaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaa

SEQ ID NO: 885 - DNA, 1009 bp, Oryza sativa
gatctttactcccggtagttctcaacaaccgggaccaaagatatctttagtcccggttgttgtcatcaaccgggagtaaagaccttttcccgctatttccaaattctttttaaacccagttagggttaagaaccgggactaaagattatagcactgcatattattttcgcttacatatgtgtttctaaaatagaagttaatgcattaacattatttaaagtacaaagattaatgaaaattactttgaaaaattatttttgtctgtaataaattaagtggataaatcataataagcaaatatatgacttaaaattaataaaaattccaataatcatatatacttagcatatgaatgatattattaaattggtaaaaactctaattaagataggtaatgtacatactgcatgatttagaattaataaaaattgtaatcatcatatatacttagcgtaggaattatattaaattaaatgttaaaaactctaattaacatatgtaaatgccacatgcatgatttaaaccttttaaaaattcaaatagtcatatataagtagcatatgaaagatagtaaattaaattgtgaaaaactctaattaacatctgtaaatgccacatgaatgatttaatacttttaaaaattctctagtcatttataattagcatatgaatgatagtaaattatgccatacatcaatagatttatatggataatcaatacatccaaaatagtttacattgtgtacacaataattacggcattacatcggcggtgacggttgaccgcatgtactttctcctcactattgttccctccttgtgatcgctgcgtgagtaaggggtgtcttcatttgataggaggatgctagggtcaatcgtcaccgtgaaagggggttgcccatccaactgattgtaatcctcgtcagtcttgtcctcaactccgacgatttttcttttgcctgggagaaccacttgacgattaggctcgtcaggccctctgcccttcttt

SEQ ID NO: 886 - DNA, 5041 bp, Oryza sativa
tggcatcaacatggacctattcgttcctcaatgataggccacacttgtgggttcatcacgcgttattgtgctctggaaagtggcgccagctccatcgttccattgtctccctggatccgtcattgatcctcgccaaggaaccaagtagctacaggaagtggtctggaaaaattgggcagtataacttgttgcacgagtgcactcgtgacaaggaccaaaggaccagggaatacttgagctctgtggtgaagaaagtagcatcggagggcatgtggatggagtacgagtaccacaacttgaggggtattcatatttcacaggatttcaagaagaaattgttggattgtatttgggactatatgtatttagcatacccagttgaagacatggaggaggtggaggaggaggagaagaagaagaaagaggcggagaagaagccaaaactgctgatgatgcttcctgagcatcacaatgttgagaacattcggaaattggaagaagctctggattttcttcctgaatttcaggagtccattcttatcatgcacatcgctacggatattgtcttcatgtatactaaatttgaacaaaatgcagcatcgtccaagtccaaagacaatgtgaagatgatcaaggccttgtcggattacatgatgttcctcgtcgcggtgcgacccaccatgctacctggtcttaagctgcgcagcctgtacgaagctactaaggaagctcttgccaaaatatggtctaagaaagaatcttcccgctgtagctccagaacaagacaaaagtgtcttgctaacatcttgcgatgcatggagaacaaaaagagagggacaaggccggataaatccgacaactggaggctaggctacaggacccggaactgggaaccagactatacaaccgatctttacaacgttagtattgttctgtcagatgggattaaactagctgatcatttgctgcaatggctacatggtaattgctgggtcaaatttcccgaatgtgaatactcttacgaggcaaaatttgcacagatgtttccgaaattgagggaaatcctgaacgagcggccgatgtccgaccaccccgataaatggtcgcaactgttggaacacatcttcttggagtgggtgcgtctgctgattaacgcgtccgtcaagtgtacaagagattctcacgccaagcagctcagccgtggtggtgagctcaccaccatcgtttggatcctggttgaacacgctggcttattccgcgttgaccgtcaaaagagatgaaattaactgtttgttgcttcctactgaatcgaggggttcatatataagttgagacgtctgtcttctcttgtggtctgtacctgtaaaactcaatttgtagatcacagcgttctcaattatatatactagccgccaacccgtgtcttgcagaggctatatatcacttatattataaatactaaattctgcattttcattatattataaattttagaaaatgtaatcatatgttactaattgataactttgaatttcgttattaaataaataaaataaaatactaacttaagagttcaagatggatacaactgcttatttattaacgaaatatagatacatcgatttcgactaaagatagacctcataatatatataatgcattatggatgatcttccgtaaatgtattatggcaataaccatatatcctataggaaaaaatataaagaaacatggaatatattgccagataaaatcataagttatatcgttgaacattgttagcaggcgtggaatttacgtgaaacatatggctcgattagctgacacagatgccattgttttcctttgactactaactattatataatacgtacagaaaaaaaatgacatgagtatgttacccacatagctaatgacctaaatttagatcagtttgaaatttgattccagcggttattttggcaacctgaaaatgcatggcatcgaatttgagtaattattgatgctgtgtgtggccgctcgatccaagcaccatctattaaaaatcactgtggaccatagaaaaaagttacagattgcatctggtgctggatcagggggcattgaagagaaacggcaccatgcattaaactcagaagaatcattggaacaatatatataaattaatatgttgatgacctcgggatgctagggaacatggtgattaagcgcatctctgcggagtagtaaccagtgttcccactctggtgcatgacatggaggttgacgttgcttctatatatcatgccatacaaaaacctacaatgtgattatggggaggatatcaataatttagcgttaaagaggaaataagaagaataagcaaattatattgtgcattctttgaaaaaaaatatgttgtgaagtattaaacattttttcaatttttagtttttaatttttatgattgtatattgccgcaacatatcatgttctttgataaaaaaatcagtctgtacgaaataaagcaaggatattgacatgtcctgtattccaatatgtagcaattacctagagaaacgaaacattgtatgtcatgtgaaatcataagatgatccatatctcccggagcattatgaggaagagtgaagtttccactgagttgatgcagatgccattgtcttgcctgagagaagaaaaaccaggcgcacatgatgtaagttctagagcagcttcttgtgtcgtcaagagtcaagacgtacctataggatatatataaacggaaaaaagaagggtatagtgtttcctgcacttgcagttttcacatcatgatgctgatgatgctgcgtgatgatgggatcgatcgaattcgagcgtcgatgccgcataaccaaacaaagttgatatacgaatgaaaagaaaaatcaatgcaagtgccgtggaggagaaaataaatcaaaccatggatttaacaccggaggaacgtcgattacacactagcatgggataggtcatctcaattgggcagaaaccctcatctgtgtcgggaagggctcctgtcacgaaccaaaggtcacagatgtgagaattcatctatgttgggcatttggccgtcacggatgatagctatgtcaatcggacaaaaaaataaagcctgtcaccgatagttttgacccagcagatgagtcaaatcagggccaaactagggcccgccaccgatgagattatccgtgatgggctcatactttaatcacgggattggtatggcgcccatcacggatgactcactcaataaggcttgtttttaagcctgtcacggatgactcatatctatcgggcttaaatttgggtccgacacgaatgaaatcatctcaatcggtcttttatttaagcctgtcacgaatgaatattttaccaaaaaaataaaatttaattttttttgccagcctcaggcctttgctagccatgctggctgcaaagtgaaataagcatatttatatattctctttccaagcaacccattcacacatccattcacaaatcaaacacagtgattacatccacattcacatatccattcaaatatatgccattcacggcaattcacaaatcaatcataggctgtcccttcaaacttccaacttttccatcatatcaaatgtttggacacatgcatggagcattaaatatggacgaaaaaaatctattgcacagtttgcatgtaaattgcgagacgaatcttttgagcctaattacgccatgatttaacaatgtggtgctacaataaacatttgctaatgatggattaattaggcttaatagattcgtccggcagtttataggaggaatctctaatttgttttattattagtctacatttaatacttcaaatatgtgtccatatacgtcaaaatttttttgccaaaacaactaaacacggccttatatttactgatcacacatccattcagcgacatgcatcttcaagagtcaagcatcagaacacgcaaaaccgagttataaattaaacaaatttatatgtaattagtatcgcaagtacatatagaaacatcagaccggattggattacgtatatgtatatacatatatacatatacatatatataaatgtatatatgtatatatatgatatatatatatatatatgtatatatatatatatgtatatatatacatacatatatatacatatatatatatatacatgtatatatatatgtatatatttatacatgtatatatatgtacatatatatatatatacatgtacatacatatacatatatatatatatatatacatatacatatatatatatgtatatacatatacatatatatatatgtatatacatatacatatatatatgtatatacatatacatatatatatacatatacatatacatatatatatataggtaaattaactggtgctacatggtgtatgggctccaagatttaaattgagaatatacccaatttgaatgactatgaaatttttttaaatgtttagatatgaacattaacttctttactaacaagttcaaacaagtttgaactgagtttgaactttttttttgttagattttggttctaggtatataacttccaaacatataattcattaggtatgtaataataaattgtgaaataaagttgagtttgagttgttttgttgttaggtatttgtatgaatcaaattcatatacctaggtatatactcataatttgaaaatttttaaaaatttgagagaatttgtgtgttttataccttggagcccaggcaccatggagtcccatatgggtatcctatatatatatatatatatatatataggtaatcacaggtctttgataagcattgtaaaatgttcaaccatttaaagacgagcaagctatgaattcactctaaagcttccattgattcctaagatttcatctagtatgaaacatgttgtatcctctctaatgacttcgaagttgtctgtgcatccactacttgctttcagcttcactaggtccaaggtagctgacaattt

SEQ ID NO: 887 - DNA, 17495 bp, Oryza sativa
cgctgacaagcttttagttatttcaatcgggcataatattgaggccatcactgatgacaaccatccgtgatgggcctgattgttatctttatcggaccttaattagagctcgtcaccgatggatgttatcagtgacgggcaaagtatatgggtccgattgagattacaaagataatctttgtcgggcctaaactaaagcccatcaccgataggatctcatcggcgacgggctcaaaatacatgcaccggtatatctttctacgcgtacatctttgtcggtgtttattttagcccgttagagataaggatattgtgacggtacgcaagccctaggcacgggaaaggccgttacaaataagaagtaatgtagtagtgacaacaataaatcgatcttagggcttgtttggtttggtgccaaattgtgccctaccaattcattggtaattttgaatagtacttctatatgtctggattggtgccaaattttaccaacaccagttcttaggtagtacaaaatttgtctatccaaatttggtagtgccaaaagttacctaaactttggtactatcaagattttagtagggcaccaaaccaaactggcccttagtgacctgaggcttgttccacactcttcacgttaaggttatacattagttcagaattaaggatgccaagatcaagagatgcgaggtacagagaatcggtgtgtcatgggggctggtggggccgacagaatctttcgagcgatgacctcaaacatgtttgcgttcccatctgctggatttctacaacgaacggagtttacggagagattgatacgtacgaatccgattgtaacctgagagaagatcgatacatgtacgtatacattggatgggctcatacggtacattggatcggctgagaagcggcccaatctattttaacacaggttctcaatacataacatctatggtgattacgatatgacacactagctcaatcaatggtcagatctctattagtattgtcgaaacaagatttcgacaatactaaaaggggtggctatcaagctaagaaagtggatgggtttggagacaaagaattttatataggttcaggccttcttattcaagaagtaacaccctactcctgtccggggatgattccgccgagtgtattattgattgtatgatctgggaaaaaaaatcgtcccgaaaggaacccggacacctccttatataggggaaggggtccgtattacaaaatacagtccatatccctaacggaatatgtgattacagatagaatacaattgtaaccgactaagacctcgggtatttccttgacatacaagttagaaaactaccccgagtcctcataaagatattctatctatatttggtaccatatacccaactaaattataactgtcgtgtagatatgggatatccataatctccacagtagcccccgagaccttcgcagatgacgaaatagccttctcaaaacaaaaatttataatccgagtgcttcaattcaagctgatccagcttgccgagtgctaaaatcaaagactgcgaagggcgaaaataaaacatggtgcatcgagtagatgcacctaattaagtgtagccccccgactatgtgattagttgaaaaactaaacatgtagtcaagaaccgagtggtttcatagcgaagcatgcatggtactcagtaaaatacccagccgactgcttctcaacttgaacatatcaagaataaaaaatacgaaaagggccgagtgataaacactcaaatggtccaaaaatagacatatttgataggaatccgagtaaaaaactcttaaaatgatccaccaaacatgataaaaatcatggtaatcaacgagtctaatagtctaagccatgactctcaccataaccaaattaagcatgtatcatgccaagagaatgactcttaataaattagtcatcccgaatcaacccaaacagcttttgcagcctaataaggcttacaaaaatagtataacaccttcctgtcgggcacctttttgtttgcatcgtgttaattccaaagaattatcaaaccgcattaaaaaggattttaacagcattgggccacatcattgcgagcacaaattgccaaagcaaaagcgtctaagtccctagggatcacaacgggccacgctgaaaataaaagtgggctgaagtactatgtttaggcccaagcccattagtactcccgataccctaataacaccgaagagaaataaaacgtctcttcgtcttccccgccgagactctcgccattttccccatttcctgctactgtacaaaactgcgccggcaaagctagggttcatcaatccgctccaacccatcctcaaaaactccacgaaatctctctacgcgcccacttctccgattcctcatccctttccagccatatctcggaccaaatcagaccatccagttcacattcatggcggaagagagagaaagctacgagagtcaatgggcgccctccgatgtgacggaagagaatctgaaggagatggtggcgcacggccttcttccagcgaaggagatcatcgggtggcgtccggcgtttggcgaagcattcccgacccccgatacgcacgaagtcgtggtatttgctcatttcttctatggcgggttttcccttccaacctcaagatttttccggggaattctaaatatctatggaatcagcctgcatcatctaaacccaaactccatagtccacattgccaactttattcatgcctgcgaagcttttctaggcattaggccacatttcgccttgttccgccgcatctttttcctcaagcctcagccaaacaagaacaaactatgtgttgttgggggggctaatttccaactcaggggaaccttgagccaaaaatatttctctatgcccttcaaaacctcaaacaaaggctggcacgcaaattggttttatgttcaaaatcctgagcctactcttcccgagtactcctgtcttcctccagtttatcaggacacttggaactcactgccaatgggagatgaagctgctcaggcagtggaactgatggagcggatgataaaactaaaagagcaaggtcttcaaggagaacagatcacccgacactttattaagagtcggttagctccaatcaaagaaagatctcgcacagccttcgagtttgacggcaagcatgacccaaaccgtgaagatccagattctctcgactttaaggtcatgaaagaaagcatgtataaaatcttttcaaatgccatcgttgtcagctattcgcacttgctaccagtcgtgccattcaatgctttcaatcctcctccaccggtatgtaatcaaacatttcaacctttcacaaaatatagttttgtctttttgttgaatcaattaacaatgaaggatattacacccaggaatttgctttgatgaagtcggatcccccagtcgttcaacgccgatcaccccaccaccaaaccggttgagggagcgggggtcccaagatccgttctgaagaccggccaaatacctccaatccagccggccagccagattcacgcaaaaggaagttggtgtcaagtgacgacgaaagcgatactgctagaaagcctggagaccgagaggcaaccaagaaactgccgaagcaggctactccaaggaaaaaaacatccagtcgtcctatgctgaagattaggaagtcttccaggtacaaatcatataacagtctcccttgcattgatgcgcacccagtgcggaaataatactgataaccaaacttgcaggaaaccatccgatatagatccttctggaaaagactctgacccgaccaacataggaacaaacttaaaagaaaccgagccaactgctgaggatcagccgagtgacaaccagccagtaaccgataatgtaggatctggtgatcaacccccgactggaaacgagtcggccgaagctggagccggaattaatcaggagcccctgattgaaaaccagtcggacactaggccaagccaagagattccagaagttggagctcgggcagacagcccttgtagacaagacgccagcaacgacccgatgccagggtcccccgttaaggcgcaagagtcgactcgtccccgtccggaaatcatcacaggtaaacaccttgcctaaaaccgtgttgatccaaatgactctgatcaattgtctaacctttgtcaatggatacgttaggaccaatgactggtgatgaagaagaaattccccatatacaagcagctgaagactcgcgccctcccatcctagtcaagtggtgggacgatgataggcaacctcaagaaatcgtaataaacaaacaaaaagaagatgaggaagtatgcttgctgaaaaaggcactcaacgaggctactcgcgttgtaaatgtaagtccattcatgcatagccttaattgtcccctttcatgttttgctgaaacgccagtaaattcatattacagagaatccatctcaggaatgaggcgaagaccgcaactcttgagaaattagtccctcatcttggaactcttgaagctactagaagccagctacatgaggttagagagttcgcgaggaaaactgagcatgatctgaggaatagaatctccgagcttcaagaatctaactatgaattaagtgattcatccaaaggtaaatgccatatctgtctgacgtattcgtgaagccttccttgccatatcgattaaccgaaaagcatttcagtgcaagccgccaggatttccgacctagagaagcaggtcgaggctctggagaaggacaaggccgaactagcaaagcagagggacttggccttaaaagatattgaaggtaatgataactgattccccatgttcttatagccacctggttatacgaatttattcgtgcagatcgcaaaatcaagtcccaggcacagtttcaataggcttaaaggggccagggataaagtcgctaatgccgctaccccactcatccaagccatgttcttcaataacgccggtccgagtacacttgacgcttccgagatcttcgacaagctgagagtcgctccggatacttacttcaagaatatcaaggaggctggaagtatgggagcaagcatggcattagctatgaccaaatctttataccccaaaatcgatattgacgccgttgatgggtttgcagacgggacaagcgaagaaatagccttcaacctcatcaatgatgcgcgaaaagccgctgacaagatcgctgctgacgtagttgagagattccaagatgttgaccttcggccgactgggtctgataattccgatgatgaagaaactgactctgattagtagcagtgattctgatgataatggaagatcaatttgtacaatactgatgaatttatgatgtgctagatatttcaaacttagcttctgatttcttaaaagcttttgtcaaaccttattgagcctaaaactcgcaaaagttattaaaaaactttcagtcctcattatctaagccaaaaaatcaagcagggcaatgataaatcaagtaagcaaattgaattgataaaaatcatgttccattattattatagtagccccccgactgaaaacttcaaggaaaaactagaagttagcagtcaaagaggaaagattcaaacgaaatgcctaagcataaaatcgatgaaggtgtttaatattccaagaattgttgacaagagtaccatcttcatgcttgagtcggtaagaacctggccgagtgactttagcgattatgaacggtccttcccacaagggagataacttatgccgatcctgtgtagtttgaattctcctcagaaccaggtcgccgactaaaaaggctcgcgatcgaacattccgattatgataacggcgcaacccttgtaaataccgagccgactggattagggctgcttcacgggcttcttccagtcggttgatatcatccactcgatcttcttcatagcgctcctcccggaagttacgaaatcggagggattcaaactctacctcacttggcagcattgcttccgcgccataaaccaagaagaacggcgactggccagtagcccgactgggagtggtgcgtagagaccaaagtacagacggcagctgttctacccacttgccagcataggggcgcagtcggtcgaaaactcgtgctttgatcccttgaagtaccatgccattggcgcgctcaacttgtccgttactcatggggtgtgccacagaggcataacaaattttaatgccaaagtcttcacaaaaatctttaaatactccgccggtaaattgagtgccgttatcagtaatgatacgattcggtaccccaaaccgatgtacaatattgatgaagaaatctctagctttgcctggagtgattgtgacgatcggtttggcttcaatccacttggaaaacttatccacagctacaaagagatgagtataacccccgactgcctttttgaatggaccgaccatatcaagcccccaaaccgcgaatggccaagacaacgggatggtttgcaactcctgagctggtaagtgagtttgttgggcaaagaattgacaaccctcgcatgttcgcacaattttgtcggcgtcggaaacagctgtgggccagaagaaaccctgccgataagccttgccaacaatggttcatgcagcagcgtggttaccacaaatgcctgaatgaatatcttttaacaattgtcttccctcttccaaagatacacagcgttgcaggattcctaatggactttttttgtacaattcggtctcgtggatgacatagagtctgctgcgcctggaaatctgctcggcttcatttttttctcgagggagttcttgtttggtcaaaaatcttatgaaaggttctctccagtcggcttcgatcatgcctacgccttgagtatccatggcttcaattgtttcttttctgggcacggttggtttataaagatactcaacgaacacatcagagggagctgcttcccgttttgaaccaaaattggccaatctgtctgctgcctcattattgtgtcgaaggacatgggtgagctcaagtccatcgaatttatcttccaacttgcgtacctcttgtcgataagcggtcatattatcatctagacaggaccattctttcatgacttgattaacaaccaactgagaatctccacgaacgattagttggcgaatgcctaaagagatggcaatccttaatccatggagcagcgcctcgtattccgccacgttatgggatgcaaaaaaatgtatctgcaatacgtagctcaatctttctccagtcggggaaattaagacaaccctagcttcagcgcccgtaagcctctttgacccatcaaaatgaatagtccaatattccatcttttcctttggcgtgtattcttggcactcggtccactcggcgaggaaatcagctaaagcttgtgacttgatcgaagttcatggcttgaaagatatgtccaaagacatcaattctcaggcccacttcgcaatccgtccatttgcgtcgcggttatgaagtatatccccgagtggaaacgatgtgaccaccgtgaccgagtgactttgaaaatagtgagataatttcctgacggtaattaagacaccatataataacttttgaacctgaggatatcttgtcttggagtcagccaaaacctcgctaacgaaataaattggtcgttgaacttttcgaatatggccttcctcttcacgctcgacaaccaggaccgtgctcacaacctgggaggtccccgacacatataatagtagcggctcttgcgaatgtggtgaggccaaaactggtggagtagtgagaagtttcttgaagtcttcaaaggctttttgtgcttcgggtccccactggaaattgtcagttttcttcaacaacttgaaaaaaggcatccctcgttcgccgagtcgcgaaacgaaccagctgagcgccgccatgcaaccagttagcttttggacatctttctgggagctcagcggtttcatgttgaggatggcgttgattttctccgggttggcctgtatgcctctttgagataccataaatctgagcagcttccctgacggtactccgaagatgcacttttcagggtttagcttcatcctgaaagcacgaatgcttgcaaaagtttcttctaaatccgcaatcaggtcatccttctgcttggtcttgacgactacatcatcaacataagcttcaacattgcggccgatctgagtcgaaaaacatctttgaatcatgcgttgataggttgctcctgcgttcttcaatccaaagggcatggtgatgtagcagtaggccccaaagggcgtaataaacgaggtcttcaagcagtcggattcttttagtctgatctaatgatatcccgaatagcagtccaagaaactgagtagctcgcagccggctgttgagtcaaccacctggtcaatgcgaggtaacccgaaaggatctttagggcaagacttgttgaggtcggtgtaatcgacacacatgcgccattgcccggtcttcttccgaactaggactgggttagccagccagtcgggatggaggacttctttgatgaagtctgctgctaacagctttgttaattcctctttgatcgcatccttcctatcttgtgcaaaacggcggagtcgttctttgatgggtttggcatcttccttgacatgtaaagagtgctcaatcacctctctgggaataccaggcatatcggatggtttccacgcaaaaatatctttattattctgaagaaaggtgatgagtgcgctttcctatttacaatctaactcagcgcctattacagcagttttggtaggatcggagggatctaatggaatcttcttagttttgtcgttgccttctttggtctttgacagcttggtcacaggcacttctccttcgcttgccgtggtcgcagccagtcggatctcttcgcgagcgagagtgatctcgcgggtttgggccatctcgcaactttctttgtcacatgtgatggcttgcttgatgtcgctccgtagtgatatgactcctcgaggaccaggcatcttcatcatcatgtaggtgtagtgtgggacggccatgaatttggctagagccggtcgtccgagtatagtatggtacgctgtctcgaaatcagcaactttgaaacaaatgttttctgtgcgaaaattctcccgagtgccgaaagtaaccggaagagtgatctggccgagtggtgtagctgataatcctggaataacaccgtggaagggtgaattactcggctttaattccgtgcgaggaatctgcatatcgaccagggtcttagcgaaaaggatgttgagtgcactgccaccatcgatgagagttcttcggagcttgacattgcgaaccactgggtctagtaccagggggtaccgccccgggtggaccactcggtcgggatgatccgagcggtcgaacttaattgctatctctaaccaccgaaggtattggggcgtgttaggctgaaccgcattgatctctcgttctgttagcttctgctttctcttagattcataagccaggggtccgccgaagatgtgattgagttctttgcgatgatcttgaaaaccagtcggggcatcgtcttcatcatctttcttctttgatgtgccttgatctccgtttgagggcttacgtgcgttcttgacgtattgctccgcaaactgtttgtagacgaagcaatctttggctgcgtggttggagttgggatgatgcggacattgggagttcattatcttgtcgaaggtgttgatgcgggaacgttgtcgggaagatggagaggttgttgccacaagttcttcgggcttacgcttgcgatccttatggttgttacttccactccctcctgcggtccgcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtcgcgaatgcctttagtaaaggcggcaatgatgacgtcgtcggtgatgtcggagattttgttgcgttgcttagagaagtgtcgaatgtaatcttgaagggattctctagacttctgaatgatgttatagagatcgaagtgtgtaccaggccgttcaaaagtgccttggaagttgacgatgaagtggtcgcgtagctctgcccatgatccgatcgtgccgcggggtagcccgtgaagccatgaccggtgtcacgtcccaaaacgactctaaaatacatcctctaaatgatgcctagaataattaaaatccgtgtgaaagcttccaaaaattaaaatgtgcaaagttaaaagtcaaataaggcttggaggatttttgtatatttcctaaaagcctaaaatgtgtaaataaattttagtgaaattttcagagcacaaataataattaagaagaaataaacaaagttaaaatgattttataaaaagaaaaaccctaaaatccctccttctctctaatgggccgaattcggcccatctccctccccctctctctcctctccccgcggcccattcggcctccctccccgcgcgcgcgccgctgacgggcgggcccgcccgccaccctcgctaacgggtggggcccacccatcatccccgacctcccgctgctcccgccgcctcgcccgtgccctagcgctgccgccgccgcgaatcccgccgcctcccgtcgtccccgcgtgcccgtgatcccctctccctttccccccatttttccctctctctctcgcattcaaacgggcggatttgcccccgcaaatctcaccggcgccattgatggcggccggacctcccgcgcctattccttcccctccggcccgcctctcccccttccaaccctatataaaccctccccgtgcctcctccgtccgtttccgcctcttgccaccctttctcctcgcctgattcgagctcgcgacgtcgccctctctctccgccatcgctgccgagcttcggtccgccgctgtcgccgccccggaccatctcccgccccagcgtcacctcctccagcttcgccgcaccgccagcgaccccgtccaccccctcgccgagtccgccgaccgctggaacgccgtcgaccccgtcgacccgagccgcgccgctgccttcctccgctccggccgcttttttcgtcgtcgccgtggtatgtggcatgtggttacacgtgaggaagatgtgtcttgtgggtaaagttgtacacctctgatcagagtataatctattcgaatagccgcgccctcggttatgggcaagccgagcaatgtacccaagttagtgttttaattcttaaaacttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgcatagctctaggatcgtatttacaaaatagctttgagcaactaagtgtcttttaatgctgtttactgcaaaccctaacaccctataatatggctcccttgtactcccttgcatttattctgcactcgtgggtgtgtcttgttgagtacggtggttgtactcagtcttgttcaatttttcccaaacctagaagaggagcccctagatgatgaaggctttggtgtctagctcgtgcctgccgtcaagcgcctgtggtcgtcgccctagtcttccgctgtttcctgtttgtctttgtgtgtgctgggccttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccggacagaatccgctagggccacaggtagataattcgccatggctttgctgtctcctcctgctgcgcggattgcgaggccatagacggtgagccaaaactcggggttggtggtgccgtcatatttctcgattccagtcggcttaaagccggctggccaatcaactcgacgcaggtcgcttgtgaaggcagcaactccgtccatatcgtcgtcatagcgatccggtgaatgatggcctcttgctacgcggtgctggttgatggtgtcacgaagatcgacggggcgccttcgatgtggggagtgtggtcgttcaactcgatgctccctatatcgttcgggaggcgaaagaacagatcattcatcatgtcccctgctcttgcgactagatccggcgccggcaatgctgaggcttggctggtgatagtcctgagatcgaaggtgagggactcagctaccggtcggggtgcgggtgcttgcgaagttggctggaaccaaggcagcgatcatggtcttcgtctggttcaagatgttgacaacatgatcagcctgattgagtgcgtcttccttgaggagggtgtcgaggagagtgattgctgcaactgcgttctgctggagggtgcgaaaaaccgctgttccatcgacgtcttgttgcccgatgagttctctctctcgtcacccggattccaaggcgcgctgccgtcgatcttcagcctcctttgcaactcgctcgcgatcttgttgctcacgctgtagtcgttctcgctcttgtcgctgtcgttcttcctccagtcggcgacgttcagtctcttgtcgtgtacgctcttcatccgcttctcgggctctgcattgttcctccgtttcgttgtcagccatgaatacgccgaaaaagagaggcgtgtaattatcctcatagctgtcgtcgaagttgtcgaagtcacggtactcgtagcagtagccgaagtcgtcgtagtcgaggacctcggttggttgagaactaacgccaggggagctgaggtagccgtccaactcttccgtcgagaatgtcccaagaggttggagtataacgccaacctccctggatctagattggatcggggccgaagccggggctcgtctagatcttcgagtgggagatgccttggctgtgaagacagcggccaaatcatcaggaagtctcatcaggattgagggataggacccgtcatcttgatctagtcgctgaagagtagatcggatctcgtccgagtggtttgaaaccaactcgggagagatgatcttggagtaggcctcggccgagttcggaataccgaacggcgcggggacctagtctctccccgactggttcgaatccgagtcaaggagagagatcttaccgaagtcgttggtgatgaagttgaggctgccaaaccggaacgcctgcccgggagggaaggcgaagtcgtcgatgccggagacagaacccatcgcacttagtcggcaaaaacttgatgctccccctacctgacgcgccaactgtcgaaacaagatttcggcaatactaaaaggggatggctatcaagctaggaaagtggatgggtttggagacaaagaattttatacaggttcaggccttcttattcaagaagtaacaccctactcctgtccagggatgattccccgagtgtattattgattgtatgatctgggaaaaaaaaatcgtcccgaaaggaacccggacccctccttatataggggaaggggtccgtattacaaaatacagtccatatccctaacggaatatatgattacagatagaatacaatcgtaaccaactaagaactcgggtatttccttgacatacaagttagaaaactaccccgagtcctcataaagatattctatctatatttggtaccatatatccaactaaactataactgtcatgtagatatgggatatccataatctccacaagtataggtatagatagatatattgatattacctatacaatcttttttctaatagttgtcatcgatatgatagagggggcagctaatgggcgggtgatcgctctaggcgatcaccccccatcccctataaggtgctctctcacttcctcctcccctcttctcttcctactacatcatatatttttaaaaaaataaaaaaacaaagttgtaaaaaattatgtatagaaataccatatataaaaaatatttgaattcaaattcaaatttgaaactgtatgtaaacttttgacttataaactttgggtctataaactaatatttgaatttaaattcaaatttgaatcgggtatgtaaacttttgactaacaaactttaggtctataaactttacgtgtataaactttagatgcatagaaatactatatataaaaaatatttaaattcaaattcaaatttgaatcggatataattcaaattcaaatttgaatcggatataattcaatgacttataaaccttggctctataaactttaggtgtataatttttagatgtatagaaatactatatatataaaatatttgaattcaaatttaaatttgaattggatatataaacttttgacttataaactttgggtctctaaactttagatgtgtaaacttgaggtgtataaactttagatgtataaatttactaaaataggaaagtaatgcggtgccaaaaaaggaaactatgtgaagagaggggggaccgcgctggggcgatcgctaggggcgatcaatcgccccttagcctttccgtatgatagatagatagataaatacagatagatagatagatcgatagatattacctgtacaatctttttttctaacaactaggaggatagcccgctcattcgcgcaggcatgcgtattagtttgttttgaaaatagttctaacaaaataaactgaaattagagtaaggtgttttctatttttaattgggtgttcattgtatctctttttttcaataaatctcgataaacttttattggcaataatttttttaccaccccgtcaaccctctttttaattgattcgtatatatgtaattcgttatgcttgtgtatctataaacataagttctttaaaaaatatttgttatattttgaatttagtgattgagtgattctaatttcgattttgtattcaaaacaaattattgttttattctaaattgtccttttaaggatttaaaaatgtacatgatctcgtatcgtgttgtacttggactcatcttttaatacttattttattattccaatttctggtatttataacttatacctttatatggacagttgatattttatattctacatggaatctatttatatatttttttatagttttagttttttttgtttttgaatatgtattttaaatcaaattgcttgttttattttttttctgaatttaaatacgaatacctcataattgatctgaatgtcaacatcggcctcgcggagtatcttatcgacctcctcattagtgggcctctcctgatgcattgcacgtgacatggcaaggctcggcgatagagatgaagctgttttctagtccttgttgaagacacggaacgtctccctctgcccctcctctcagtcctttgtccttcacctcattacctaacgtgctattaggctctagaagtcatggaaagtcgatgttggcgcttccatcagtgtccacctcgctaaggttgtgttgttccccctcctttcctaacttagctccttagttttctatgcgcatgctttccaaactactaaacggtgctttttctaaatgttgctttaaagcagcatattaatccattttataaaaaaaataactaatacttaatattctaatgtaatgcatgctttccaaactactaaacggtgctttttctaaaagttgctttaaagcagcatattaatccattttataaaaaattctaatgtaatgagtcgcttcattttacgtgcgtgggagattagatcctacacccatctaatgaacacaacctaataatatcttgcagctccgcctccgttgggtttaggccgagtatgcatcatggttccaagatccttgcctccttggtggtgattaaatatggactttatactcacccatttgaattcattaatcctttcacagtgcaaattttgcttaaatatttgtagtcagaacggctacattatctaaattttatatagtaaataaaggtaatatggatcttgaattatgatttaataataataaaagttcctttgtaacacaagattgaaaaaaaagaatagaaaaggttcaaatatgataggaatacatgtgtaaaatgagtattgaaaagaacggatgtttcaatgtattgcagaaaaacacaggaaatgaaaatttgcaaataaattgagaaaagtgcatgtaacttgagagtcatggtcatttaactctatgattattattattattattattattatttatatattatgtgttagctcgaaaataagaaaagttggctcgaaaatgggagaggagagtgggatccccgaggatagttggagggttgagggatacgtaagtacgtgtgtgcccacatatggtggggttgggtgtactggaatttattttgagatatctaacagttaaaattagtggggtcgacctatttaaaaagatatgaatggttggattttttttcctttttatcaaaatttttaggattttttcgtcccaacctggactaaagatcgtaactttagtcccggttggtattaccaactggggctaaagatcctggtgatctttagccccggttggtgctaccaaccgggactaaagtcccacccctatatatatgtcttcttcctcctccaactgcccgagcaagcttcaaaatttcttcaaaaaagaggggaggtcatgccaaaatttctattgaatttattttggtgattacatacaaatcggaggtgcctaaagggtttgcaacttcatcctccaatgtttttttttgtcatactacatttgcacctatgttttgcacactttttttgtctccaaaatttagttgtaagttgatcagagagaaaatgtgtgtggggaagaaaaaatatatagaaatttagttcatttgctaaacaaggttttataaaatagttgagaaggaaaactctagtgaaagttaatcttaaataatagaaaacaaactaaaatgaaaattaaaagaagtaaaatacagtaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagt

SEQ ID NO: 888 - DNA, 2446 bp, Oryza sativa
ataaattggacaagatgttagaggaccacagaacttcgttgtacccaggttgcgagcacgggtacaaaaagttggataccactctggagttcttgcaatggaaggcaaaaaatggggttagtgacaaggcatttggcgatttattgacactagtcaagaacattcttccggggggaaaaaaattgcacgagacaacgtacgaggctaagaagatagtctgcccgttaggactggaagttcataagattcacgcatgtccgaacgattgtatcttatatcgcggtgaggagtatgagaacctagaagcatgccctgtttgcaaagcactaggatacaagattagacgagacgatccaggagaagttgacgggcagctaacaaagaagagaattcctgctaaggtgatgtggtatttccctataataccacggctaaggcgtttgtttaggaacaaggggaatgctagaatgttgcgatggcacgctgaagagcgtcaacaggacgggatgctgagacaccctgctgatggttcgcagtggcgaaacatcgacagaaaatttaaagaatttggaaaggacgcacgaaacatacggtttggtttgagtacggatgacatgaatccttttggagagatgagcagcggccatagcacttggcccgttacgatgtgtatctacaacctcccccctggctatgcatgaagaggaagtacataatgatgccaattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccaccccgtacggaagaaaggcaagcacttcgaacataaggccgaccactgtacgaagcctaaacatcgcagcgagaaaacagtgtttactatggttaaagatcttaaagtagtgttcagaaaggggcctggaagccagcctatagagagcgaagatggtcacgcggcgatgtggaaaaagaaccctatattttgggagttaccatattgggaattcttggacgtacgccacgcaatcgacgtgatgcacctcactaagaacctttgcataaaccttcttggcttcctaggtgtatacggaaagtcgaaagatacactggaagcacgtaatgatctgaagcatatggaacaacgcggcgaccttcacccggaaccaaaggagaaaggaagccattacttgagtccagcaagctacactcttagcaaggcagagaaggaaagtatgtttgaatgcttggagagcataaaggtaccgtctggatacttcacgaatatcaagcgaattataagcacgaaagagaagaagttcacaaacctaaagtctcatgattgtcacgtgttgatgacacaactgctaccagttgtaataagggctatcctttcagacaatgtccgggcaacaataacaaagctacgtgcattcatgaacgcaatttcgcagaaagtcatcgatccggatagattagaagcccttcagaatgaaatggtgcaatgtcttgtcagctttgagttgatatttccaccttcatttttcaatataatgacgcatctgctttgtcacctagtgaaagatatcggtattctcgggcctgtgttcctacgcaacatgtttcctttcgagaggtacatgggcgttctgaagaagtatgttcgtaaccgtactcgtccagaggcaagcatcgccaaggggtatggaacataggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaatcccatttcacggttttacaacaatcttcattggtggctccttacatcgaggagcacttggctctagttcacgccagaaacatcgataagtccgatgcatggattacacggcatcacattgttactttccccgcatggctgcgacaacatctcatgggtaacgagacgattaaccagcaactagccttccttgcaaggggtccatttggctcgatcgtgacattccagggatatgggaaccagaacacattctacacaagagcccaagacatgaagagcacgaaccagaacagtgctgttcgtatcgatgccatggaacacgatggtacaacttgcacatattac

SEQ ID NO: 889 - DNA, 11585 bp, Oryza sativa
attttagaaacacatatgtaagcgaagataatatgcagtgctatattctttagtccgggttcttaaccctaactgggtttaaaaaaaatttgaaaataccggaaagatatctttagtcccggttgttctcatcaaccgggagtaaagatccgggggtatatatttttccggtgcgccctcgtcttctccaccaacacttcacgttttcggccgatcgatctctctcggcctctctccttcaccgccactacctagggcaaatccccgcgccgacgccaccgtatcttgccgtcgtctcgagctcgtcgttgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtgggcaggaggccctctagggggcatatatatgagacaacctgatcgtcagatcaatacacactcggcggattcaaatccccaaacaggagtagggtattacctctcattgagagggcctgaacctgtctaaatcctttgtctccacatccatccacttttaggtctcgtgctctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgccggtcatggactcgaggcgtctcagctttccggtcgatcggccgcgagtccactctgccggcttgtcttcgccactgacattgctgataacaacaacgacttcaccgccggcccgcctccgtcgccgccgactggtgtcctcgcctatgcggttggttggtcacaccaccgttcatgggcatccacgtcttcaccgaccggctggcctacgccgccgccgactgatgtttccgcctgtacacggctggcctattatgccgccgctgttgggcgtctacgacttcaccgccggcctgcctccgtcgccgccgagtggtgccttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgccacgctggctacccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgtcttcgcctatatggttggttggtcacaccaccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcttcgcctatatggttggttggtcacaccaccgttcatgggcgttcacgtcttcaccgccggcctgcctacgtcgccgccgattgatgcttccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagttgtgcctccgcctacacggctgggctattatgccgccgttgttggatgtctacatcctcaccattggctcaccttcgttgccgtcgactggtgtttccgcctacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataatcgcaaaagtacccgagtagtaaactccgatccgtgaaactttgttccattaatgacgaactcatgtcactcatatgcatgtttgggaagtgcctcggccgactcccagtgcttggggctatgactagtcggacagagcgtttaaacgtaatgagtcatctgctcggggaaatcaaaattgacaagaggagaaatatatatttataaatattttaaaatacttgattttttctcgagtattatatttatatcagatactactcatcctatatgtttgttctgcaggatccagatccagatatgcacaaaagggattcatggctttaagcttatctcttacgctccaggaatggatcagtcagaacatcaccaccggcttgccttcgcagccgccgactggtgttttcgcctgcacggctggcctattatgccgccgttgctgggcgtctacgtcttcaccgaccggcttgccttcgtcgccgccgactggtgtttccgccagcacggctggcctattatgccgccgttgttgggcgtctacgtcttcaccgaccggccgcctcgtccgccgccgactggtgttttcgcctgcacggctggcctttatgccgctgttgttgggcgtctacgtcttcaccgatcggcttgcctttgccgccggagactggtgtttccgcctgcacggctggcctttataccgccgttgttgggcgtctacgtcttcaccgaccggcttgccttcgccgccgccgactggtgtttccgcctgcacggctggcctttatgccgccgttgttgggtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaaacaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggggatgcacaattaatgcaaaggagtacaaggggataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttatgccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggggtatgtccaattccaccataatccaacaattccatagtgtccaaaatgatatgagacttcccaaagtctaaagttataaaaccacctaatgttgcctaattaaccagcgaagcatctacctaagttcatactagtggaaccataaatagagtactcactagttggggttttgtttaacctagggtgaacaaagtaataataacaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgtaccacgcttcgggaacctccggaacgacgaaagctacgcgaagcacacaagcaaagctacaagcctataaagaagcaataacaatacataaaaagaaagcacagggttctttaggttatagcaaacattaggagacttgaacgggtcgattcagagttcgtatgaccaagatatgatcatccgaagtttagtgctgttatatggagatttgcggattattataattaggttttgcaactataaaacaggtgtaagcgctagcctggaaaagacaggaaggctgcgccgttgacatgcggaccccacatgtcaacctaaaggaccgcgttagaccgagtacacagagtcggtccacgggtcgacggaagcggatcccgtgtgtcaaccgaggcgagtggccgacaaacggactccactagacaccacacggactgcacacgtggaaaccacgcggctaccgagcggacacactaacacggtcaccacgcgcacaagcgaacgactgccgacgccgatacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcgcaacggagacgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccacgacgaccgagaacgacgagaggacgaggacgacgacgaccggggccggcgaggaggctacgagggcagccggcagcggctgcacggcggcgaggatgacgtggaacacgccgctacgatgacgatgacggaggcggcgccgcgagacgacgagccgggcgaccgacgggacgtcgacgacgagaacgatcggagacgacgatgatggaccgcggaggggtttggatggaggggaaatgatgccgaggacgaccttgccgctgcgatgccggaggtggtggaggtgtggccgaccggtgcacgggcgaggagggacgggcggccgaacaactccggcgaggcggatgtagaggttcgcggcgatggcgttccggcgaaaccgaggagtggacgaggtggagggctacgccatcacgcaagggagagatggcagcgccggctgacgcatgggcatggcgaaaagggcagccgggggagatgccgccgaggaggaaggagaagccggcgcgggcgacggtgttccggcgaagttcgggcgaggaggaggtgatgccggggatgagagcggcgtcgtggagccgaggaaggtggtggcggcgtcggccggcgctccggggacgtggcagaggcggccggaggcggagaagtggtggcgacgccactggacgccggcgaggacgcgtctccggtgctttccccgcgaaacggagggctgaccgagggagagggggcagctgcgacgccgggagaggtggcggcgcagccggagggtgcacgggtgaggcgggaggtgcggctggaggtggccggctcggagaaaagaggagggcgacggcgggaaggcagctccgggggtcacctcgcgaaacggagggcaagccggggtggaggaggtggcggcgacgctggaggaggcgacggcgcggccggacgacgctccggcgaggcgggagaggcggctggaggccggccggcaacgtgggagagagagggcgacggtggggaggtggctagagaccacgggagagctcgggaagaggctaaaacggtagaacgtaaagagggggttctattttatatgagagaagagggagccggccacgggagaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaatttgggaatcccatgcttgattcgcgcggatttgagggaggaacgaagctaggttttcggggagagagagaggaggccggctgggaggaggaagaaggcgacggcggcctgacgcgtgggccccgcgcggccaggcgcgcgcccagcacacgcgcggcgcacatgcgcggcagggaggcggctcgggcttggcgcggcttgggccgattggccggcccaagaggagaggaggggaggcggcctggggaagagagggaggaggagggagtgggccgggaggggaagaggggcccaagagaaagagagggaaggaaaaagagagggaggagggaagaacttcggccacgggccgagggagagagagaggactttgggccagacttggcccaaaggaggaagaggacattttttagatttttttctttttaataaactttgttaattgttgttgttgtttaataattatttccggcgctctgaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgaattttatttcgggatgaatttatcaggacgtgacaaatccaccccccttacaagaatctcgtcccgaagattcgagtaggctagcaagaagataggttggcgggtcttctcttcttgtctgacttctaccgctccgtcttatataacaaacttgcctagcaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttaacaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttcagtgaaaccttgaagtgttttgccaaaagctatactaactgtcgttgcctttgatccgaaaaggactcatctgtaacccttagtccaaacaaatgtctctttggttaatcacttgattttcttcttttccatcctcaggttggttattagctcgaggttagaatataattcctcggaaatgagaccctaggtctcctttgacagtaaacaattatacacataattccatatcagcatcttccaaaatgaccctcctagaacttgcttttattacacatgtctccctgattacatgaatacaaggcactgtcttaaacaaaaagggaatgtgcttaacatcggtacattgtttcctctatgggttagaattaacaggaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaacccttgctaacattggcatcagcggtaccatcgttgctatcaccattggagtctttctcagtgtcaaaaattgctaaggttgtcattctgggttccaacattgatactatcgttgacatcttggcgaatgctaccgacattgcacgctttattcgagtggtcactaatggggcaagaaccatggttgttggtggtatcatcattattagtattgctagtgttgttgtctgcattgcgtccatcttcttgaggcaggaactctggatacacaacagaagatccggtgatctgaagtggctcagtgcgctgtctttggttaccacctggaaatactgggttgttaaccatccttctcttgcaattcgtcatccgattatgctcactttcgagttgcatggctttgtccacaagtttctcaaagtcttcataatcctctagaagtagttgcactgcgagctcatcttttaacccctggagaaacttctcttgtttgtcttcgtccgtttccacatcttctggtgcatagtgagccaaacgatagaactcgtgcaggtactctgcgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacattggttgcccctgctgggttgttccgattctgtaatagttgaaaggctgttgccaacatgttggtttggttaaccacaatttggattagctctggtgaggtttcgttgatgcttttctcattcccattggcttgggtttttgagtcatcggatccatcattcccatagcctttgttaccagtgttatccatctgtcacaaggtaggggttgagagaggaagcatacaaggaaagaatagaccagaaccagggacaagaccttaaaggaactaattcttcttgctgatgtgctgtttgtttcacttattctgcaagttgattaagcaaacaacctagcatggctacatcaccacccaccgatgcaaaccatgcgctacacacacaagcaaggaaacatactacaaacgaaacactagagggtggcttaggttctgcgacgggttctccaagatcttagcttcagcttcacggctggcttcactgcttcctacactttgctagcggatcctgcagtcttccggagcttcggcaaacaactgacgacatcttcttcttcgcaaagctgaccatctagtactagttgaaatccgaagaaggaagaagggagtaaaccttttgcaaatagcattaggggaaggagaaaaaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaaacaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggggatgcacaattaatgcaaaggagtacaaggggataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatgatgagctacgta

SEQ ID NO: 890 - DNA, 2683 bp, Oryza sativa
accgaccggccgcctcgtacgccgccgactggtgttttcgcctgcacggctggcctttatgccacctgttgttttttttatacgtcttgaccgaccggcttgcctgcaccgccgacgactggtgtttccgcctgcacggctggcctttataccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcatggctggcctttatgccgccgttgttgggcgtatacgtcttcaccgaccggctcgcctcgtccgccgccgactggtgttttcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggctcgcctcgtccgccgccgactggtgcttccgcctgcacggctggcctattatgccgccgttgttgggcgtctacgtcgtcaccgaccggccgcctcgtccgccgccgactggtgcttccgcctgtacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtgccctcacctctacgtctggtttagacagctaccactactgatggacagcatcatcttccgtcgccgactgattatgctgccgtcgattggtgcttttatcttcacaactacgcgtcttcactaccggtttgcttctgttgccgccgacttgtgttcacttcattacggcaataccactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgattctccaatattcaggatttctacttggacgccttcaacacatatcttcaatcaagcaatgactactcgacgacaagaagctatagttctcgactctatgttcagttgtttctcaactaaccaaagagtcgggggctacacaaatataaggctcaaaatcaattaatcagccaatgagtcaactccaggagtcattatcttcatctttgcttcggagcagatgttctacttcagcaacttcaattatttcaccgacaattttggcttctcagcgctgccataatctactccaaaattctcaagtatcaagttcaagatttaatctacatgttcgggagtttggagttatcaaccaatcagctcggtttagacgagttggacaacaacatctactttcctccaagtgaagcatctacaacagctgtaacactaagttctacagtcatcttcgtaaatcaagaagcattgcatcagttttctttatgcacacgctcacatcaaggaaacttctcaagcttcgatagcctactctgctgccgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcatcggtttgcttttgtcaccaccgactgctctgtcgttgttgttgggggccttcattttcattgatggctgacctgactgctgccgactggtttcatcgcctccacggctgtgcaacttcatcacttttgattagtatcactatcttcactaccactaatatttttgtcacctctagtgggcaatattatctctatattggtcgtcttgtctctatgccaactgcgtcagctactatcaatggacaattgtgactacgacagaaggacaagctatatgctcaggggcttactagttcaaacacaagtatcataccttcaatttggacttgttccggatacatgcaacatgaattcatgatcatgggtctattttctatgctcaaagactggactatttattattcctcgtaagggttatcaaccgaatacttgcgccagtcgggatttaatttttatatttattttggagtatatcataagggataatcactgagatcagaagctattcatatgagctacacttggtatatatcacccagaagatctattactagggagcatgtcacatgcgt

SEQ ID NO: 891 - DNA, 145 bp, Oryza sativa
atcccactcacccataaaccaaacacccctgaaagtgggttcatcccatcccatcccacctcatcccaccaaccaaacactacctaagagtctccaagacaagtcaaactagcttcaattatcaacccaaccttgcatttctggg

SEQ ID NO: 892 - DNA, 1245 bp, Oryza sativa
agttggcacaatgcatcttaaaaggtgtcacacagtaagcctttatatagctgccccgctgtctttttaatatagtcaaggtcctgtttgggtttatcaaccaattgattgaacacaatatcattgctttttgccacgtaagtgtgcatttttattgaccaatattatggcttaggttgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttcgaaatttctttattcacagcattcaagcttctttatagttgttttgctatgtgaactttcaaagatgttgtcaactttaggttgtacgcatcatattttgccaagcagtcggtatatcacttggatcatattattcagggattcacaccgcatatgctatatattggtatcaagtcacttggttgactataattatcaaaaaccactcggttaattggataatttattccttgactatatgtttagtttgttcagctaatcacatagtcgggggctacacctattaggtgcatctagtcgatgcatctgactttattttttcagccctccacagtcttcagacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagtaataggggataacatatatgtatggaatatgtaacagatcatgacttgggtattacgtttcccctgtatattatggaacgggcctaaaatcctggtttgataagattgtaaagtagatttaggaaatcggtaccttattggttaaggtttctattttgtaatcctgctcccaccctatataagggggcaggaaggcctttagggggcatgagacaacctgatcggcagatcaatacacacccggcggattctatttcccaaacaggagtagggtattacctcttattgagagggccttgaccttgctaaattctttggcttcacattcattcacttctaggtctcgtgcgctaccccgttttattattggcgaaatcatgtttcgaca

SEQ ID NO: 893 - DNA, 8712 bp, Oryza sativa
tttttttttctcaaaaattttaagatttttctataatttataagatgtgaaatgtgtagatatagaggtgttgtaatggacatctaatacatgatgatatgatataggttatcaatttttatataacgttacattgctgtttagttgtcacataaaggatatggatttaggcctaataatatatttatcagatatcaagaaaggcctacatggatcaaagtaaaaactgaatatattaaaaatatatataatcatttagactatgtgacgatcggtcaccaactatgcatgtaatagaggaactcacatcctacagttatatctcaaacggcctatttttttaacccattagatacaagatcattgcagatgacacatcaaatgcctatttctatatcgaaaaacatagtgaatataggacttagctcgttgattaatttaattaaaaatacaattgttcaagcgtatcataaaatcaatgtacagatcatccataaaaatcgttgcacagccagctcattgctccatgcaagaaaatatataaccatttacaataatacattatggagtgtatctcgtaataactaccttaattagaaaaaagaaaaaaaaagagaaaatgaggggaggataggcgcagtggtgtagcccggaattttttcttgggtagtcctacttcataagttgacatcacacatgaaaatttttcaaacaccgcaaacaccatatataagtacaaatttggtcaaaagacgatgcaaatatagcaataatatcttatgacatcaataatcgactaatttaacaaacaagtccaaaatgtgcacaagcaagttcagaaagtgcaaatattacattatgccaataccaatccccattcctcttcatatttcacccaataaaacaataccaatctaacagaagcgatttattcacattcaatcattcacaaatcacaaatccgcatcctaagctatgagctaattaactagccatcaatatgatcaatgaggcaaactaatcaataatcaataatcacaaattgcatatttacatgttcactaatcacacattgacaatataacattatgatagcactctagtaacaatcacatattgcattacgaagctatgagcaagaggattagaactgtaaagcctagaagtagaggaacctcatcagcaaaagaaggttagaaggcggcaatgcgacgccggcacggacgcacggcagggaaacagagccaacgagccagccaaccacgggtcttggtatctccatctcgggctctcagctggcatctccggttcccgcgccgacggccggtggcggcatcatgacagcgagcgggagcggatttgtgcagcgtgagccatgggctatgacagcaggtggcggcgaccagcgatccaacgatgagaggtggagcggtggacagccagacaagcagagaggagccgcccgacgatctggcattgctggctctatggctcgccgttgaccaccgaggcgatgaaggaacggcgtcccacgttcgctcggcacggtgcggactcacgggtgccaggcgttggcggtgcacaggtgaatgccgaagggagttgcggctcctccccaatccctcaaccctagcgcctgctgcctactcacgccggagttttgggcttttcttgttgggcctgattttttaggggggtttggtctctgggccaaaattgggggtagtcccgagcccactgggactaccccctagctacgcctctggataggcgtacgtacagatgttgggaagtgcacgtgtggggcccaggagagaaaggtgaggagggattttattttgatatgatggttaaaatcactaggtccaccgttttaaattaaaatctatggtcatatatttttggtttttcttataatttctataatttattggagtgccacttggcggcttaagagcatttgtaggaagtttaatagacttttagtatataatagatagatagataatagataagttcactttaggtctctcatctttgatgttgagtttgaattacgtgctcaaaccatagtaccagatataacgcatgtctcaacttgcaaaaccagtgtacccaagattcaagatagtatagtgtccaatttagctgatgtggcaagtgagaccaatgtaagccccatatatcagggctatttcttcttcctccaacctcctctctccatcaccgactctactcacgctcctcctcatctgtgccgcagcagctgcaaccatggccttgccggagtaagggagtcttcctccatctccccacctcgggccaccccgtcaccacctagcagcttcctagctctggcaccgacggcctcatcccatccctagcacggttatagttggattagattaatcttaccgcatacaacggccccacctctcccgtaggtctgtacatatgaagtacatacttacgtacgaagccgctcacccgatcaagttcgtttttctctcctttcccttttatagtttctaacgataattgagataacattcattattagaaataaaaaattataactttgtgtagactgcatcatcctatacgtccataatgtttgaagaaagtttcactggtggagaaaccctttgtagtcccggtttgtaacccccctttagtcccggtttccaaaccgggagtaccaatccgggactaaagattgctatctttagtctcgggtgaaataaccgggactaaagacacccgggactaaagatcgagctgacctttttttttgcatggccctgtagctgcatggtttatatatatatatatatataaaccatgcatatatatgtttcaatacatatatatgcatacatatatatattatacatatatatatatattatattatattatattatatgtatatatggttcagtacatatgtacatgcataatatatatgtatttatacatatatatgttatgcaaatgcatatgtgtgtgtgtctatatatatatatatatatatatatatatatatatatatatatatatatatatatatatatatatatgaccaaaatatatttacgttatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcaagctctcttgtggtgatgatttggtctgcaaggcagtggcaatactcgcacacgtagtagccgcacaagttagttccctgcttttgctttgcgtactacaaataaatgacaaattaacggcgtgagatctaattaatatacacttgtatgtattaatttgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagaggaacttataccagtacctgtctataagttcgaaaaccttgtcaaacgtagactctattttatccattgagtcatatacattgacggtgcaggccgacaggtcaaagagtaaaagcacccagtggaatctgcaatgtgcgtgggatgcattacatatgaaacacttagcaagttcgtacgggaatgaaatttggtatgtgggaagacagtaaaattaaactaactctgtgttgtacggcaacagtatgaacatcttgtaatgctgcgccttcaggagatggacgagattgtcctctgtttcttgtggatattggtcgagcattgcgacgtttactctccgagggtcgatgaatccagtatcgaaaaccctccgccttcgggccctttgaatctctattctataacgataaaagggagtattttattttatatagtttacttatatagaagaacctaattaattaaaggagacgtagtaattaagaaatataactgaacgatatacttacaaaatccagcaactcataatagagacgtcgagggcgtccagctggtatacttcgtagattcccttgaaattgatccagagaatatcatctccttgcaagaagtccgggtgcctgatcctcgctccgatcatctctctaccggtggcgctcatctctatgtacagctgatggaacttgtacatttgtgtgggtaaggactgcaccagctcgggcttgacaagcggtttactgagttcgtacatgtatttcaattccgcctttactattggttcaactcctagcaattgatctgtagttagaccggtgtcaataataaattcttctatcgtcatgtcttccccggtcaccaatggctcgatctcctagtttggtttctctccaagctgagggactggtttggactttctagaagattctttcttcagcgttcgctcatagtccgatagcttgatggcctccttgacaggtgcagacatacccctgaagaagttcctgacactggggtctataggaatcttcttttctagacttcgaggtttgaattgtctcttgacttctgatgcaacgtaagtgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggatacggtgcaggatcctgaggaggagatggcggagccggaggagatggtgcacgagacgtcgcttgtcgcccagggaggatgatgtaccgcctgcgccatagaataatggcatggcttgtgtctcgtagatgcgtctcactatctcctccagggtaatccagctcgaggtcctcgtatgcgccttcgaccaactcaacttcgaccttcgagtatcctgctggaatcggcctgcagtggtaagtacctgaagggtccgttgggatggccatgcccgacaccaccttcatgttgtgagagattatttattagtaatcaacatatataagcagcaactagcggaatggctaaatctaaaatatataaactacgagcttacctttattgataagttcttgtaaggaatatgcagctcacatggtgtttgctgagtgatgtcatcaacgggacaggtcgattcgtcctgtgtttgcatggcgtccatgctctgtgtcctacctaccccgttgtggcgcagttgctacggtttcctgacgggctcaccattgcaggaggaatggtcggctggggatcatgggaccgatgtgcggccatgtgttcatcaaccttccttgccacctcctcttgcattctgagttcgtggctcgatacccggaactctagatctgcaatcttcgtctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctttgtccggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccgaccaattggtggttgccggttcgatacccctctcaatcaagctagcctccatctcctcccactttggcatcgcgacgctatagcctcctgaccccaagtggtgatggtacttcttcttggcggcattttctttgtttatttccatcatcgcttgcccttgttcacctgtcttatatgcaatgaactcgtcccagtgatcccttagctttgggaatgtgtcaaagttcggtgtctgcccctttaggatatacttctggtacagatctcccttgaagctctgaaactgttctgccattttcttcagagtccaccttttcactttgtcctctgtacccgtaggaagggtgaatgtctcgagcattgtggtccacagcatctctttctctgaatctgggacaaagctctcatgatctccgcgtgcccttgttcttcgccagtacaccgtactgacaggcacgttatcccgcacaacccaaccgctgtgacatacatagttcttggcggcttcggccggggcactaggatgtccatcttcttccacttccgttatgatgtgccgacccttaagcttcttcgctgcaccttgttgcccgcgtgccctcttctgtccaacggagggttgactaccactagcctcctcctcctggttcccctccacatccctttccacgtgcccctgctggttcccctccgcatccctctccatgttcccttcctcgttcaagtactggtttagatcctcgttcccctctttttcattccagtactggctgattccctccgcgattgtatcgtacaatatctgttccacatcgcggtcagccatctgttgatacaagaaacatttgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataattacatactaagtctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattctgtagtcaataattatatagtaagtctaattacaaataaaataattttatattaaaactcaaataatattacatgctaagactaaaatagtcatgtatgctaagtgtttcgtgcgtatatgctaagtctaattaagactacaatagtcaattgctaggagttgcaccaatttcatagtcaataattacatactaagtctaatttgcaataaaataatcttatattaaaactcaaataatattagaacactacacaaccttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatactgcatttcacgttcacgttcgttcgctctttcacgttccttagctcgttcacatttgttcgctcgttctcattcacgttcgttctcgttcacgttcgttgtcgttctcgttcacgttaattcgttcgatcgttctcgttctcgctctcgttcgttcgatcgttgtcgttcttgttcacgttctcgcggcaacgtacgttgacgtgttcgttctcgctcttgttcgttcgatcgttctcgttcacgttctcgcggcaacgtacgttgacgtgttcgttctcgttcacgtgttcgttaacggcggtgtggcggcatcgggccagcgcttggcgcggcggtgtggcggcggcggcgtggcgcggcggcgaatgcggcggcgtggcgtggcgtaggcggcgttgcgcgcgtggcggcgaaggcggcggcgtggcgcggtgtcggcgtggcgcggcgtctcgtggcgggcggcgcgacggagagagagatcgagatcagagatcgatgaagggagaggcggcggtggctctcaccccaaaaatgcggcggcggaggaggaggcggaggcggcggcgaggacgactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatatatatgccccctagagggcctcctgcccaccttatataggatggggggcaggatt

SEQ ID NO: 894 - DNA, 2346 bp, Oryza sativa
gtaataacaaagaaaacgtaacacccaagtcatgatctgttacatattacatagatataagtaatcccctataactagtcggataaccatccggtgtgggtatggggtacccataatctccacagtagcccctgagaccttacagtcgaaaagataatcttctctcgaactagattactccaaagctgagtgcttcaatcatcttcgccatggtctccgaagtacttttaccaaatatgaagactgtggagggctgaaaaataaagtcaggtgcaccggctagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagttataaagaagcttgtatattgtgaataaagaaatttccaaagtattgggcatacgccatgcgcacactgctttaacaaatgtgcttaagtccctagaagacacatggtttcaccacacctggaaatatatggcatatgtggtgtaaaatccgagtaaataaactcataaatgatttaccaaccgcctagaaaatgaccacaatatataatcagcctaagccataatattggtcaataaaaatgcacacttacgtggcgaaaagcaataatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggttgcagacatattaggcctaggccaaaaaatatgccttcgacaccctttaaaggatgacgcatgtaacatgctcccgagtaataaatcttccaggtattatagaccaaatgtagctcatatgaatagcttctgatctgagtggttacgtaacaattgaatcccgactggcgcaagtattcagttgataacccttacggggaataataaatagtccagtctttgagcatagaaaatagacccatgatcacgaattcatattgcatatatccagagcaagtctaaattggagatataatcctcacgcttgagttgatgagcaaaccgacgatgaagacgtagacgcgcatcaacggtgatggcgaaatccaccgatcatgaagatgaagaaaataatcggcgacgacaaacgcaaccgacatgatgaagatgacgatgtcggtgatccagccaatagcagtgtagcaaccaatgataatgacaaaggcgctcatcagcatttgcatagtaggtcaaccgtgaaggtgaaatatttggaggagagttgatgctgttgttcaactcgtccaaaccgaaatatttgaagttgttgaagtagaatgtctgctccgaagcaaagatgaagataatgactcctggagctgactcattggctgattaattgatttcttcagcttttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagcggtataaaccagacgtagaggcgagggcactagtcaacagcagacgagatgaccggcggtgaagaagataaggccaaccaacactggtagaatcatgcagccatggaagtgaagaaaccagtcggcagcagacgtaggcaacttgtgttgacgatgctgacgcctattagcggtgacggcgatgtagcagccgtgaagaagatagcatcagttggcgtcataacaggccagccgtgcaggcggtgacaccagtcggcggcggatgaggcggccggtcggtgaagacgtagacgcccaacaacagtggcataataggccagccgtgcaggcggaaacacc

SEQ ID NO: 895 - DNA, 840 bp, Oryza sativa
gaaagccaaccggttggttaagacgtagacgcccaccacggcggcataaagaccagccgtgcaggcggaaaacaccagtcggcggcggcgaaggcaagccggtcggtgaagacatagacgcctaacaacggcggcataaaggccagccgtgcaggcggtgacaccagtcggcggcggcgaaggcaagccggtcggtgaagacgtagacgcctaacaacggcggcataaaggccagccgtgcaggcggtgacaccagtcggcggcggacgagacggccggtcggtgaagacgtagacgcccaacaacggtggcataataggccagccgtgcaggcggagacaccagtcggcggcggcgaaggcaagccggttggtgaagacgtagacgcctaacaacggcggcataaaggccagccgtgcaggcggaaacaccagtcggcggcggcgaaggcaagccggtgaagacgtagacgcccaacaacggcggcataaaggccagccgtgcaggcggaagcaccagtcggcgacggacgaaggcaagccggtcggtgaagacgtagacgcccaacaacggcggcataataggccagccgtgcaggcgaaaacaccagtcggcggctgcgaaggcaagccggtggtgatgttctgactgatccattcctggagcgtaagagataagcttaaagccatgaatcccttttgtgcatatctggatctggatcctgcagaacaaacatataggatgagtagtatctgatataaatacaatactcgagaaaaaatcaagtattttaaaatatttataaatatatatttctcctcttgtcaattttgatttccc

SEQ ID NO: 896 - DNA, 488 bp, Oryza sativa
agaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgt

SEQ ID NO: 897 - DNA, 718 bp, Oryza sativa
tcagctggcctacgccgccgccgactgatgtttccgcctgcacggctggcctattatgccgccgctgttgggcgtctatgacttcaccgccggcctacctccgtcgccgccgattggtgcctccgcctaaacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggccggcctattatgccgccgctgttgggcgtctacgacttcaccggccgcctgccttcgtcgccggcgagtggggccctccgttacacggctgggctattaatgcggccgtggtggaaggctacaatcttaacggtggcttaacttcggtggcggcgactggtggtttcggttacaccggtgaactattatggcggccttagtgggcatttttggtttcaacggcgaacggcttcgtcggcggcgactggtggcttcaatggtatagatggaccaatttggtcccacaatggccacttctggcattaccaagggggatattacaaagcttaggcatcaattattttaatctttatatgagaattttccctttcctctgcctcactacactaattgggctttcattga

SEQ ID NO: 898 - DNA, 726 bp, Oryza sativa
ggagttggctggaaccaaggcagcgatcatggtcttcgtctggttcaagatgttgacaacatgatcagcctgattgagtgcgtcttccttgaggagggtgtcgaggagagtgattgctgcaactgcgttctgctggagggtgcgaaaaaccgctgttccatcgacgtcttgttgcccgatgagttctctctctcgtcacccggattccaaggcgcgctgccgtcgatcttcagcctcctttgcaactcgctcgcgatcttgttgctcacgctgtagtcgttctcgctcttgtcgctgtcgttcttcctccagtcggcgacgttcagtctcttgtcgtgtacgctcttcatccgctttctcggcttttgcattgttcttccgttccgtggcaggcactaataaccccaaaaagaaaaggcggtaattattcttattacttgtctccaaagtggccaaatcaccggacttgtaacaattacccaaatcctcgtaatccaagaccttcggtgggtgaaaacctaccccaagggaactgaaggagccctcccactctttccgtgagaatggcccaagaaggtggagtattacgcccaccttccttgatctaaaatggatccgggcccaagcccgggctcgtctagatcttccagtgggagaaccttggctgtgaagacaccggcccaatcattacgaagtctcattaggattgagggatatggacccgtc

SEQ ID NO: 899 - DNA, 12200 bp, Oryza sativa
  unsure (1)..(12200): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcagctgagatgcatggccggcgcgtacacacacagtaatcgatacacgagactgcgagatcgaggtcgaaagattttttttttttcaagatttcttacgtagattgtgcagacggtgccggcggagtctccctcgatgagcttgatctcgacgtcgatctggacgtagaggtacttctccctggagcggaagcaggagccctgcgactggtcgagggagagcgccagcgcctcggagtcgccatccatgaagaagtaggtgcggctcgcgccccagatgagctcgatctcatcgaagatgcccgccgtgctccggtccacggccgcgaggaaggctaggcacaggatcagcaagctgcatagctttgaggagctagaagcaagcggcattggcgccatcgatgcctgcctgcttctagctagctagccctgcagctagccgggctaggatcttagtttgaagtgtgtggctgcttgttgtttccacggtagaagggtcagcggtttgtgtgtatatatagcagaggtaatggaatgagattggagacgaaggtggtgaggaaaatgagggcggcaaggcaagtgaggaatcgaatgtcaggctggccgagacgaggggaaaccaagtctacccttggaatccaatccctcgtcctgttagctagtgctagtacactggaactgtgcacaggtgatcattggtgttagtctccgtttctacgtatataagcattttacaagtgcaggtcgtctcatcatgcgagtttgatcgatctgtgcacatggaagcacgatagattatactgaggttgaggaggatcagggggtacctagctagatggagaactgaactaagatttgtttcttatgtcaaaggtagggaagccttagatctcggtaaactgttatcttattatgctgccgaccttgctacagctatatacacgtacagtacacaacttaaaattcagatttgcttcttgtcaaacaaatttgagggtcatagtttagggcttcgctatacatgccaatatgccatactagtactgcaccgagctgtatatctcactatgctacgttaattgatctctggaactgaaagagtactgtttgacttccctgatggatctctcactgcacggcgagtaaggttggacgaagagtgactcgcaaagattcaagcagtgctcctcgcacgcaagcccaagcttagtttctctcctactgggcatcgggaaaaatgcagatcacaccgcttaaaaaacacgcttacaggagcagttctatatcaggaatgcgttttcgcaagaacatcaaggcatctttcggctcggttggttggttctaaaatatccctccgcggcttagagaagcgcgcgacacggtttccatcggccaatcacaaactcatatcaacggagcgcgcgcgagatatttaccgtctcggtcggagggacgaggtggtgaccttctcggttttctcacgcagggccccgcgcctcgcggttcgcatgtgcgaagtgcgaacgagcaggagcagcctcccggcagcgttgcatcgcagccaagctagctagaaacctagaagcaggcagccggctcgttcagttccagccttccaggtaacatgcatggggtcagcaccaaggaatagcagacgtgcgctaatttactagccagggcatacatataatctttcacgatgtggtcggttctaattgataaattaaattagtagcgagcccagcgacatgcattggtacggttctgacgttctgtcattagatcggtgtttctcgctcttccattttacggcgccagtaacaagtcttcagtggaaacatacttgaggtaggtagctagcaccatccaacaaaaaactcaatggaaaaagaaaaaggaagaaggaaatctgcttctgttttgaagctggacgaaacgtgtgtccctgactttttttgtactacgagtttattcaagttgacccgatcgactatccattgcctggccggtagtactctctactactactagctagacatacgtacgcgtaggcgtagacctgtaaaacgaagcaacttgtggagatggttaaaggtgacttgacaaaccaaaagaaacaagatacaagtgggagtatatagtagaggcgtgagcccccttcttatgcgtttcgtttggatcaggcttaatttgcagtggagatagagaacgtagatagaagtatacgtgttgtaatactgaaacttcactctttgtacatatgtactgacgtatgatcagagttcagattttcgaaatgtttttttctattttacttgcaactgatttttagactcctatatttttagactcctatctttcactattttatctgtatgatcttaggttcgtgttcttgtatccaacttacagatacactcagttatattgcaattacacttaattatagtgcactaaaattatatttttagaatagttttctttttctagatttatgatttttgacgtgattgtctttttttggttatttcatttaaaacggactatctccattggataaaaattctgcaagatttgaagttataaatctatcacaactaggccgtgtttagttcccctctaccaacttcaaacttccaactttccatcacatcaaaaacttttctacacacataaacttccaaacttttctttcaaactttcaactttttccaccaactaaacacaaccctagttagtcccttattttttttcccacgtaggacgaaaccgtttccgagactaccgaaggagtccatttgcgatagtgggaggagattcaactagtggtaagacatgagggttacaaaatagacttattcccaatccggttgatccacaggcaaaacgacgccatcaggcccaaaactggggccttctccggcccgattagctaggctggccgtagtgctgtaagtaggcctattaagccaggcccagttactcctactcgcctcgacgccgcctgctcgcttcggcgcggcggcgccccacctcccctcctccgacacgacggcgcggcgcccttctgcggtcgacgcctccgtcctccaccctccctctcctccatcttcccgccatcctcaactacaagacgacactgcggtggcgatcgcatcgatccctctacctcatcacgacccggcgggggcgaccgagcggcggcggcggcagcggcgacggcggccggatcatgggactaggaagggaggtgtggggggtggttccgccccggcgaccgaggtcgaagcggcgctgttctgagcaggtgacccaagaacgtacgcccattttcttgaactcggtcaaaagaaaggtgccgattatattggttaaatctagccttgatttctttaattcgaactccgttgtggcacgcaagatgtgtggtctgaatgtgtatgtaatgcggctcagttacttgttttgtttggacgatgcttaatgagcttaaggattacgctagctgtttactggtaataattaccttgccaggttcttttagtatattttaatttcgctttcatgcatataggtcattaactgcgcaaataattaggttcatggatgatacctctgtggacgcaagtagttcaaggacaatggacatataagctctgggactgggagttggagccattgtctaagtgatgcttttagaagatctactcaagcagatatatggctatcacgtcacgtgcagagattcttccaaatgtgctaatgaattagcatttcacttcatagaagcactgacaaagaatcttcaactcttccacaagatagactggtacaacatggatgtatttactttcaagaagtgcaaattactgaatgttaacagttcatatctagtatataatgcatgctttgacataacagggataatatggtgacatgataaaattgattaatttcaagctgatgcttttccagtgtgctttcatggatcatgctctacttcaaataatggaacgctttgctcaagccagtccaaataagcaaaacccttcttcgttgtttcacttgtacatatagctctttgctatcttgcaaaaggatttctagatcctgatattaaatctacatggcagtccaattcatgatttgcatattccaattcatgccatgaatatggttcttgtatcaatcttgtagtgcggtgtatttgcaactttcaagaagtcttatcctccttaaacatgtcctgggtactttttgacagcctaaactctatttgctgggttattctagataagtatttgttttttttggtactttctaggttccatagttccacccatgcaacaaattgaatgctatagctgtcattgtggggctgtgggcacctaaacttaatttctgatttactgtcatcccatgacccctctatcaacctccagaatatgttactgtggcctttgctacttaagtgcattttataatttctaaattgaatgtctcaggaaaatgtctggaacatgccaggtgttatggttttcattgtgcaacacataattggtttaatagtttctaaatatgattgtgcacttaaccatctgttgattcaacttgccagcataaatagttccaactgaaacgcagtttatgctcaaaacgaatgaccaaacatggggtgaattcttttgtcgaactatcctatcttggtctacaggtaccaaatccttaccattgctcatgtgatatgcccccatcagcatacatttaaaccagcatgatgtttaattaattaatcactattgttattgttgatgaatctattgatgatgtgcaggctgtttataactcaaaccggtgcgctaaacttgtgaagtaaaactgcttggactactaacagctaaagtttcaaaggcatcctgcaaaaggacctattggtctgaactttgaagggtatttttcaaacatttttgttcgtttgttcacaacttcacatgaatatacccaagttctttttgcatgtagtatttggatgttacaagcatgtccacattttcggtgctgcaaacaaccagacagggtccctgtggttgctggtgttgtacagaattgctgaacacatcatttactttgctggctgtcaatctgtcatgtatttggatatacacccgtatatctagataaagttagaaattacttggaagaaagcactaacttagtactcgtatatgccatttgtgacagccttttttttctttcacgggaaacggggactttgtatttttattattatactcctgttctgtaccgtgtacagtgcattgtataagaggacttttaaatacagccgattcggctgtgctgtgctccttaaataattcattaattaattcattgttgtattcgctggtactactagctgccatcttttgaattggcatcttgtacactgctagtactccactactattgcctgttgcttgtaaccattgcctaccacacatacatcttctttacatctgtgtcttcttcaacaaccagacctccattactccacaaagctgctttctccccctccttccctaggtatcctcaatggaagctgcttcctagatccagccccaatccacccttccttccaagtccccatatccacaaatcaacacaccatgtcttcttgttcttcctcctctccccagaaagccatagatgctagttatcaactatcaactccatggatcttgttcttcccagcttcaaagcccctccaacaccaaagttcagatctgtcctccttcccttcacctagctctatattagaagcttgtgagggctaagatggccatggaggacaatgaatcaggggcaagatgaactctaagatggctggccatggatgaagattgaagctgctattggtctatgaatcaaggtaaagagaatcccttcatcttaagtagagatatgcaccatgttgctggctttagtttcaaaagaagttcaccgagggaggtccgtttatgcttgtccatcttctgctttggattggaagcgagaacggcgaattacaaaagaatttgcagcaaaaatctctcgatatctttgcctgcgccgcagccaccgaaatctcttccttgccgggccggcccagctgagctcgatccgccccccccccccccccccacaatatcttccagagacatccattccccggctcgatgagattctacgtcgcatacataaaccacagtctaaaccctaagtgaacccctcgtcccattcgactcgccacgcccccgcctccgccgccgcctccgcctcgtcttcctccgcgtcggcgatggcgaggagaggtgactcttgtctcttgccgccgtgggttcgccgcggttgagttgtatctagcctaacgtgcgcttcgttttgcaggggatgatgaactggatcagacgtatcatcttctgtatcgcccgcgcgcgatctggggccgccgtccccgccccaacggtggccgacgccgccctcgccccatccaagggttgttccgcgtgagccatccggcggtgaaccctacagccgagcccatcaggcggcaggtacgcctctccccttcccttacttcccctctctcccctcacttatttccccgatgggatgcaatcctatgcgaatcctgacctgtgatctgtctgattatgctgttctcttcaaatggtatgcccttgtcctgaaaatgctgaaaagtacaccatcacttatgttttgaaattcaattttgctattaaggaactgttgatatggtaatcttcacaccaacttgaaattatcatccattagcgtatttctgaacttagctgtttattaagggaactgttgatgtcgtcatcttcagaccaacttgaaattatcatccattagcgtagttctagaatttgctgtttaaaggaacttttcggaccaacttgaaattatcatcgattagcatgaaatttgagaagctaatgttgcttgtgcctgaaaatggagaaacaacttgaatgcctgaaacttactctaatttgtttgcttagctgtaaacatggagaatctaatatcgcgttgcctgaaaatgcttattagggccagttcttttttttgttgtacctactagattatcgtgggcattacagctggtatatccacgaccttctcctccttaatctttagttctcttctgaaattgcctgaaagcacaaaattactgatgtaagttctgaatgttgctgtggcagggatgcattgtatgctcattgtgtatcttgattttttttttatttatcttcttgtaatgaagagtgagccttttatcattgcatctttgcagttcctggagcagctggattaccctttaccaactatcactggttctgctctgttggatgagacaaacctgattcttcatgatttttacaagaatatatctgacatcaggtctcagatctacaaccagcaaggtctgtgacttgcaaagatgaatgttgtcaaggaacaagctctatgggaagaagctgaagagctcgtatgcatttccaagaagatcttcgattccactaatcttgataagaagctgctttaccccttccctagttggtttaactcaaggtatgatgttatgatgttgttttgtgtttttttgttgttttgaatttggttagcattgattaacaggggagctgatgattgtttttgttttttctagggagactaggaagaagaattatctagatcttacatcttgggttagtttgcttgagacgtatgctaatgagaggagtgctagccctgaagctgatggtgaggcatatgatgtgggtcttcttgatgacaagactggagacgccagtgctgatcttgactatgaaaagagtgcctgctctggagagacaagtgatgctgcctttgatgaagagagtgctagccctggagacgctaccaaagaggctgatattgatgaaccgattgctatcctggggacgccaatggtggcaagatctgtagagtggaggcctatggcttgagttcttcagtgaaggaaaagtacttggataaatgcttcctaacgttgtcatatattcctgatattgtcatgtgtcatctaggtatcatctaggaaagtacttggataaatgcttcctaacgttgtcatatattcctgatattgtcatgtctcatctaggagaagttcagaagcccctgaggcaatctaacatcggctacttatgccgtgataaaagactttgcatggaagtattatctatttcagaatcttgtatgcaatcaaacaactactacttattatggtcttatggataccttgcttgcttatcttatctacagctacggtcattgtttcgttatccaaaaatgtttacagctgaagccgcttgaatggccatgctgctactgcgctgtgaacgtggcgtggcacatgttttgtaaaacatgaccatatggagtgggctatccaggtttgcaaaaccaccggtaaccgtgctcttaccgcggggtactgtggtaaccttcttaaattcaaataaatttaaaaagtaatttgaaattttgataaattttacatagttttgtacgttttgccgcagctaccgtgtagtaaccgtgggaaaccctggtgctgcccccgctgcaccgtacattcccgttcgtcctcaccgtcgcaatttcttcttcgcagcctcagccacctcggtttggtgagcgcggccgtctgttaatagccccccgcaggaaggacatcgtgttagtgcactcttcattcaggattggggaaataaggtagaaagatgaatgtgcaattctggcactttggggatctgtcacaggactaaaattgaatccaaattaagtagggtgttaatcgtattggacttggcgtccggaagatgtttggctgtgttctttggacaattttcgtaacatcactttctcgattttctatgcacgtttttgcaaactgttaaacgttgtgttttttttaaaaaatatttctatagaaaagttgctttaaaaaatatattatctattttttatttttataatacttaattaatcatacgctaataaggtattttgcttttcacgtggaaggaatgagttcccaacataaggaattaggtattgttgttggtggtgaactctggtagttgataatggtatttagactggactgctttcgttagttgaaaaaaaatgcagaaaagcattcccttggtttagcagccccatcttctcgattatacttatactctctccgtccaaaaaaaaaaactcaatttagaaggggataactaatcaaccaaaatttgaattttcaatctagaatttggagttgattttgacgtttttgtttgtagtttatttctcagcatttgcttttatatcgctaagaacacgtattttatttataaattattttcgtttgtaaatatgccgtttggcttattcgggtttcttctgtactttgttaaatcctttagtacttcgatggtccaggagtgtatggttcttttagcttctagaaagttttagtactgcatgaagtgtttcaaggtgtcagatttctgttactatattccaacagctaacaatcgtgttaaccttccacaatgaggatggagaatttataaatccatgatataagttaagtttttttagtgtacttattttcaaattttaatgcttgagaaaattcaccttttgtcgttgaaatgatttatgagttacttcctccgttttatattataagtcgctttgaattttttcttaatcaaacttaaaaatgatcaaatttgtaaaaaaatatagcaacatttttaacacaaaataaatatattattaaaatatattcaatgttacatttaattgaactaatttagtgttatagatgtgctttaatcattcaatgtgtatatatatatatatatagcttcagttataactgttggatgcactttccaagttcaagtaaattgtcaatgaaaggcttaaatggatgtatagaactcaatgcatgtgaaagggcatggaataattttcgcgtctcaaatgaataacagacaaacgatcatcaaatgctcatcatcataaccaagcagccctctatactgaaatttaagtgaggtgcagtcattatttataaagccaactgtaaggtgcatatagtaatctgttcttttcccacgtaatgggtggtttatgtttcttgatgttctctgtaaattttgctgctttggctgtaaatgttctttgtcataattcacatcatgtagtaatctgggtccagtggatccactgtctgtggttaggcttagtcaatctcttggggccaagatcactcatacccattttactttgaatgaatttggtggtttttgaggcagtttgtcggtgtatttgtattgtaaactgagtggaaatcagcagtgtttcatctgcggatcaattacaaagttttcaaggaaaattgatgttatggtctgccaagtataaaaaaaacatgtggtatctcttactatcgaaatccgtgcaagttatcgagcgattagcgatgccacgtggcacagcgtggttcgtgcgtgcgctccaaaacgcgaaaagaactaaaatataaaagacaatcttacgttggagtataatgaaaaagtgcaaagccacctgatttctccgaaagggccacgactcttcgtcttccttgattgactcttcttcttctctgtatatatattcattctccatcattcctctttcctctcgtcattgtctcacattccttcttgccgttccaccatccacattcaccggcaccaaacaccaccatcaacatccaccggcaatacatctgatccaccgagggataaagaagcaacgacctccagccggtacctctgcggcaagcacatcctgcgccgtgcgcgacaacacaacgacgaggaggaaccttcgaggcggtggcctccggccggtagctctgcggcgagcaggtccggcgacaccaggacgaggttagtgaactgaatcacatgtattagtgaacacgaggacgaggtcaggtacacgatcgcctgcattaccttgcacgatcacgaaagcccccaaattagcccagatccagtagtattttgcattttgatcgattgatttataccgaatcaaagaacatcaacaccagcctactgcaacttgccctgatcctgatgatgtgcacgatggacaacaagatatactatatctgttacttctctgacactatataggagtattagactatttgttataatataagtcactgggaacggaagcaatcggaaagaaatcttacgtccagccacgtcttattctgtcacctaaatctccaatgacaacttagtagagaggacatatggatgtgttccttttgatttctgtttgatctttgctaacaagtcaagctttcgtgtactcctaataaattaactcatagtatattacgatgaccaccattccaaactaactgttttcaattaaactttttaaaagttattcaaaatacattgatttatatagtggtactatacaatgtagctgtagcctccacttctgatccaaacaaacccttaattgacaaacctaggtacttacatgtaattatactaacttcaatcccgtaaatcaattagtcacaaagtctaatcttttcctctaaataatttgcagcaagttacagcaaattttactttctatttagaaaagctatagcacaaccaatcagctgtgaataacatttcgtgtagtatggatatttaccagaaaaaaaaacattgtctattctttttagtatttttcatcattgtacattgatcatctgcaatgatattagtaaatgtttattttacaggggataaaagaataaggaaaagaaaaggagataaacaggagcaagacactgaagctaggaagtacaaaaaggtaaaaaacaataacgagctggaaaattttatatatatatgtgtatatatatatatatatgtgtatatatatatatatatgtgtgtgtc

SEQ ID NO: 900 - DNA, 1114 bp, Oryza sativa
gcactgaattttagtatggaactaattaaaaccaataaccattcagaaatatatataaaaatatcaaccctatctattgaaatttgaaaattttgtgcgatggttgtaagaaactgtaatacaaatggaatggatgtactgtacaaaagatgtacgctaggaattattagagaatggcaatagaatagctctattgccccattgtatgtatgatcaataattgtagctcctattaatctttgtcgtcataaatattgaagtgtttgtattagctaacactttttttactattcatgtgtaattttctgattatatatagctgttgaaatgaatgattaagttttgtattgattcaaccaatatctttaattattcatatttaattttatgcttatattcatttctgactttggctattttttgtgcttatataattagaagtgttaatatgccatcaaagagaaagcaagatccaataaaaatagcagaatatgataaatcagattgcaagaaaagaagatatatcagactacaaattctaagagagaaaaagcgaaaaagagaagaagaaaaaaaatatggtgcataataacaataaaaaatgtaagaaagatgaagaagaaacatcaaaaaatagtaatataagagatataatatatacagaaaagcaaaaaaatattaaaaataaaagaaaaatacaatataatttagattatctagaaaaaattgcaaaaaagaaatgtttagagatagaccatatatcttcatatttatcaactttacatggcatggtgtcctttaccccagaatacattaaatatctaaaagaatcatatgaaaacaaatcatttataggtatgccagagtataaatgtaaacattgcaatgctatattttggtttgaagaaagaaataaaagagagacaaagaaaagaaaaggtgaaattatatattcaaattgctgtaaaaataacaaaataaaaataccaccattccagaacccaccagaaacacttgctaggttacttaataataaagaagataatctatcaaaacattttatgcagaagattagacaatataatagtttattttcttttacttcaatgggtgg

SEQ ID NO: 901 - DNA, 702 bp, Oryza sativa
aaaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagctttcaatacagtagccactggctacacgtggctactgagcacttaaaatgc

SEQ ID NO: 902 - DNA, 428 bp, Oryza sativa
aaatcttactgtcaaacagaacattcccagtgcccagaaaccaacacacagacacacaaatatacacacatacttaagcacagtggtccagacatttatattcttacctttccaaaactccctttaccaatggtccgcagaatttgaaaatggtcaaagttgactgcaaaagagaacaaaaaaggatacaagtcagatttgctaaacctggtattgctccttgaatatccttacctatgtacctacccacctattccaaaggctcttgggtcaggtgcactatacttgccagagcagccgtccacccttatccacaggggaatttgcagcacattccattttttccccagcacacaaattgtccatatgaaacaaacccttcactccacacttcttgatgaggctctgcagtcttgctgcttcactct

SEQ ID NO: 903 - DNA, 863 bp, Oryza sativa
gagagaagagcggagattgctacttagcacacatgtgtatctcttaaaacttttctccgaaaaccttaatttaaaaagtttctttctaaaaacttcatataaaaaacttccgcacgaagtgtacacccaaaacccatgttcgttagatagtaattttggagataaaaaatacactggtagcgagcttgcggcatactctgccgacttagagcagacacggtcgagacaaaaaactgtaagaagcgtaaactcgacgatcatgttctgcactgttctaatttgggattttggatgggccaccggccggctgggccatatcctacatgggctcgtaagctagatgtcctgcctggtccacaggaaacgcgttggggcagccaagtctgagctgtgctctgtatttcggcctgacctgccgtaacgccgttcactgggatgctctgtttgagtgtttctacaattctgctctgatcgaaacgcaagtaacagcagcaattgaggcatcatctccattagtctcctgcgtgtttcgatccaggctgttgagttttcattgccgatataattcagacccttctgacgtcataacgtcttacgaaacatgagcccgttttactcgtatgagttggcagaattgcaagcacgtaaagtcactacctcttcctctcttagcaagaaacagcttgggtgctcgagtcgatgtttcctgaagaaacggacgattccatacatcgacaaaccactctgcactccatgctctgtaggtgtacgtgcacgtatgatttcaatcggacgaactgctaaaaattgcaatgcaaacatattttttctttcacactccattctttaaatctttcgtgcat

SEQ ID NO: 904 - DNA, 1631 bp, Oryza sativa
ttagtaatatactgtgatcaggatcctgattttctttatcaggaaaatgatgaaaaagaaagcactgactatggctgcattcaaacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaaacctctataatatgtcaatactcttcaaatgtctgtcacaaatagccactgtgttttgttcagattatacagtctatatcacactatatgtcacaaaaatcttctaaattttgtagtctactacagcaatcatgattgtgcactatagtatcatgctataacttgcgcttttttttttgagataatacttgcattgttgttaaactgattattctgtctcattagggtcaaatagcatggcccatccagtattgcacgcggcaaagccgcgtgtttttttctagttttgtagctatagctaaaagaaattatggattggtatgtttttctgtccaaaatatttattcacgtttagcactcttatggcaaaattttcaaaaaatgtaaatcaacaccacaaaccgcaatcgagggaggagtagttatctaaagtagtgaaagaaataatcgttctcgtcactacaatgcgccacgtcatctgctcaatataaggagttggatgcaacaaaggctgtgtttaattccacactaaaattggaagtttgactgaaattgaaaatttaaagaaaaaagttggaagttgatgtgagtagaaaagttttgatgtgatggaagagttgaaagtttgaagaaaaagttgggaactaaacaaggccaaaaaattgagcccctactgttggatgtagtgtgtaaaagaggctcagtaaaaaagagtaaacagtagtatttttgcacactgtatgagttagaaaagcaggcagtacctgatttgtttgtgatggctgtatgtattctttcaggagaaaggataatgttctaataaatctaataaataaaccttctgtcatcacctacataatagaaaattactacccaaatgctttcaattggtatgaatagtaggggaaaaaaatcatattattaatatactgcagtgcatagtctgcatacaccatgaagaatttgatttactctttaccagccaatcagcaaataagaaagtcttagtccgtagcaggttataatttagctgatgacttaacaattcccttacaaatgctcaattcctacataccattatcaaaaggtgaacaaaaaaactgatgatatcctctctaccagaaattgtttattcattcaaataaattcgttcactcattttaattttaagttttggttacaaatttcagctagaagtcctcatctgaagtttggggacgagggggagtataatatcatgggcactgatcttcttggtccaagggtagatgactaaatcaactactgcaacagaaagttctcttttaaaacagt

SEQ ID NO: 905 - DNA, 48668 bp, Oryza sativa
  unsure (1)..(48668): unsure at all n locations
atggtggctttttcttactgaatattttattttggttgttaattctagtttgtaacattttcgacttggttgaaggaacataaagcactggtaattccctccactgtgcctttttttatcccgctgctacatgcgatgggaacatcttctcttcaattctgttattgctctaaatgagcatatttttttttattgaaaccatcaacaagagatcaatcttaaatgtaacgtttgaacctttagttggaaatacaggtttgtctagatttaactattcttttctcaggtcatacaattttgcaaagattcaaatataaagtatacaattcataatcatcataattacgatgcatatttattataaatggcttttatacgggaattcaaagtcatgcaatacacgactaagtggctagtggtaatgtatgacaatttatttagtgttatgataatattcttactcctacttatcaatgtaataaatatgttagcgctttgcctgtacaattatatataccgtcaatataattttaagctaattattataaacaataagtaaacgagagagattacagtcgcgccttcgcgcgacttaataaacttgtatagatgatctctggtgcatggtgggaggggtagagagggttaagctgtttatcgtgtcagccatgtgctgggcactgtggttgaaaagtgattaccttgttctgttttcctgtagctgtactctggacaactttgtttctctgggtaggtgtgaacttgatgtgaaattctaggggtttaccgagttgatgaagatttcaatagctaaattatgtggcttcatcattttctaaaaaaaaaagttatgtggcttcaaaatttaataattcataactgattctcttgtatagatatagaaaatcagaacagagcatgatacctacattatgtctgctagtaattgcctttgacctggttagcaatgaatgcgacgctaaccttgtttcgtacactgagataaacatcattggatacttgcagaattttaacatttactattctgaaaaggcttcacttaattccaaatgaggccttgttctttatagaactatctgtttacttctgtgtttgtaccactaagtctgcatcgaaattctacataataatagtttctaatgtgtgggaatttatctcattgtaaaattagatttaattttcagctagagttaaaagaacttttttttttgactcctctgtatgattcacaacattccataatcgcagagtgaatatttgcttatagtatgatcagcccctagataaagagagtaaagaactatgcacacggtaagtcggtaatagtaccatctagcaatcctataaaccaaaaccaaataaaaaaggttacttgaacactcgatcactagatgttttgttattagacaatatatataagctcccgagcagctcgggagcataggtattctctaagccgggaaaatttattcatcggttattaaagtttcttagttcctccggtatgcttcttggtgacccctggtcgacccctcctccttcccggcgccggagctcgggatcgagtggctgcttggtcctcgtcgtcggtgatccagtactcggcatagcctttctcattgtactccttgcgaatcctctcctgctcctccaggatgggtttcgcgccctcgtcatgtatcttgttctttctagcccagtagtcgtccagctgatcgacgggcacggggaaacaagccagtagctccttggagaagttcttgtatccaggtggcatggtgaggggcctgtgcttgtacgacatgattctgtccacctcgtgctgtggcatcctcaccttcttcatcttcttctccttttgcttcttcttcgtctcttctccggccgccgctgccgacgccttcttttctccagccgtctccgtcgctgccggcgagattacgcccttctcttcctcttctgcaaccgccttctccttcgattcctccgaggaactcgccatggtccgccgcgatgtcacggtagtaactgcaatttgcaattggtagtgttggttttagattggggggagaagcctgccgggtgcaaggattttatatcgctataagcagatcgatcgacccggttcgccatcggaatcggcgagagaacaacggcaccgaatcgaagtcccattgccatgaatagacctcttaccaaccgacaaaagaatcaaccaccaacaatcaatcgtatcagggcaagagtaggagaaggaaagtacctcgagtcagtcacggatgagcgacggcggtggtgggggaggcgccgccggagaaccaaggtaggagacgggagaattttttttatttataattttttttattaaaagttttacaaaaataatttttcattttgaaaattgacggaagtagtcgcctaccgccctctgggaaaaatcgccctctcgggcgacggccgtcaacgaaatttgcaggcggccctcttgccgccctccgctagggcgagtttatactgtgcggggggccgcctgcaaatgggcggcgaggggggcatggaattttgcaggcggcccccttgccgctctccgctagggcgattttgtactgtgggggggccgcctgcaaatgggcggcgagggggcatggaattttgcaggcggcccccttgccgccctgggggagggcgattttatactgtgctctatatttttgtataaatatcaatagttatcaaatttttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattatagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgatagctcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggctccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagccaaaacaaaaatgaactaatatctgggctgaactgtaccgtgcgaaaccggtgctgtaggtcgcactgctccgaagctaggggcgctcgaaggcaaacgaggtcctacgaggatggaacatcaagttacgacggggtgatgttttcgtagaaaaacagaaacaaaacttaagaaacctctgggctgagcagtaccgtgcgaaacaggtgccgtaggtcgaggtcctgctccgacggaaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatatgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgatgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtattcgtgcacgcctcacagagggcacggtacgtggctgctagcacggcagaaccccagctccactgcggcacgtcctgtggctgagcatccgcgatggaccgtgcgtagtggaccagccagaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgttaatcccacggttcaacagcgccggtgtgtcgtacgccatacctgcatcaaataggttggtcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcaggcatttcttgtaagtatggccacgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtaccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagacaacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttaccatcacacccaattgctgtcaatatctgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgtatgggttaggtgagcacagcggggctcacctaaccgcatttattgcgcctcggctaaaacgtgtcacactgcacgaagtgcagcgcagagcactcgtttatccggtctgtgaccagtcacagaccggtcagatcacgggttaggtggcgacaggcggtctgacgcacgcttcgccccatcccgtcaagacgagagcttctaggcactcgtccccggctggagctagcgtgttacatcctagagatgacacgttagccccggtcagatacgtgccaggcttcatcctaaccattacaagcaagatgttgtgtgaagaagggcaaacatgcacgttgctaagctgacgcgtggtggacaagaatgaccgatttgtgaccggtctgacactgctcatgtcgtcagcagacagccacattcccacgacgcgcctgcccccggcggaagtggaggtaggtgtgtgccgtcccgtcagaaggatgttcggaggacaaccgtgcaaatctccgtccatttatgaagagaagaaaagtccagtttggaaggagggggtgcatgtggtatccccttgaaatataaaaggaggaccttgcccatagagaaggggaacgatcttttccagattcggaacctagaactagggagaggttggctcacactttgtagctccttcatacacagatccaccaaaacacaggagtagggtattacgcttctcagcggcccgaacctgtatacatcgcttgtgcttcatgctcttttgagaggtcgcgatctttccacatacacagagagcttgggatctcaccctgagcccccggccgaaccggcaaaggggggcctgtgcggtctcccggtgaggagccccgcgctccgtcaatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaataaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatacgaatcttccctctccatttcatcaacaattataccaactctctccccctcatccgccatgcccatagcctgctcctcccttggttgattttcctcattttgcatcgatggtccaacaacatcccctgcattgataggaccctctatatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaggcggccccccccacagtacaaaatcgccctccccagggcggcaagggggccgcctgcaaaattccatgccccccctcgccgcccatttgcaggcggccccctgcacagtataaaatcgtcctagcggagggcggcaagggggccgcctgcaaatttcgttgacggccgtcgcccgagagcgaacggccgtctgccacgtcattttagccgccctctgagagggcgatttttaaaaatcgtcctcccagagggcggtaggcgactacttccgttaattttcaaaatggaaaattatttttgtaaaacttttaataaaaaaaattcggagacgggaagcctctcccgtgtgtatttatcctcaaaatttgggcctgacctagagatgtggtctttcgcggcaggctgggcccaaagaagaaaggtggtggagaaggccacgcaaggaataagtccacttcacatcctttatttttccgtcgatttaattcgctgaaccgtaataccggaaatctggatctcgcccttcgacttgtaaaaaccgggttatcacacaccttcagccctcaaaatcggatttgctgatcctgtgacagccaaatgtgatttggccggcaagattcggcacatcaccaagcctccaattgtcagttccaaccgatagatatatgggtcaattggatccatcccattataaatttgcacgtttaaaaaaagtcattactattcatttattagtaaccatgcatctgcaactaggcctgcaacactctcaaaattgattccatcccatcctgtacactatatacacattttaaatcattttagaatatcaagtgtatcaagtgtacaattaatactccgctttgtctgctctggccgcccactgctgctgccgctatgtgggaagaacgaaagagaggaaaaaagagaaaaaggaagaaagaaaagagaaaggaataagatgatgctggcatgtggacatcatttttttccttctcacgtacatgtggacctcacatatttatttatttatttatttattgctaactagaatgccatgtcaacgaaaccaggcatattatacgtcttgggaccttttttggacagtcttacatagtttagtagtatacatttatgatattacggttagggcatctcaaacagacttggcgtacaatttgagggacgctaggtgaacttattccttaatccgagccctaaaaatggccataaagggagccggttagcccagttactccagtccaggcaagtgacggtggcaggatgtaagtggcccaacatacgtttctcgctgaatggccttatcctcctctaccaaaaagaaaaaaacttctgtacctaaatccggtatgttgatcatctaaaagaacgctttgatgatcccatgagagcaagtctaataggacagcccactactagctccaattcatctatagctaatcaaatagtcaattcatataatagttgcttgctatactattaatatatggtcccacatgtcatacacacagtgtatcttggagtctgtgctgcagctggctacagatctgtagcccgctgctcttctctctcatcgtttatctcattaaaatatgtttagagctggctaatagcttagcctgctattgtacctgctctgacagtgcaaatgtgatttttttttgggagaacagtgcaaatgtgatttggccggccagaaccgggacagaaccaagccaccaatttgtcagttccaaccgatcgatgatactcctatgtcgtacctcaaccgtaacctggacctgagaccacatgatcgtatcgcccacaatccaatagaaaatacacaacgctagtactccgtattacctaccgcctggcgcctggagcgcctgaacaatttcctacgcgtttcgccgcgcatgggagcagatcacgcgcgcggtgtgccggtgtgcgtccagttggcatccggccaccgtcttcaatccggtggttggggccggccggtcggccaggcgccccgggttgggttgccgctgcatgtccccgttagaacaagtataatagtaggctataagccggctaaatgctgatgtggaggagagaagagagaggagaaacgggctgtaaacttacagcaggctcggacacaagaaactctatgagagaggtaagtggaccctatattaattgtaaagagttatctattatatgggtagattgagagaagactataaaaaatcttatagccaacatatcggctatattattaaccttgatcttaggccggtggatgccctaacggctcttgccgttgccgcagtggccggaaatggaacgcagatgcgcgtcgcgttactcgctttccgcttgctgcgcgcagcgcgagaaaaaagcacacgaccagaattccacaaaaccgtgtcccactctcagtctccccaccttttgtcgtgtctccccatcttcacttgttttctcgccaaatcctacgtgagtcgctctctcgagcagtcgagcgcgcacagggcgccccgctgtcctccgcgcatcgccagcccacgcccccgcgaacctgacacgaacatgcgcctcgccactgcagcctgcactgtactacacccctcatcctcctcgatcaattcgtacacactctcccaaccacctccgtcaccctcacgcttaactcctaccccacgcccagcaaaaacatcgtctatggctgtgtttagttggggaaaaggaaatttttgggtgtcacatcagacgtttgaccggatgtcagaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctatataaaccctgcgaggcacgcaccgatcgatcactacaccttcactttctcttctcatcatctatatcacgatcgatcacaaagaggttaacagtaacacatggggttcggctcgagggagatggcctgcgcgctcgtggcgctggtgctcgggctctgctgcgtcggcggcgcacgggcgacggggaggatcgacgaggggctggaggtgatgtggggcgacggccgggggagcgtctcgccggacgggcaggtgatggcgctgtcgctcgaccacacctccggctccgggtggaggtccaagaacacgtacctgttcgcgcgcgtcgacctgcagatcaagctcgtcgccaacaactccgccggcacggtcaccacctgctacgtaagccagcactcgcactgacacattctttgtgtgatcggatcttttttttttcttggctcgtgttcgagctcacgtacggtggattccatgcagttcatgtcggaaggggagtgggatatccacgatgaggtggacctggagttcctcggcaacgtcaccgggcagccgtacacgctgcacaccaacgtcttcgccaatggcaccggcggcaaagagcagcagttccacctctggttcgaccccaccaccgacttccacacctactccatcgtctggacctcgcagcacatcctgtaagctcatgcaattcactcatcaaccaaatgcacattctcagtttataatcactcactcgctcgccgccatggatgccgatcgagctgacaaataatgtatacgtttatcgcagtgtgctggtggacgggacgccgatccgggagatgaagaaccacgcggacaaggggatcgcctacccgtcgtcgcagcggatgcggctgtacgggagcctgtggaacgccgacgactgggccacgcagggcgggcgcgtcaagacggactggtcgcaggcgccgttcgtcgcgcggtaccgcaacttcaccgccacggaagccgcgtcgtcgtcgtcgccggcagggtacgaccagcagatggacgccacggcgcagcaggcgatgaagtgggcgcgcgacaactacatggtgtacgactactgcgccgacagcaagcggttcccgcagggcttcccgcccgagtgctccatgccgtagagtggagtggagacgcgccaaagcctcggtgcactttgatgaacgcggactcgatcgaactcacgcagggcacgcattgacctcgtttttttatttttacttctcttgattgaattgattcattctttctatgtaaagtagatatatatatatatatatatatatatatatatatatatatatatatatatatatatatatatatatagatacaaatagttggcattggacccacgagcagctcgcgcgagggagcgcgtacgcacacgtacgcccacagagcatggagcgccgaggggcgcgtccgtgtatggacgcgcccgcgcctccacgaaacatggactcgcgcgcgcacactggctcaggctgagagaggaagaggtagtgactttacgtgcttgcaattctgccaactcatacgagtaaaacgggctcatgtttcgtaagacgttatgacgtcagaagggtctgaattatatcggcaatgaaaactcaacagcctggatcgaaacacgcaggagactaatggagatgatgcctcaattgctgctgttacttgcgtttcgatcagagcagaattgtagaaacactcaaacagagcatcccagtgaacggcgttacggcaggtcaggccgaaatacagagcacagctcagacttggctgccccaacgcgtttcctgtggaccaggcaggacatctagcttacgagcccatgtaggatatggcccagccggccggtggcccatccaaaatcccaaattagaacagtgcagaacatgatcgtcgagtttacgcttcttacagttttttgtctcgaccgtgtctgctctaagtcggcagagtatgccgcaagctcgctaccagtgtattttttatctccaaaattactatctaacgaacatgggttttgggtgtacacttcgtgcggaagttttttatatgaagtttttagaaagaaactttttaaattaaggttttcggagaaaagttttaagagatacacatgtgtgctaagtagcaatctccgctcttctctcagttactttttctagcatcaagcatcagaagcaacactcagtcagattaatccaatcatttacactttagatgcattatcataaacaaatctagaaactaaaaaagaaatccatctcgtcgattaccaatcctagatacaattggactgcattatctcctggcagtagaccaaggacccgttccacttcgatgaagataaagatttttcagcgcacgattactcaagcattaattgttataaacttaaaaaatatatttattaatattttaaagaaacgtttatatagaacatttttacatgaaatatattatttagcaatttaaaaaatatgctaacaaaaaccaatgtaaaatctgtatataaaaaacgaacggatcctgactagctgtgtaggactacgcactgcatatgtatcgtgtgcaatgcggctcaacttctctaaagtatctacaatactatctccgtttcaatttataaaactttctagccactactagaaaatgcattttttccaacgtgggggtctttttttcgcaggcggacatgactcttggagcaaaataaccgcctacaaaaatataaatcaaggtgaagttcgttgtcgccctgcgaaaaatataaatatattttcacaggcagaccacttaagcgacgcttgtgaaaatcattttcgcattgcaaaaatcgtacctaccctaaaaaaatataagtcttatcttctcatccaccccctccccaccactcatttccctcaacacttctccaatccctcccctcccctccctccctccaccggcggcagcgtggacggctcgacggcggcggcggcgacgacggcgcgcgcggggcggcggcgatgcacgtgggggcggcggcgaggcgtgtggcactatttttgtttgtttgtttattggattttcgcaggcgagccatggccccaactgcgaaaatcgcagtcgttgggctgcagtcggtccttccccgtgccagtaaaatatacttttggccgcctgtaaaaatgctttttctagtagtgagcattgcccatatttatatatatgttaatgaatctagacatatatgtgtgcctagattcattaacatttatatgaactagcaaaatgcccgtgcttcgctacggtgactaaaactaaaactatttgtttttaaccaaagttatttccacactactttggtacttttgctcgctagaaaaagtcttaaatgacagagagaaatatagtagctcataataaattatttttcaaaaaaaaaaaatcgaagaaagggagataaaaaagacaaagccggcttgatttccacctttacacggtccaagttaacatggactctgaagatatgggtagatctaccgggtcgctcagcagcacgattggccagcgagcaacctcagaccaatcgacgaccgtagcaccgtaggtagcagccgtgtctggccttctgcgacagcgatgactatgagtctgtgctattattatttcaatatttcttatttttaattatggccttcgtccgtcttgtgatgaagagaaagttacgaatcttttaattaggtaagattaagatatagaattaaacttcttttctttggtcgagggacctagaacatactttttcccggcctggccggtcagcccacgacctcttatacgcacgtgcgggcgctccccccaccctgggccacaacctgggcctgggccggggaagccaccctgtgcgcgcctccacttgggccggtgtcggttgtccgatcgtagggtttcgatcggacagccgggtgctgacgtcggatggacaaaaccccatccctctcggctgtcggcgaaaaccctagtttctcctcctctccctctcgcctccctcccgtagtggatacaacggcggtggtagagggttggaggtggtcgcgggcgaatccagggtggtggcggtggctctctccaccctctcttgcctccctcccgcaccagatctggcgtggtggcggcggccgcgggcagatccggcagcagcggctccctctgccccctcttgtctccctccagcggcagatccggcggcagccgcgagtggatctggcggcggtggtggcgtcggcgacggtcgcgggtggatttggcagcgtggtgccagtcgagggtggatccggcggcagtcggcggtggtggtgtcaacaacggccgctggtggatccggcggcggccgagggtggatccggcggcagttagctatggtggcatcgatgacggccacgagtggattcggcggcggctgatggcagatccggcggcattccgcggtaggggagtgaaagttatgtgattatgttgttgttgttgttcttggatgtgaatgtgaataatgtgatgtttgatgttcttggatgattattatgtgattttgtgttgattgtggttgattttgggggcaaagagtggttgattttttttttggcaaagcgggaaaattgcgtgggcaaagaaaaatcacgcggacggactaaatcggattgtgaaaaaatcgcgcggacggacaaaataaactgtgatgaaagaaaaattatgaatattttaattagttaagattggatggctagatgacaaatccgacctcaccttctgccatcgatcgctaggcaagaagctaagctagctacccttccaaacaagagagagcttgtttgaagtaaaccgaagggcatgttatatgcgctggttttcttaaaaaaaaaacgaaaccaacaaatgtgctggtctttggagcgccgcacagcaaagaaaaatatccagcgtggaccccacctctcgaacattatctcctcgtgattctccttctctggaatcctccgtctccccgtctctcgttcgctttctccactcccagcgacggcggcatgccttctccacttcttttctcaccactcccagcaatggcggcgcaccttctccctctccgcgccttcttcactcctcacgacggctgcacgctttctctccccgcgacggcggcgcatcttctccattccccagctcgtcactcctcagcgacggcggctcgccttctctactccccgactcgtctctcccctgcggtgaaaccaacggctcaccactccccggcgacatgatggtgcggcctccacagatctggagccgcctcttccttgtctccatcacaacaccaggcacgcgtcatccccgacaccgatgccaaaggtcagtttcccccctcatcttctcccttcccccatcctctatacctctaatgtcgtcggaagcggttgtctgcagggtagcgagtggccagaattctccacggtgagcaacggccacaagtggtcttgaatttccaaatccgtgtgataaattttgtaatattgattatgtgatgtgtgatcgattatttaatgtgtatattatgtgatttgttttgttggaatcatccatttgttttatgaactttgtgattctttttctctcttttctatttattttctatggatttggagcgtttgagccgagcctgctttttttttcttttgcaaatcatatcaccaccaaagaccggttcccaaccggcaataatgtctatttttgtagtagggtagtgattgggttttgatttggattttgtttccgatttcggattgagcgattttgttctttgttcgtcgtgtgatacatgcgagggcggagggcgtcacttgggcggagggcgtcacttgtggacgaaaacgtaaaaaataggaaagttactcacgcagcgtggcgtaaacggattggcggacccgaaaattttggtgacgattaaaaaaatccaaatatttatattagttatagatatgaaagtgttaacctgaaacggaggaagtagtcactaccatataggccctagagctagtgggacccacgtgttacgatctcgttcccgtgcaatgctccggccgagcagattccatcggtcctcggtcccagcaacgctcatgtgcctggacatatggaaaagccgaaataaatggctcgggttgatcatgcatcggcctcgccgttgttgctacatgatgccggcggaacggaacaaccaccacagaatttcaggctgcgtggaaactgatggacgccgtgcaacgcgtacacttccacatgcttttgcacgctcggtgcagctcatggctctcgcgtgcccttctttttttaactgcagcacagggctaaaaacatgttaccgtcatgctgcaggcgtgattgtgagatcgagtcgtcgatccaagtttgcagtcaatgcaaagtcaggcctggtttagttttctaaaaatatcacatcgaatctttagatatatacatgaagcatttatttattatattattaaaggaatagaaaaaagagcctccacgttcgctctcatggtctagaatttctcacattaattagagaaaaagaaaatacagagtccatatagaaatacaatttagaaatagttgaaattcggaattaaaaaataaggaatattagaagaggagactagagtccatatagaaatacaattatgaaataactgaaattcagaattaaaaataaggaatattagaagtagagtatagagtcaatatagaaatacaattaggaaataactgaaattcggaattaaaaataaggaatattagaagtagagaatagagtccatatagaaatacaattaggaaataactgaaattcggaattaaaaataaggaatattagaagtagagtatagagtccatatagaaatacaattaagaaagaaaatagaaattcagaattaagaaaataaggaatattagaagtagagtatagagtccatataggaatttaaaactaactaaaatttagaataaacataataaaatcaaaagtagagtttagagtccatataaaaatacaatttacaaataacaaaaattcgaaattaagaaaaacatgggaagaagagtttaaaatcaatataggaatgcaatttagaagtaactgaaattcgaaattaaaaattagtctagagtctacatagaaatacaattagaaataataaaaattcagaaataaaaataaataatattggaagaagagcatagaatctatatagaaatacaatttatagaaaatttggaattcaaaaaaaaaagaaatactaaaaaatgagtcaatatatataatttacaaataactaaaatttgatattaaaaataattaataactaacacgtatataaaatacaatatgaatattacacattagtagttttgtaaagttattgcaaaatttaaaattatgttgtcattttaatatatttaaataatataatgagaaaacatactatatgcttttatatgagagaaaatataatgatattagccacgcaatctgcgcgggccaccatgctagttaaatataaatgaagaaaaactaattgcacagttagaggggaaatcgcgagacgaatctttaagcctaattggtccatacttagccatacgtgctacagtaacccacatgtactaatgacatattaattaggcttcaaaaatccgtctcgcggtttacatgtgagttatgaaattagtttttttattcgtgtccaaaaaccctttccgacatctgatgtgacaccaatttttttttcgtactaaacaggccggccctcagtattacgcgcacgtacgcacagagattgaagaagacagaagtctgtacggtgaacagtgtatgcacatgagcaacgctaaatgctatactgagctgcatgaaaaatactggggccgtacttctctaatctctaggattgtaagtgcatccatgtgttcagaacaattgcaggcttggcagaggcttagagctagtgatgctctactgaaacggtgaaatgtgaaaatagtattgcactctgcaatgaaatcaagacaaaatatgcagttgtgttcgtaatatgtcaacagatgtgaactaataattggagaaagcacgacaattctcggttatcgggtattccttttcttctgagagttaggccatcagaaattgggtaaaccaacctatgttaccactccatgcgaaacacagaattctgaaaaatacatggcgcagctctcccactggagtaatggacatgtgacgaacacttaatcaggtcaacttcttgcttgttttcccagctctgctcacctttagctacatactcttccatcattttctatgcctaggtcttcactagccagcccataatccaaacttctttacatcttccaagaaaccaaatatctaatgcatccatcgccgagttcgatgagatcgatctgaaagtcttttgaccctggtgctattgttctgcatatagcctgcacttgaccatggcctcactgcccctcacacacagcagtacatcactcactcactcacttcacagtttacaccaccggccggaagccatggcgccggctagggcgcaccacctcctagcctgcctgttggcttctgcgctgctcgccgccgccacgccggtgaccggcggtgggctcatgacggaccagctcgaggtactgtttggccagacgcagctgctcaacgacagcaatggcgaccagacaattgcgctgacgctagaccgcgagatggggtcggcgttcaagtccaagacctcgtacctctttgcaaggatcgacatggacatcaagctcgtcgccgacgactccgccggcaccgtcaccacgatatacgtaagtgaccatgaaacagcagctgcacctgcacagtgacatgcatgtgccaaatcgtcagttatatagttctgcattcttgagtagcttgtgatacattgcgtggtgcagttgatatccgagaaggattggaacacccacgacgagatcgacctggagttcctgggcaacgtcaccgggcaaccgtacaccctgcataccaacatctttgccaacggcgaaggcggcagggaggtgcagtaccggctctggtttgatcctacccaggatttccacacctactccgtcatctggaacccagacgagatcctgtaagctgcatttcaagatagtatgttaatggtgtaaaaataggcttgttgcgttagaaccggtaaaaaagcattgagccaaatgtgtatgccagtgtcactaaagtcggtgaattgcaggatcctggttgacaacatgccgatccggcaattcaagaaccacttggactccggcgtgccgttcccgatctaccagccgatgaggctgtttggctgcctgtgggacgccgacgactgggcgacggagggtggccgcatcaagaccgactggtcgcaggcgcctttcgtggcatacttccggaactacaccgccgacggctgcgtgccgagctcttatgcgtgggtatgcggccagggcccggccagcagcagtgactggttcgaccgggggctggacgacgtcaagcagcagcagcagctgagggaggcccaggacaagtacatgatctacaactactgcaacgaccccgagaggttccccgatggttatccaaaagagtgtgggttgcagtaggatagaggtggctcggtatgcatgtgagaagtgcgtgaaatgtaccgaatcaatattccttttttgaagattttactggaatattgagattgtttcattctttgccccgaggaggaaaaagagagcagaaagtttcagaaaaaattgaaggttttcgatttgagtgtttcggtctgaatgaaaattttcaaaagcatttggaacttttctattgttttgaaagtttttgttatgctcagacactcctcctgccccagatcagttgggtatcatgagatacctcaagaacatgggcccagaatgaagtaaactaattctgtaatgaatatatgaaaataatggtgacaaacaattcattacaggagaaaaggttgataaaactcatgacaagagttttggttcttatccattccatcagttgactgtcaatctttcatgaggacatattctagtttaggaatcctactagcacctattttcctagtcttgatagttttaggattagtctatttacaacaatttttgcagttccaatgtataatggggggggggggggtgattttgcaggtctgaacatcatttggaagaaaaggtaaaagtatgaatggcgcatgcccctgctatatatagcaaatccacaaacaacccacttccccatccgcttaccacactaagtgcatgcactcacaaatttaccttttctttgccttaacccgttttgcgcggatggccctttacttttcccctcttgtcctctctccggactctgggtcgtcgcttctctccccacaaggattttctaaatttcattgccatcaagaacacacaggcttcaggtaagagggtctatctgcatttgtgttcttttatttttcattcaatgacattttttatgttcctatgatccttttgtgttctcgggtgtaatttgttgccaactatatcataatgagcttttgttggtgtttgggtgaccattgtgatgtttgaactatgatcatatcattcatctttttcttaaaaaaaaaaacttgtttgcagttccagcatgatgttagcgtcgttttgagacaaaatcaggaaaggctctttcacaacatcaagcatgtcaatttctatgaaagatgtagatccggctttccgtggagttggacaaaaggagtatcctcactgcattctatttccaatatttattatggcttggacacttgatctcacagaaaatacattttgtgaccaaaggattattactgactcacacacaaaaaatgtcaacatatgtaatcatggatggaatgattgttaactgttcttggcaacaaaatcatccaacacaagaggctaagcataattgttcctggatagtctaaaaaaataggcaaagctggaacaaaaggctatcatgaatttataatctattgcatctataagaaaaagtagttccatagcatcatagggtgactaaaccaaacaaaaacaatgatgaagttaaagtaaataccagtcaaataaaactaaggttaagggctgctgatttatcctcacaaagttagacttggtcatcaacccccatgagaattgtagccctccactatgtcgatcagaggagtcttttgtacatgtattgtactccttaattaccttacagtggtttggaggtatggcgtattgaaaacttcaagcctgttcccgtgccaacatcttcacacggaaaattttacatgggtgattcatatatcatcttgaaggtatggtagtattcattccttgttattccttttcaacattattggtgcataatcgcaaacatagatgatgtaattcatcttgaaacaaacattacatgacattataaactattttctttctttatcttttaccacactagataatgcaatacttaagtcattttggtgaaccacatgcttcactaaccataccattgtcgtcttgatgccacaatttgtatagtatatggcttcaagtttgttcatgcattatatgcttactgcaccatgtgttttgaacctcatattcatctttcttcctatagacgacagccttgaaaaatggttcatttcgccatgatctccactactggcttggaaaggatactagtcaggtagactctcaaataatctggcagcacctcacttgacttagctctcccaagctaactattaatacacaaatgcctaatatttgaaaggacgaagctggaactgctgcaattctaactgtggagcttgatgctgcccttggagggcgtgctgtccagtacagggaagtacaaggcggtgaaactgaaaagcttctctcctattttagaccatgcatcatgccacagccaggaggggtagcttctgggttcaatcatgtagaggtcaatcagcaagatcatgttacccgcttatatgtgtgccaaggaaagcatgttgttcatgttaaagaggtaatctattgaagttgatcactgcctttgtttatgcaaaggcttgctgggttttttattcttatgctgcttgtcatacaaaccaggttccttttgttcgttcatcccttaatcacgaggacatattcattttggataccgcgaacaaaattttccagttcaatggctctaactcatgcattcaagagagagcaaaagctcttgaagttgtgcaatatatcaaagatactttccatgagggcaagtgcgaagttgcagctgttggtaagcttttttttttttgtttatgtgcttttgctttgaatattcaaagtcacatttaaagcatttgacaatctggattcctctcatagaggatggaaagttgatggccgatactgaagctggtgaattttggggtttgtttggtggttttgctcctctcccaaagaagacatcttcagaggacaatggggatgataaggaaactgtgaccaaattgctatggtaatactcaagtcaaatcactatcaatattccaatacccgcatcaagaaagtgttagttttgaatgagaataatttgcagtcaaatgatgctattttgagatcaattctcttaaaatttatgaaactgaattagtgatttctattacttcctcccagttttaaccaaggaacgctggagcatattagttttgaatctttggagcatgagttacttgagacaaacaaatgctacttgttggactgtggagctgaaatgtatgtttggatgggcagaggtacttctttgcaagtgagaaagggtgcaagtgaagctgctgaggtaatttcttattggccatatgtgtatgaaggttctgattattggaagctgatttttttttcattggtactctccattcaattatagtgttatgaaacaaaaagggaacatcaaggtagaacttggctacagcaatacaacttttgtaaaagtccattcatttccatcttacaaataaaaaaaaaactatttggcatgtattccagtactcagcaaatgtaccaccttactgatataccatgctgacttttttaaaaaatatatatattcttatgaccaaaacacaggcacatttcacatttcactttgctgtgtgtgtttctcttacttatttacagaaattgctcattgatgagaaccgaaaaggatcaaatgttatcaaagtgattgagggattcgaaacaatcatgttcaagtcaaaatttaacaagtggccgcctactcctgatttgaagctgtcatctgaggatggccgaggcaaagtggcaggtgattgcctacagactcattagttcaagcgtgaagtattgctaaaagagtatcaaatgtacacattcatcatgtatattcttactacagctctactcagaagtcaaggattggatgttaaaggattgatgaaggctgctcctgaagaagaagaaccccaaccttatattgattgcactggtcatttacaggttttttttcgatagctgttatgaatctgtattgctgtgagcaacaatccttttaaatttgtttgtctacacatcatttagggtgctagctaggttttgaagttgagacctgaagcctctcaaacgccaatgtactcatgcaaaaataaattaatagagggtaatcaacaaacactataggtgtgtttggtttggggaccaagtgggatgggttagaccaatcccagttttttaggatgggatggttccagttgtgtgtttggtttgtggtatgggatggttatagttttttgtttggtaaaaatgattgagatgggatgggatggacaatgttgcggacgaggcggcgactggtcgtggaggtgaggagaggcgaggcgaggcgcggactagtgacggcggtcggccctggaggcggtcgcggacgagccggcgaccggtcgtggaggcgaggcaaggcgcagacgagcggcggccggtccctgaggcgacgaggcgcggacgagcaacgtcggccggtcgcggaggcgaacgtggacgagcgacggcggtcagtcgcagacgaggcgccggccggtcgtgaaggcgaggcgaggtggagggagcaggcggaggaggacggagcggcaccgggggagggagcggtgccgggggagggacgggtggccgtggcggtgccgcggcggagctgagtgggaggctgtgggagctgacgacgagcggcggcggtcggtcgtggaggcggtcgcggacgaggtgacggccggtcgcggaggcggaggtcgacgcggatgaggcggcggcgctgcggcggagccgagcgggaggctacaggagctaaagccgtgggctccattgaagtgggatggattggtccggccgattttggcggaccgtttcatcttggatctgagaggaatattcctctccagggaccatcccgtcccactcacctctcaaccaaacacccctaaaagtgggttcatcccatcccatcccatcccatccttgcaaccaaacactacctatatgtatgcaaaggcatctaactaaatcatgcaatcgatctacacccctctatctttgacagtttgatgtccatccttgaactaacatttttacattgcagtcaaccaatttattttagtgaagtttgatggtgattgtacaggtctggcgagtaaatggcgatggcaagactcttctttcatcttctgatcaatcaaaactttacaccggagattgctacatttttcaatacacatacactggagatgataaggaggaatgtcttattggaacttggtttgggaagaagagtgttgaggtaatatctacgcactaactctagttatgaaaaaattgaaataaacatacacatagatttataggacatatgtgctaggaactaattaaatatttgttgtgaagtcattagcaaggactaaggataaagttagcagtctgatgctgttagctgattttttctagattgataggacaacagagaggtttgcgtaatgtggtaactgtttaacttctgtatgataaattcaagtttctgcatgtgggcgatcttaattactttcaggaggacagaacatcggcaatttcactagctagcaagatgtttcaggctgcaaaattccaggctgcccaggtaacctgtccattgtccatatatgacatattacatcacattatcactctaattcattggtgcttccatgcaggctcgcctctatgaagggaaagaaccgattcaatttttcgtcatatttcagagtcttcaagtttttaaggtttttcttctactcagtagataagtcaatatccttgagtggatctgacagagtgactgttagatatatataacaatttgacacttaatccctctccccctcacaccggctttctaatgtagggtggacttagctctggatacaagaactttattgctgtaaatggtaccgatgacgacacttacgttgaaggtgggcttgctctcttccggattcaaggctcaggatcagaaaacatgcaagcaattcaagttgatgcagtaagtgcaaaggcatctgtttggtccagacatatgcgagagcgtaattcttatattgttatcaatggtttcatctctatgatccttttttactaggtgtcttcgtcattaaattcatcctactgctacattctacacaatggaaacactgtgttcacatggactgggaaccttacaacctcactggataatgacttggttgagagacagctagatgtaattaaggtgtgaatcacttattgcggaaaatattaatctttatacccatgcagttttcctgacacttggtatgctcctatacatttaaatccttgattgaaatcttacagtaggttttcatattaattagcaaaatgcagtttgaatatcgtagaaaagaagagaaggctatatagttgatcatgatgcgaccagattataaccatgtagatttattagatacatattaactatatgagagatacaactataatttagttaattgtgaatcacttattgtggaaaatattaatctttatacccatgcagttttcctgacacttggtatgctcctatacatttaaatccttaatcgaaatcttacagtaggttttgatattaatcagcaaaatgcagtttgaatatggtagaaaagaagagaaggctatatagttgatcatgatgcgaccaaattataaccatgtagatttattagatactccctccgtccctaaatgtttgacgccgttgattttttaaaacatgtttgaccgttcgtattattcaaaaaaaattaagtaattataaattattttcctatcacttgattcattgttaaatatacttttatatatacatataattttacatatttcataaaatttttgaataagacgaatggtcaaacatatttaaaaaagtcaatggcgtcaaacatttagggatggagggagtacatattaactatataagagatacaactataattttagaaataaaagcaagaattttgcgaggcgttcatctagcttgttgtaactttatgtgcatgtggatatatacaagtctagtagttatgtatggttattggatgcttgtcatcctcacaagtcataatcattcttcttgatatcatggcttatttggcttatgttttttgcctatgttctgaaacaatcttagctttgatatacgggtaattttaccatccttgagaaggtaacaggaggtaccaccatttctggtgtaaaactgggtatctctaggtataaggtacctgggtaccaaaatttttagcgtaaaatttaggtaccttgaggtactttctcaaggaccgtaaaatttctcgtggtatacatgtccactgaacattgatacaacttcttttttgtgcttctcttttacatgatacagccagatctgccatccaggtcacaaaaggaggggagagaaaccgaccaattctgggaactcttaggtggaaaatgcaagtattcaaacaaaaaaataggaaaagaaaatgaaagcgaccctcatcttttctcatgtatcttatccaagggtaatcaaaaacaaattattgaatgttttgatatggtctacttagtgggattaccatttcaacatctattgacatttttgtttttttctgcacttcaaatgttttgctggtggggtttcatgaagaaaatctaaaggtcagaaaaaaaaactgacgcatagctttttccccccctaagcgtgctctccatgtgtctaatgccagtccttcctttgaaatctacatgatcaggtcaaggaaatacaccactttactcaggatgacctgatggcagaagatattttcgttctagactgccgcaccgacttgtttgtttgggttggacaggaggtggatgccaaattgagatcacaagcgatggacatcggtgaggtattaactaaagttacttgatccgtctattctaattagaaatcacgttttctgtttggcatcttaattcattttctcactgtaactatgctagaaatttcttctacatgatttccttatggaaaatctctcgcaagacacaccaatttttattgttacagaaggaagtgagccacagttttttactaggttcttcacttgggactcagcaaaatcgctggtaagtaattatatttagattcaagatcagtttttgttctatggtgattagatgagcgcccaaacataccccccattttggttttctcacatctactctttctttcttttttttttgtcgcagatgcatggcagttcataccagaggaagcttgcaatagtaaagggtggagcaactccatcgcttgatgtaagtctcaacatagtgctcaagtagcatattgatagaatgcggtccttattgcttgtaaaaagtcactctcttcatcatttttgctatttgttgatacttgtgattagctgtgcacatatgcatgtgataattacttggttgtaccaatgagccattgttaaactcttggtcatctgattaacaaaccaaactgccatgttgagtgtaagtttgaaatatgggttccaagtggctaacatttgatgagatttcatttttcttgtccagttgtatatatagttgcatcatttatatacagttcatgtttggtgatgtactgtcctaccaatgcctttcaaccagggaaatttggcctctgtttcaatctttggggttttacacttaatggcctctctttcaatctatattgtgatttacacttaatggcctctctttcaatccatatagattaccttacatatatatattctttatgcgttgccagaaacctaaaaggcgaacaccagcgttttcaggaaggaacgcaggacaagataaatctcagcagcgcacaagaagtatgtcccacagcccagaacgtcaccgtattcgaggaagatctccagctttcaccgcaatagcttctgcctttgagaacccaagtacccggtatctttccacccctccccctgctgtcaagaagcttttcccaagatccggagggtctgaattgccaaagacatcatccaaacaatcagctatcaatgctctcaccagtgctttcgagggtcctacgaaaagtacaatacctaagtctgtaaaaggtactctatcacctattatgctagaatacggaaggcaagtgttcagttgtcttataattttcctttatgaatttctgcaaaattaagcgagccccgaggcagagaaggcaatacaggaggaaggctcaacgatcggtgaaagtgaaaacgagccagaagatgatgagaacagcacaatctacccatatgaacgtttgaccaccacatctgatgatcctgctcctgacattgatgttaccaagcgagaggtgatcaactaatttttccacttggtattttctcctgatgttgtaagatgaacacaataatatgtactattttcaactgaatgcaggtctacttatcatcagttgagttcacagagaagtttggcatgacaagggcatcattcaaaaaccttccaaaatggaagcaaaacaggctaaagtctgatctccagctcttttagctcaactctgaggaacagccccttgtcctcgccttgaaggcatcacccatttttgagggcacgcaatttccgtgccattctcgagttcttctcttcacctattttggtctgctattgctctaggatcaccctgctctttctgcagtagcaagtaggtcttttggtagtgtttttcttttccctttattgatatagagtgctcatgaatgtttctgttgtgagcctcgcatttttgtgccgctacaaaatttttttaagaaaaggtctatttattgtctctcaactctcatcatcatctctcaactaatggggagagagcaagggcatcactattctctaattccacaaattcacaagttctactgacaacaacgccattccacagttcaacaagttcatcgatatggcacgaaattccgttgctaaacggaatagatacgcgcaggagcagaaccacaatcaaataacgcagtccacttcacgcatgcaagcaacggaaattagggtgaatagaggggatcgagttctgaccttcaaccggttggctgccgagtgccgaggcagtcctggttgcaggagttcggcggcggggcgaaggactccgatggttgcggcaacgccagcggagaagccccgggcggagaggggagctcgactcgagcgagctgcttgccgttgccgtactgacggaccgcgcccacggcacccgtgtcagaaccacaccaaaacacccccgaaatggaattgacgaacacgctctctctcagatttgtggccaccgcaagacaagaaaaactagggttctaagctaagtactagggttaatgatcttcgatagcttttccattcatcacaccgggttatatacccccaggcatctcaggttttttttacagagcagcgagtgagacagaggaagcagagtaaaagcagcgtcgcgcgcaggcgacgacaaacagaaacggtaaatagtacaacaaagcgatcacagccgtaaatgcaccatggtaatttggaatagcctcatctctaccgttcatcttcattaaacgacgtcacccaaccggtatcccactctaactctgaacttctgaatttttaactgaaacttctgaaactcttctccatttcttctctgaaatctccatctctaacaatccaatccccttgagcacgaccttgtcctcaaggtcgaaaatgtggaaacgttgcttgaataaaagcagagtcctcccaagtagcatcctcaggagatagattttcccagtgaacaagccattgagtgaccggctcatttcttcttggaactacccttcttgctagtacagcgacaggttcagtcttgatgttaccatcttcatccaccaatggaagattaggaagtggtacaaccaaatttcccacatgtttcttcagctggcttacgtggaacactggatgtattccagcttcctccggtaactgcagatggtaagccactttcccaattcttttcaggattctaaatggcccatagaactttgcacgaagcttcagtgatcccctcaagccaaaagcgttctgtctataaggttgcatctttagatacaccatgtctccctcctgaaaacttctttcagacctaagtctgtctgcaaatttcctgattcgattctgagccctcaacaagttatctttcaatctcaacatcaactcttctctctgttgagcagtgattctgatttcttcagttacatttccagggatagcttgctccccattctgaggtggatgtacaccatatagtgcttcatacggtgtgacctgtagagaggtgtgataagaagtgttataccaccactcagcagtaggcaaccacttgtgccagtctctaggttcttggaacaccatgcatctcagatatgcctccacacattgatttacccgttctgtctacccgtcagattgtggatggtaagaagtgctgaacctcaaagtagttcccatggatttgaagacattctgaaagagatcactagtgaatattttgtccctgtcgaaaacaatcaccagtggcatgccatgcaacctataaacattttccataaagatctgcacaacatcttgggtatcatagggatgagacattgcaataggcatatttggtcaacctatccaccactactaggattacatctttgccttgagactttggcagcccttcaataaaatccatagaaatatgtgtccaagccatttcaggtatttgcagaggatctagaagaccaggagaatgaacatgctcagcttttgtaatctggcaagtggggcattcagagacaattttctccacttccttcttaagctgtggccaatagaaaatcttcttgattcggtggtaagtgactttaactccagaatgacccccaaaagctgatttgtggaaagcttgtatcagtttgttcctgatattagtagtactgccaacatatatcctgtttttgtatcttagtattccagcacccaaagaaaaattgctagattcttcatttagttcctccccatccaccaatttcatatattgggcatcatttagataactgctcttcacatcctctatccattcaggatagaccaatgtgattgcatagcatttttccttctcttccacttctttggtgtctctccttgataatgcatcagctgctgcattttctttcccttttttatattcaatgttatagtcaagctccaggagtttcagcaataatttgtgttgtattccttctgaaagtttatgtgtagccatatacttaagactctgctgatcaattcttataatcacttgattacccagcaaataatgcctccattttttaagtgcttccaaaatggcaattgcttctttttcataagtggatgaccctgctgctctctgccccagagctttgctataataagctattggtctgccctcttgaattagtactgccccaatgcttgaaccacaagcatctgtttccaatacaaacggtttgctgaaatcaggaagagctaatactggacaagtagtcataatcttctttagttggtcaaaagccttctgctgttcaggaccccaatggaaattatccttctttaataaatcatgtagtggtctacagatagcaccatacccctgaacaaatcttctgtagtaacctgtcaatctcaaaaagccccttaacttagttatattcactgggactgcccattctagaacatctttaattttgctgggcttggttgccactccttctcctgatactatatgccccagatattctacacttggtgctgcaaatgtgcatttactcctcttagcatataacttgtgggatctcaaaatagataggacacactgcaattgtttttcatgctcttccagatttttgctgtaaatcaatatgtcatcgaagaataccagtacacattttctcaccagcttttcaaaaatttgattcatttagagcttaaaaggtgacgggtgcatttgttagcccaaatggcataaccaagtactcaaaatgacccatatgagttttaaaggcagttttaggtatatcactttccaccatcctgatttgatggtaccctgatctcagatccagtttggagaataccttagcaccattcaactcatctagcaagtcctctacaattggcataggaaacttgttcttaatagttcttgcattcaattgtctatagtccacacacattctccagctgccatccctttttctgaccataacagctggtgaagagtaaggactcaaattgggcctaatctcttcagactccaggagttcctttataatttcctccattgcattcttctgctggtgtggtactctatatggtctctgattagggggttcagctcccatcttaagtgggatagcatgatcacattctcttctgggtggtaaccccttgggctcagcaaaaacctctgcaaatccagctaggatagttgctacagaatcagggactggcacattctccatctccaaagtcttgagagtatgtacttcaattacaaaccccataacatttttgtccagcattttgttcatcttttaaaacttgatcaacacttttccaccaggtgcagtatagtctttgaattaatattttgccctttgtaggttactgtcagagttctctgcttcaagtccaaattaattggactgtgctcatatatccagtctgcccccaaaacaatatcatacccctttaaaggaatcaactggaatgctttaccgaaaagatatccctggaccttgtactggatcacctcggttttagctgtggaattaagtattcctcccccagctaccatgactctattgtggtcaaattctatgatttcacacccacttctcaatgcaaattcataattcatgaaggtattagtgctaccactgtcaaccaatgccacaactttccttcctttaacataggtaatcaaagagaatgtattgattccatatgtaccctgtattgcatgagtagaaatctgcatcagttgttcttcattatcatcttctttcttagcaggacttccaggtgctgtttgatattccccttcctggttttcttcaggacttcctgattcctcttcttcatcctctacttcttccatcatatgtatcaccttccctgtcctgcacttatgctggtaagaccatggttctttgcagtaccaacaagttttcttttccctctctcctccagtatttgccccccttctgtcctacattcttgttattattgaaacctcctgattgaaactggggtttactcttgttaaatcccccttgagcatttcccctttttgcaagactggccttctcataaacttttgcatactagtaccctgctaacaaactttgtggtttttgcccacacacatcatgtttgatatcagctctaagacccccaataaagcagctcaaaatataatactcaatcagatagggatgatcccttttaaccaatgcaacactatcctcaaatttatcaatataatgcatgacagaaccagtctgcctcacattctgcaactgctccacagcttcgtgtgcatttgcctcagtaaatctatctgaaatcatcaagtaaaattggggccaattaatataatgccatggtatcccaagatttctaaaccacttcccagctcttcctaccaagtgcccagtggctaaattcacccattgctctactggtgttcctgtcatttcaaagaacttctcgcattgttgtaaccacccaatagcatcttctccattaaatattgttaactccaacctctggcttcttagtgtcatgtcagcatatggattaggcatcccaccaaacagatgtctgggtccttctggccaaacaggtcctcctccatttgccatatgtatccctgtagcattcagatgaggtctggctgttggctgcatctgcggatacctccatggctggtttgtttctattccataatgattcattcccacatcctcctgagactccactccatgtatatttaaccccccaggtaaatgaccagcctgagttctagtagctgaagtgaatattggtgctgaggtgaatattggtgcaaaatttgggttaacagtgtttggctcaatagaaaaattcacatgtccaacagaaggaacagcaccagacatgtgtattggaaaaattggtggaagacttgttgatggaaaaacacttcccataccagcatgtatctgactggaaggaattgcattagttgagtttacctgagtctcatcagcagtttgaggtagagccactcctgactgcattcctcccgtagataaaattggtgccactgatgaaaatccagggggaactaatggtgcaatcaaagcccctgtcccagtagcagcctgtgctcctgcagatacacttgcaccagccatagcctgggtccctgcagatccacctgcaccagccgtcccactagtactcgcaccagcagagtgaaatccaggtagagctgtgcaaatactcttcaaaaggtccttgatttctcccatctcacctctcagattactcagatctgtcatctcccgcctaagctgcaggatctcagctctagcgtcaaatccatccacactatccaaactgttaacggacctggtgcgagccggcatgttcactgacaacgaaattcggcttgagggttatctccaagattcaccctctcccctttttgatctcgtcgtcgcaggtctaccgccgcctgagtcaggtcgaaagctctggagattttacagggaatacacatcaaagtgattccccaaccctcgcttgtcgatctgtctcacttctactcgcctccggttcgaattgtataggcttttgggattttacgagaggaatccgcagatcctcccaaccttcaccttacaaatcgagagccaagaatcagctgtgctctgatacccttgtcagaaccacaccaaaacacccccgaaatggaattgacgaacacactctctctcagatttgtagccgccgcaagacaagaaaaactagggttctaagctaagtactagggttaatgatcttcgatagcttttccattcatcacaccgggttatatactcccaggcatctcagttttttttttacagagcagcgagtgagacagaggaagcagagtaaaagcagcgtcacgcgcaggcgacgacaaacagaaacggtaaatagtacagcaaagcgatcacagccgtaaatgcaccacggtaatttgatatagcctcatctctaccgttcatcttcattaaacgacgtcacccaaccggtatcccactctaactctgaacttctgaatttttaactaaaacttctgaaactcttctccatttcttctctgaaatctccatctctgacaacccgctgactcgtcgccctcgttcctccacggcatcggcgcgccatccgcccgtttggccgtaacgcgctccgccaccctcgtctactcagagacggagctgtacacagtcgcggcggcgcacgcgccgccgctgcgccgagaaatccaaggagacagggtcacgtgacctacagctcggccttcgctttttgagacttcctctacccacatctctatgtgcctgcagcactttcatatggggaaagatgggcttaccatgttccatcaatagcacctaacctatgctgattttggcggaccgtgctccaccccggtgaactcatgcggttccgacgtgcccagaggccagaggcgaatccgttcacggtccgtaggaccaacaccattcgaaggttgatggcccgccccgtctagaataggaatctttgactgggcttacgcacattcgctcacttacgctgtcccccctcagctcaccccagccccgggtacgtcgtctccaaggcttcacacaaaatcttcactgacaacatatgcatgcttttgtagggtcaggcagaaccgttgttgcctgatgggaacttcccccatattgctatcaatgtcttcatgtcgcacgacctcttaacattacacacgttttgcaaaattacagggttgctactactactagggtgctccgtgaaaaaacttcctttacaaataagtcccccgcgtataacccgcgacccatttgggggtaaaacgaacagccaccggcccatccccttgtggccgactaagacagagcccagtctactagactttggaataagtccactttgactcccttaaaagtgacccgaatctaatccatgaccctcaaccgtaaaaccagataggatgactccccgaactattcaaaccagtgcaatttgactccctcagtggttttggatggcggttttgctgacgtggcgttgacgtggcgatgttgacctgatctgtgttgttgatgtggtgcttatatggcattaaaataaaaaactatatgggctccattcgtcattcacatggaaaaaaaattgcgaggcccacatgtcatcctctatctatcctccttccccccctctctctctctcccttctctgtatgtttctcttcctccagattcggtgtgcagaatctggagcggcggcggcggcagggtgagggccggcgcggaggaaggaacttgagcgggtcgagcggcggcttcggcggcgacgacagagagccggaggagaggcggtggagcggcgacggcctcagctcgccggagaaggcgggggcgtccggcctgtggcctcccccacaatggtgccgcgccaggctgggacgaaggagagggctaatgcagacggcgaagcctgagacgccgccggccctagccgtgcctcccggtctgcgccggaagggggtgccgcctctgtttctttctgcccggagaacatgcatgtgcacagtgttgcctagcagatgcaagtgcagtgccagcgtggggtagcaaggcgcagccaccatggaatccagtcgaattttggcaggaccagcagctgtaggacgaatccgtcctaccagcgtggtccacctgagtcctgcagatcttgaggtcgtggactggtctgatttttttctttgtggtcactgtttgcaaggtcttgaggtcgtggacaatagctacttcatcaccgaggacaacgttggcatgctgaagctcaccaaggaggccaacggcatcttggttcgttgatcagcgcatcgactcatgttaccaattcgcctatgaaaattgctaacatctaaccgtgacatcctgtgattaattggtacaagcagtttgactaccatatcccgcgccggagacggtgggttgcgcagtggtgcactcaaacggccacaccgcggcagccatgtccacgggcgggctgatgaacaagatgaccgggtgcatcggcgactcgccgttgatcgggtcgggggaaggcaaggccatcatacgctccacgctggcgcgcgacgtcgccgccgtgatggagttcaggggtgccgggctgcaggaggccatcgactactgcgtcaaggaacggctggacgaagggttcatcgggctcatcgcggtgtccggcaccggcgaggtggcgcacgggttcaactgcaccggcatgttcagcgggtgcggctgcaagagaaaagagagagaagggagagagagggggaggaagaaggttggagagagaaaggatgacatgtgggtcccacaatatattttgtgtgtaaatgacagacgggtcccacaaaatatttttcattgtaatgccacataagcgccacgtgggatgaagaccgggtcaataccgccacgtcagcaaaaccgctcagggagtcaaattgcactagtttgaatagttcggggagtcatcctatccggttttacggttgagggtcacggattagattcgggtgactttttaagggagtcaaagtggactttttccactagactttcacccacagctcgaaggcccattctacctacctctcgaaagccaaggcccaaatcttatcctacagcgaccaaccaaaacgtactaaactgaaggtacccgccaaccaaaaaccaatctctaaacgccaaactgtaactccttaatccattctcgttttttttctgtcagctggatagggacgtctactactccctccgtctaataatataagtaattttaagtttttgtttgcactgtttaactactcgtattattaaaaaaattaaaattattatttattttttgttacttactttattatccaaagtattttaaacataacttttcattttttatatttgcacaaattttttaaataagcaagtaaaaactcaaaatctcttaagtaaatttcacaaaactacatgtttttttttcaagttgcataaaacaacacacattttgatacttggcactttagtacatatattttggtaatttagtttcacaaaaccacactattgatgaatagattcacccgtgagatgacgtggttgttccatctaagatgaggatgttacatcctattaatttcgtgcgatggctgataataggatgtcatgtcctcgtcctaagtgaaacaaccacgtcatctcgcgagtgaatccattcattgatagtgtggttttatgaaactacactaccaaaatatatgtacttattaagtgtcaagtgtcaaagtgtatgtggttttctacaacttaaacaacaaaatgtgtagttttgtgaaaattactcaatctcttatattatgggacggagggtgtaattatttgtttcatgctcagaattcaaaagtgtggctgttattctaatctcccacgagtccacgacacgatgccgcacggttggccgttgccccgagaccagcgttttgtccatgcgtacgtgtcaaacctccacctaaccatgacgcgaccacggacggcgacgctggcataccgccaaaggctaacgtctccgtcgccgtctcggcgagcaattcccccagcccaccgctcgtgtagtcgtgtgggcgcggcgcggacgtgacgtgcgtcggcgcgcgcccctgcaggtgggtcaatctcaatccctttgctcaattgctccaagtgtcggcgcgcgcgcggttgctgctgggtccgcgcgtcgtggcggcgcagggatcggacacttgtgaggcgcgagcggctgcagctcgacgcgacgtgacgtggccgttgtttgggaccggcggtgatattgctacctccatcccaaaataagtgtagccgtaaggacacgtttgaccgatcatcttatttaaaaattttatgaaaaaattgaaaaaaaatagtcacacaataagtaatattcatattttatcatctaataacaataaaaatactaattataattttttttcaaataagatgaacagtcaagacataaatagtacataactacatttattttaggacgggggagtagattgctagtactaccatgtcgacctttttttttggttgagatgaactgcctctgccataggttgttttgaccgtttgtacccattttgtacattggttttagagaaatcacgttctcaatgccgatgcatgaactgtgaagggagaagcgtacagacgaaagagctaaaccctttgttataaaatataataaattatagcatttagaatttgtttaaaaatatgacaatttatctaccaacatttcttcctaacaaattataacctttcatcgtttaaattcctcacatgtctatatttttaacccatcataacatttttttatttagttttatctttttatatatgtttttaattttttaaaacactttaattatgaaacggaggtagtatttttgttctcttctttcctcacggggaaaaaatgaaaggccgcacagccaatcagccatagaacgcagtgatacaacttgcacaggatgagctctcaaaagcaaatactcaactccatatatgggtgcaggagcagtagcgcgtcaatcgtcaaaataagagtattgttgactaccctactccatttatctaccacgtgccactttaaaagcctcatgggttatgggctgcgtgggccgagaaagaagcggggtctgatgagacgtgtgttgtgctcacatgttctgaacctcctgatgagatggtaattcgtcattgtaatttttgcaatgaatgtcaactgaatatctcatgtgattttcttgcgctccaaatagaatttcacaagagctcccctgcaaatttgaatggtcatcacagctcacaataattccacctgtagttagcatgtatatatatagcctttgtcccgtgttcttcaaaaaataatattagaccttaattcaattgaagataatttctgaactgaagctccaaacacgcacccagcaaaaggcacggcataaaagtgatgttcataatgggttttattgatagtagaaatcaattgaaccatttatctattctgataggaaaaaaatattttattgctctaactattctacctaattacttaacccctaaactctttcatgcttattttataatctgagctattttgtactgaaattttgatagaatacatatgcatttagaacttacgtctagtcctctcttttttttttgaaaattttgaactattagcgtagttcgaaagcactaaagactaatttaacatcaaaaatttaaaatttaaagttcaaacaaacatccatggaaaattttgaaaatattcttgaactttaataatgatgtcatatatggcttaaaaataacagttttaaatacagcttgtataaagaataaaaaaataaatgttatttaaacattaaagtgaacgatttttattagtttaggggtaaaatgagccaaaaaaaaatagttcacgggttaactgatccattgaattagttcggataagtaaaatggatttattttcattaggggaagtaaaatgaatttattttcattataatacaatggattatttattgtcacattgactatgggtaatagaatatcttgtatatttcatcaccgattaagatcaatttttaccagagttagattagaaattagcttaaacgtatctcgggataaaaaggcgacagcacgcaaatccagaacgcaacatgttccggccggagaacgcagaccactcggcagtcgcacacgcgcagccgacgtaactaaccaccttaccaaacgggacgatataagcaaaaccgcgacgcgcgcggccaagaggcaaacaaacaaacacgcacgcacaccactactccatcagcagcagccagcgagcccgcgccgcagccacccgcgcgcgcgcgcgcggccggtgaggtgtgtgagatagatcgtcgagcgcgcgtacgtcgatcgtcgaggctggccgccgccgcgaggataccggcgccggtgcgcgcggtgatggcgtggtggcggaagaaggtcgtcttcccggcgcgccgcgcgtgggccgccgtctccacccgcgtccgcgcccgcaagccaggtacgcgaccaagctaacgattctccccccatcaccctgactctggctggtagtagtacgcacacgcatacttgatgctgcccaaggatggcgtgctagctagttcttctgggagaaataatcttggtatactttcttagagcccgacaagtttgctgctgatttgatgatcttcttggtctggctatgtccatacagttcttttctcttttcttgacgccatgagagatcccataagaagagagagttctaggtctgaattatattggaattcagttctagatcatttcgctacttcgtggagacggtaaaacagttatagaaaagtggcatgactcgtgaaatcatgagtcaaaactatttaggttaaaatattgaagtgcagttacctggatgaatacagaacttctctgttcaactggaaagtcatagccatgcttattgtttttttcccctttgaaattcataatgtctggactttacatctaaaccaacaatccaacatgatactatttggaatcttcactataaaaaagagagatactgttcgaaacaaaactgcccatgttttcatcattccttctccttcttctttcctctgatcttgtattgtcagtatttctggtcatgctctctagagaaggagtaattctcaatctagagcttatgccatctgggaaatggaaacccttttgttttatgcaaaatctagagcttttcttccatcaattatttactcttacagttacagtgttgaccattcttcaatttcgttcacatcaaccatcaaccaagtatttgtccatggtggaatgtgattcttttccactacaatgccgctgagtggatgagactttgcaggctaagtctagaaacaatcttccttttgcaccatctcatctcccactaacattctccaaaaatctagctcatccaacactactcgatcctaacatgtgggtccaagatgaaaagtctatggtgatacgatccctctttttggttgccaaaccagaaaccaccaccaatgccaaaatttctctgtgatttcaaagggtttcaggaatttgttccaaaaattccagcttttgcacagccaccaaaactaaatgctcttctgaaagtcaacctccccggcgggtacaacgcgacagtgaaatggcagcgacctaccagggattatcagcagtgcacagtgagatactgccattggtagtactatggttttgtttggggagtttaagattttgagaaacaactagtgagaatttagttggtgagaatatgaaagggctgggtttcttggcttctaaattttagtttattttctagattgtataactacatattcttaaaatctgggtggaaatctaaactatttgagaaagattctgacagctgaggattctaggagaagctgcagctaacagaaacttcccaaacaggccctatacctagtaccactctgctgcattgctgctacagtaccatccttattcaataggagcaccaagtgtcacactgtcacgaggtcgatggttcagtacactgaagatcagtaggtgcatggatatttttagggtccaaaattcagtactaccacgctgcccaattagtgccagctcgatctcaacatcttgctttgtcaactagcagtaatgacccaatcaaacatgatgtacagttagttacctgcatcttcttctcagatctgaaccagattctgcttgaacacatacactggaactctgcaagctaatctcaaacgggaaagcagcaggagtagagtactgtcaagtggatcgttctgcttgttctgttctgcttgcagcttccctgcaagtgttagcagtatcagtctccaataattcagaccttttggtatgaactgagccgttgcgatttgcggctgcatctgatctgcacccaaagattcttcttcgcggttagaaaagggttcccttgtaccagcgtcgcacgcgacaacacaattaataggagataatgccgtccacgcgtaagcccatcaacttttaaccaccagcttgtctagagctcgaggcagggggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactactgtacc

SEQ ID NO: 906 - DNA, 522 bp, Oryza sativa
tggaacaagagtgatcctaacaaatttaggagacaatattatccacggtataataataacaggaactcatataagagaaaaagcatatgtacccataataaacttaacaacccgaggaaatcaatggccatttaccttgtgtctgacgacagttcccaataaaagtgtgctattctatgactataaataaaaccaaggacaaactttatctaatgttggtttatatctaaaaaaaccagtctttacacatggccaattatatgtcgcaatctcacgagtaagcaatagttaaggtttaaaaattctaacagaaaatgaagatgggacatgtgcaacacaaacaaaaaatatagtatatagagaaattttagattcatttacatcttaatgtatactatatttttctctatatactatataaacacaaacacagtactaacattttccattgcttataatttgcagatgaatatcattgcaattgcagagctgcgcccagggcgatatgactacatgatatgc

SEQ ID NO: 907 - DNA, 866 bp, Oryza sativa
  unsure (1)..(866): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactcatggtggagctcgtcaaattctccacaatgtatgtccacttgaacgcggtgaaccctcccacttgcttgaaaatgtcaatcctcgtcacgttcttcccggcaagcataacgtcgaacaccctctgcccagctgagccgatgccagcatcgatctccgcgaaatgcaaccagaccatgtaggacatcctggtgtcgaccggcatgaggtactcgatctcgttggaggcatcgccgccggtggtgatcgccgacgtgtagagcttggtggggaagtagttgggcggctggttgctgccgaaaatcttcctccccccggccgtaatggcgtcgtagttgaggtcattgttccggaaatcgatgtcggactgccagacccgggagaaggcgtcagagtcgttggtgaagcccgggccgaagaggttgttcccgcaggtgagacggccgtagttgacgaggatgaggtccgcgccggtggtggcaccgtcgtaggcgagcgggtgcacgggcgcgacctcgatggaggcgacgacgggggcatcggtggagagcgagtagaagcagatgtcggaagtgggcgaggtggcggaggggaagatgaagtcggagtatgccccgtagcgcgatgccggct

SEQ ID NO: 908 - DNA, 17228 bp, Oryza sativa
gctaccaactccattggcatcattatcgagagaaaacctactactactaaccattagcatatcagtgatagtggctgcctggtgctagagcatatggtaacatatatagatagagtctgttaggagagtttaatattctgacaaacagttgagaaacagtttgttagtagccagtttataaaaatctagaaaaagctgggttttctagcttatggcttatagcttatggcttagtttatttttttagattctacaactatagtttcttagaatctggaataaacactgtattagttgggagagtttctaattcggagagaacctgcaaacaggaccatactgttgctcttgaatcagtaatgatagtacaagcggataatgatcggggtttagagaaaatgaatgaacgagcttttgggcattggcagtgccacggcaaccaccgccgcactcccatcaccgtaccctcatccactgatccgttctaaatgccgcatcatgatgattgcacgccccaaacccaaatcgcacgggctgcacggctgcaacgcaaccaccacaaaaagccccccctgctccggtgggcatccgcatatcagcatctgcttctgcgacgtgcggggggtggtgtgcgcgagtggtgcgccgcacgttcgttcgttcgtgccgccgcctgccaacctgcagcccagcaacgcagaaacggacgtggcatattttcctccgcgaccgcgagcacatggacatggccacggcgacgaggcatccacgcatcacgtacgcacctgtgcacgctgtcactgatctatctactcgcaaactgaacgaggagtacctgctccctccgtattttaatttacgacgctattgactttttgtccaacgtttgatcatttattttatttaaaattttttttgaaaatataaaaatatttatgtcatgcttaaataacattttgatgatgaatcaagtcacaataaaataaataataattacgtaaattttttaaataagatgaatggtcaaacgttaaacgaaaagtcaacaatgtcgtacattttaaaatacagaggtagtacttgcttgatccgtcccaacaaatcacacaaaacgcaaagtgctgctcccaataaatcacacaagtaggcccggaggggcagtaaattggcggaagctgttgatcacgcggtgcggagcccgtaacccccatttaggatagtctaacccgtagggtacataagcagtgtctatggtactatcggcctgtttagatccatttagaatagcaaatggtaaatggcaaaagtttttgtggcaaaagttttggcattgcaaaagtaatagttggtgtttagatgcatgttaaagttttgccattctagcactaaagtgagagagagaaagagagagggagtggtcccaaagcactttttagcacaatttgctactatggactagcaaatgccaaatgccaaattgccaacttttgctactagtgtttagatccaaaatggcaaaaagtgctacaaaatggcaaaacttttgccattttggaggatctaaacagggcctatgtcgataagacatcacaatagaaaatacactctacatcccatggtttcttaaagtgggccattaataaatatatcatctctcttctctaccaatcatatttattcttcatctattataaagccattattcttcttccaatgcaaaacttgatagtgtctactgcataggttcttgtgttgaagctgtgtcttacatgagacccagttgcttcctctcttcactctctctctctctcttaattaatatagtgccacgtaaactaaaagtcctatatgataatgtagttaatgccataaacccaatcatagatggagggttgggactgcccttactgcaaagatcaatcataaagagaatgtaaacgcagacatgaacagccaggacaatgacatcgtaaccgtccatatattcttcccattcccatttactatcaacatcgataggagtttcaatcccgttatatcgaaataggttacatctacgtcgacgatgttccggatagaggagtagacgcaattcatatttttcaaaacaaacaattgctagtagagtaggagtaatatattgtgtgatacccaaaaaaaataatactagtcgaacggtttgggatccccatatatagtttcatttattttagtagggtcacgagagcacatgagctaggcaaagccgtggtgcccgcggaagacgccaaagggctttcccgtgccatgatctgcaggacactcgacttagaaaaatgaaattctattatctacaacaaaaaaaaaactatcaccagaataaaacagccatctttgatgacagttagtagcagcagcgtgccggtctacttgcagacaaacatacccgaggatgctccttggcgcagaatgaaacgaagccggaccacaataaggcccacacgagatagcctgcataaatgggccgtggcccatgacctctctttatcggccttatcaaaaggaaaaagtatactttgactccctcaactatcgcccgagtataattcatgtcctccaaccacaaaaccgggtatatcgactcttccaactatcaaaaccggtgcaaacaatgttcttcggtggttttggctgacatggcagtcttgaccgagtctttatcctacgtggcacttacgtggcattagaataaaaaaaaataaaaaaatacgcggggccatatgtcattcacacacaaaaaggagcggcggctgtagcggtggggacgaggcagaggggagcggtggcggtggggacgtggagcttggtgttcgggttgtagatggcagcgaggacggtgaggtcggcgcgttgaggtcggcgttgagtgcccgggcgccaccgacgaggtcaagctcatcgacatacccggtgttcagggtggcagtggtcacccgcatcttgggcgactgcgggtggtagatgagaaagatgatgagcacggccacgctgatggcgatgacgagcagccagaagaggatgcagcacacagtgttggtgaaaaacacgaggcctgggagatctgcttaactccagtgcaggtccaaagctcgcctttgggtgtgttagcgtgccagttgatttgatcctgcaatcaacaagaaatagaaacaaagaaaaccgcggttaaacctataaacgatagtcgatcggctaggtgccgatgacatatcatttatctttgagccgatgtcatatgtaaatcgatcggcggttgtaaatagataataaagaactaaatctactcgatcggatgtagatattagcaatatataattcttatatcgatatatacttaaatcaagtgattaggatagatcggtcgccatgccgagacagtataaatcacttagatcgaaatatatattaataacaggattatatatgttcatagcatagccgatcagatagatctagcatgtatcggctaatactccgatacaactctatgttaagatgttaaaacaaacagaatataccaaacaaaagctgaatatacttagatgcaataatatcttaacataaagggcagatttaacgtgtcaacaaagcatgtagagtaaatatagttaaatcagataaaatcggctgaaattccgatgctaccctaatcggcaaccagaaggcaggctagagattgatattctaagcacgacttaatagatcaaactcaactgatgcagcattaagtatgaaaaaaagaacaatatcttgataatcaagccgctggaagttttatagaacagtagatatctcatataatccaagtcaacgtcggtgtttaatctaatcggctgccctctaccgatagatgttagccgattgtaggttagatagcgatattgccaaagattatgtaagatatatgataactcgacgaattacataaataagattagagtgtcataaagatggaagcactaatcccgagaacgcaagccgtcataacaagttttacctcttattgaagatcgaaactgatgcagctcaacccgaaatcaagaactcgtcgaaataaaactaaagcaaaaagggcggcgatgcgccgagattgtgttgaacgtgtatgttaattgattacatggggttcggggtctatttatatccgaaaattacaaactatgtccatatcggacacgtctcttatctctaacaaactataagataccacaagtctttgcggcagacttttgcccaaacgtatctctaaggaatttacataaaatatcctaattaatagatacaattgccttctcaggactctatccatgtgcggcaatcatcttgaagcatatcaactcaacccgatgttgtacatcgagtcatattgtcagaatcggccgtatcggctcacacaatctgattcggacccagccgatcctgttcatagccgatccggacttcagccgattcttgctctattctcgaaccgatctttgccttctactccacttcgatctaatcctcttttccgatgctgatattaccaaatttggtcgttaacacgcggtgaagcagaacaccatcggccgcctcttcttgtccttccgatggagcagcatcggtgatttggccgacatccgttccgccttctcctcctcctcctgcccgccgccgctccccaccgccactgctcccctccgccttgtccccaccgccaccgctccggagaaagagataagggagagagacggggaggaagaagggaaggagagggaggatgacatgtgtgtcccacatgtcagtggtcccacaatacttttttatgtgaatgacatgtggatcccacatttttttatttttgtttttattctaatgctacgtaagcgtcacgtatgacaaagactcggttaagagttaagatcaccacgtaggcgtcacgtcagccaaaaccacctcgaaaaccatcgagggacattgtttgtactggttttgatagttggaggagccgatatatctggttttatggttggaggatatgaatcatactccaggcggtagttgagggagtccaaatatactttttccttatcaaaaactatcaacttgtgatggcattatttgggccttcactaagaagctggagtaaagccgaactcagtttcttcttccctctcacttctgagctgataagcccagcactctctgatcaggtccaagtccaaggcgttaaaaggaaaggaaaaaaaaactctccaccccgcgcggcgcggatcaagccggagtttgagcatgggagtgcgtgccgagtcttctgagaccaccgcgataattgtagccgggagggccggaaaaaaggcagaccagatgacaataatctcatctcatctggagcaaatggtcaagcagacatactccatggagagagagaaagcgcaaagtaagaagaaacagcccagacgaaggaagcggggtaaaaaggaagaagaagagcagccgtccacgtggtggggccgacgttgatccggatctctgtacacgtggcatccggccacgtcagtcaactagtgtctccttctctcgtctctgcttttttattttcttgctactgctagcgatatacaccctcagtccttaaaaaaaataacttcttattattatgaggtgacatattctattataacggatcttgataactctatatctaaatttgtttttactaggatatgtagtactccctcctttctctaatataaaagattttgacattttacttgtattgtttagccatttgtcttatttttttaaaaaaattagaattattatttatttttttacttactttattatccaaagtattttaagtataactttttgttttttatatttgtaaaaaaaattgaataggacaaatggtgcaagcaaaatggtaaaatctcttatattatgggatggagcgagtactaggttattttttaggctgtgtttagttcctgaaaaaagttaaaaatttaagaaaagttggtagtttaaaaaaaattaagagtttatgtatgtagaaaagttttagatgtgatgtgatgtgatagaaagttagaagttagacgagggagtagcgtgactatccagttcattggacaatccatcgcttatcagagaggactctcgaatgacagtattaccatgcaccggacagtccaaaaaaaaaaagccaaatttagttctaacctttttattcaaacttttaactttttcattacatcaaaatttttctacataaataaactttcaacttttccatcatatcatttcaatttcaatcaaacttttaatttttggtgtgaactaaacacatcctttgcttaacctgggaggggacttctaaggttgttttttttttacgggaacagtgcaccgttttatgaacatcaaatcgactttattagttgtcgggctcatcggctcatgagaggctttatggcggatcagagatccccctgttgagtaatcgtgacgcctaaccgtaaaagctttggcacggcgtacttcgctgcgtaaaattgatgtctccatttcgaagttgttcgttgtaatttctttgacggattgaagaaaacgaacacctcctcaactgattgtgtcttaattgtgtgcaacacactcgtaataattcttcaaccgtgcacgcagagatgttaaacgttgttctgcactttgctgtaactgtacgcacttcctccgttttataatataagttattttagcatttctcatattcatattgatatatgtctagattcattaacattaatatgaatatggaaaatgctagaataacttatattgtgaaacagtggaagtagtacgcgacaagattagagtaggaattagaggtgtttttgtcaacaccgtgagtaattgtattctgtgacctgtgtaacttcgtcctggtaattccatgtgcaaaaatcagtattccaacccactagattcagtagcaaaaccaaacaatccaagtagcaaatgagtcagaaatttaccaacatgcagattagaggtggactaattaaccactagattcgagaatcttgtatcgttgtctctctctctctctctctctctctctctctcttttgtgacatgaggtcgtcaagatgcatggatgcatgcatgaatacacagggcgcagcagcacgtatgctcctccgatccctccatttggcatttgccatgttcttcgatgaaaccgacgtatcaccaactaatggcactgcaagttattgtgatcctcatcaccgatcgatcagctctattgttccggggacctacttttcgcctacacataagcattttatagccccttttttaagggaagtcgagatgcatgacgacaaattaaagcacgcaagagcatctgctgctgtctaaatttagcccgtgtgaggtggcgccgtcctatcatatcggatgaatttagagaattaaatatatactactaattacataaataaaactaattcgcgtgataaattttttaagcctaattaatctataattaacacatgtttactgtaacatcacataggctaatcatggattaattagactcaataaattcgtctcgcgaattagtctagggttataaggtgggttttattaataatatacatttaatatttataattagtgtccaaacatccgatgtgataggactaaaattagtcccatctgaaccgggtcgcttgtctagctgcatgcagttgtagcagcagacaacactgcctcgtactgtacggtactgctacttctactccactccttcattcatcttaaaataaatcaatctcgtaccggatatgacacatcctagtattatgaatcttgactaggaatgtgtcatatcccgcacgatgttggtttattttatgatggagggaatatggaatagagtttagaattctaagaaacagttgataggaattaactagtgaaaatctaaaatagctgtgtttttagctttcgagttctaaattatgttctgaattctatattttcatactcttaccgttctcaaatctgaaagaaaatctaaatgagttaagagattttgaaagatgctccatctaccaaaagatcttgaacagaactggagctgggaggtaatcaagccggtgatggctcaaggcagtagcaaaatttggcaatggatatgaggaagctttgggtcaggctggggaagcatctgggtcacatgctgcaggtgcattgaagaatgctacagtaacggtcaccaaccctccataaatataaaaccaagcactgcactgcagtaatccctcacccaccccatccaccgccatcatcacctccagtccccacacaaaatggtggtgttttccggacaaaagcaacaaaaaacggatggatcccatcacaaattcgccgtataaaagcattgcatcgcaaggttaaaaaccattctgctgcagccatccatccatcgtccatactctctcatcaacaatgatgcaatgccgtgcatgacaaaatttggaagctacgtcacgcatgtgatcggttatcgccacctacctaccaaatgctcgagaacaaaaaaaaatgcaaatgtattacgctaccggtccaaatttggtccgaacacctacgaaatcattcatccccaggagcaatggagatatggaaattttggaagcttacgttttcatcaaacaaaagcggccatagaacacatgaacagattggaatggattcattttaattcgtctttgccgagacatcaaagacgaaacagcaaagcaccggagaagaagagagtgggcccccccatccatcgacaagcagagagcaggacaggctggcatttgtcctcgcctttcgtctctcccaaagcccacagagcctggcactgggccccacccccacatcacacactctcgcgcttaattaccatttaccaccactaatcactccttgatctggctaattaagttaagccatcgctgctaatgacttagcacttgttggtggtgaagccgacggtggacttggccgtgtcgaagctgacgcgggtcccctgctgctgcacgttcccgatgatggacaccgccgcgttcgtcggcgcgaacgccaggcagtacgtccccgcgccgtccaccgggatcaggtagttcttcgccggcagccggagctcgccgccgccggcgaaccgcagcgacaccgcggggacctccacgctcgtccggtccgacaggtcgtagcacgtgtcgaacagcgacacgccggaggtgcgcggcagcgactgggtgccccggacgaacgcgtcgcgcagcgccgcgtacgccgacgactgcagccgcgtcaccgccgtgccggagtccacgatgacgccgccggcgcccgtgctgtccatggcgaacgccgagggtgggatggagaggatctggccaccgacggagaggcccgagaggcccacgtagtagaacgtgctcgtccgcgggctgcggatcagcggcgccgtcacctccgcgtcggcggcgtcgccgaactggagggttgacgaggagggggagtcacggtcgacgaggcagtaggagaaggtggtggcggagatctgggacgggaaggagagtggcccgccgccgagggcaagcagccccgccgcgccgacgaacagcccctcgttgtcgtggccgcagcctatggcgacgctggagaccggggcggagtcgccgagcgtgagcgtctcggtggcgaagtcgccgacggtgtaggagccgtcgccgtacgcgacctcgtagaggcaggcgccggtggagttgcggcaggcggcggcgtcgaggtcgtggcagcgcgggttgtcgcaggcgacggaggcgtaggaggtggagagggaagggtcgaacaccgggtcggactgctggtagcagtcggcgcacggctggcattgcacccaggtgacgtcgctgccggtgtcgagcaccatgtacagctgccgcgcggggctgccgacgccgacgcgggagaagtactcgccgctgccgagcccaaccccggacaccacggggccctgtatctccgccgccgacgcctcgaacgccgtgacgttggccggcaccaggtcgaaccgactcaccccgtccgccgccatcgccgcgcgggccgacaccgcggcggcgcgggcggagtcgcggcggaggcgagccagcacgagtgacctgtagctggcgtgccgctgccgcccctgctcctccggcaagaagtcccgggagtggagccgcagggccaggcgcccctcctcgtgctcctccccgacgacctccgtggacacggcggcggcggcggactggtggagcggcacggcctccgcggataccgcggcccgcgcccgggacagcgacgcggcgacgtcgagcgtctcggtggcgagcggcggcgaggcgtggcggcgggagagaaccggccgtggcgaggcggcggcgaggaggaggaggaggaggagaagcgggaggaggatgggaggctgcattgctgctgatgctgctgctggtggtgagctggatggagtgaggagagtgaaggggaatttaaggggagaggagacgaagttgcagtggtcagtcaaggtgaacgaacgaatgaatggatcacgtcactcttcttctttcttctccagctgctctcaatgaaatccatgaattcatccatccatggcgacaggttaaaaagaaaaattaaccaaacctaacaaactgagcaaccccaatctgtacagtacgattgatgtgcatccttaactaaatcgaatcaccatttgttaacacatgtaagcatcgacgaggtgaaggggattaaggaatcatggtgagcaattgaaaattgtgtggcgccagatgtgttgcgaaactaacgacgcgtattatcaaatttatcatcagtcagtcacggatgctttgttacacagttatcagactatcagtagcagtataattatcacgagctgtagttgataaaagacaaacgccacctacgtgctaacatgcatgtgttgatttggaggtcacctacgcacattttcttaacactcacacggtcgtcgtcttttgctactagcctactaccactatacttaacttgaaaagactgctgtttactcatcaagctttgatcttgcattagtgacatctgcagatcgagccaagtaaccaatctgattcatggcccatacaatgaaacaaaccgtttctttttctacttaaaacacataaactccacaattactagtaaccgttttgctctcctttcttctccaccccgttccaaaataaaaaataaacaatcttatatatcaatctaaacatatgtatatcccgatttagagtcgggatttgactttttttatgaacatatgaagtatctgttttaataccgattatattaaatttgttttttagacgaaggaagtaagcatcagcatattcagaacaggttttactagccagtttgtaagtattactactactaggcatgcgtaaacaaggtaagagaatatatctggagctgagcctgcctgcgtctctccaacagcagcggaagaagaatagaacggcagatatatcgatcgtgcaaatgagcatttcgacacgtcacactatttgtcaaaaactctcttttgcatactcccccgtccaaaaaaaaaataaaccctaggttttcgtgtccaactttgactgtccgtcttatatgaggttttttataattcgtattttcattattgttagatgataaaacatgattaatattttatgcgtgacttgtatttttaatttttttttaattattttaaataagacggatggtcaaactctgggcatggaaaccagggtttgtttttttaggaagaagtgagtagtagtaacggtatgtatagtagttagtggagcagtaattaccgtggcacgacgagaagtacagtaagcatgtgctgtaataaattatgcgacaggagctagcgctgtaatccacacacacggacggagtactaaaagttggttaactacttgcccttggtaacaactctctctgactccaaatacaaaaccttttagacttaatacatattgttgccgtttatatttaggggttgctattatacggatccaagttttacaatgctatgatttctactgatgaatactaataaatctaatacatataaatactagaatcgatatatctcacagatatttcatatgtgcaaatagtatccattagcgactaggttttcatggcggtcgcctcaagattgtacaagaaaggaaggataaatttaatgacaaccccttagagcacgtacaatagcagaatataagacagctgtaaacatattttaaagaaataaaagatgagagagaagagcagcaggctacagatctgtagccagctgcagcacggactccaagacgcagtacatgtatgacagatgagaccatatattaatagtatagtaagcaactactccctctgtttcaaaatatttgacaccgttgactttttaagtacatgtttgaccatttgtcttattcaaaaaattttatgaaatatgtaaaactatatgtgtagatgaaagtatatttaataatgaatcaaatgatatgaaaataataaataattacttaaattttttgaataagacgaacggtcaaacatgtgctaaaaagtcaatagtgtcaaacattttgaaatggagggaatattatataaattagctattagactggctatagataaattaaagctcgaagtgggctatactagctctaacaagtcatcgaacacgaacgcgtcgacactatcgtgcacctcgacgagcgcaaattaagaagcggccaacgtccatggagccgcctttgcctctacagcagggcagtagaaaaacaggtgacgctgtgacgttgtggaggatagtgcagtcaatgacaatgtgccctcgggttcatcgtacagatgataccgcgctcggatgcgtggataggatgtcgtcccctaaacattttggtatatttatgcaacatattgtaaagacaggttgtttaattagctggctttaagaaacgaaattgcaacttgtaaatttgaaatcaaagatactatactactctacccaattcagaattttagatgcgaattgatttaggggcttcttcatcgcttctcttctttctaagcttatttttccgttatctcagtcacttactcacctattaccttctgcttaagtcgcagtagtaaaatgcccagaaaaatagaaaccgggaggaccacagcgcacagggaaggaaggagaaggcttgaatggcagcatctgcaatctgcatgcgactataccaccccctctcgatctgcagagggaacaatgaaagccgccgatttaggaggaaattcagacatggatcatggatggtggagacgtccagtctcctgtgtttctttcacccactgacccacctagtctgcttattgcttgtccatctatgtctctgtgtttagttcacttcagactttaaaatcttccatcacattaaatatttggacatatatatggagcattaaatatggacgaaaaaaaaccaattgcacagtttgcatgcaaattgcgagacgaatcttttgagcctaattacgccatgatttgacaatgtggtgctacagtaaacatttgctaatgacagattaattaagcttaatagattcgtttcacagtttacaggtggaatctgtaatttgttttgttattagtctacgtttaatactttaaatgtttgtccgtatacgtcaattttttttccaaaccaactataaacacggcatatatcaccatgtctatcaattttgccatgcactgtactcatgtatttccttctactccctcgtccacaaatataggcacagcaaaggcctcattctttttaaattttggctacatgagtttttttaattgctaaacggtataattttgagaaaaaaatattgaagtctttcaaaatttcgaacaaatccatttcttaagtttgagtaatagtcaatatttaattattcattcgttaattacaaaccttctcccttaaaggcgtggattgatcggcccaaaccccgtcgtagaatagggactataacatttacatagactctaatatattactttaaataataatatatgtataaataaaaatagttacatactactccttccatcccaaaatatttaacgctgttgacttttttaaataatatttgaccgttcatcttatttaaaaaatttaagtaattattaattcttttcctatcatttgatttattgttaaatatacttttatgtatacatatagttttacacatttcacaaaaatttttgaataagacgaatggtcaaacatatttaaaagaatcaatggcgtcaaacatttagggaatgagggagtattatagttttatttcatgataaatctagtaactttatccttacgctgtcaatctttaggagtatttttttgctattaacattttaagttaaaaaggtttaactttgtagagatagggagtgtgttccaaagcctgcttgctggttgtccagaggtactgaagtatcagtaggagtagcacctaataggcaagcaactaccttgccatcatgtgtgcttggtctttgtggaacacagcaaatgatgcatcatgtagtggtggtatccttttcctctgcggcatctctgtttcagtgtggctagttgttgtttgctcctgtaatctccaagagctaccatgtttggtagtaaaatccagtgccatccgttccatccacagggatgggccagagatagtgggctgtccaaacaggcctaaatccactaacaactctgtaataagtgtactgataactagtactacctccgtttgagaatacatgagcttattcgattagaagtattttcaaatcacaggaatataaaaagtaaataattggaatgttacatgcactctaatccatagaaattttttcaagaggtcttacctcgtgctaaagattataaggaatatggttataaaattacaattcttagtaaattggtatgatctatttctgtgaaatgaatgatgcatagagaaaaaaaatcctataatttcaattcctgcaataatcttttaaaaatcctttgtaccgaatgagatctaagtgatttaatttgcccagttacatagaatgaatctttttgtattctcggatggagacagtactaagtaaaaaagaaccttttcttctttatgagaacattatatagctactccaatgcacctcgcactgaatgaatatacagaatagcttttgtgtcatgataataattttcaaaggtactataatctctttaccacatactactgtagtgctctttaagctaaacgcatgaaagttaattacacccacatgtcacatatggccatatgggaattaattaatcggcaacaaccagcccggacaagaatcttacaagcgaagtgctcaagaaagtgtaaagcatagatgcacttgaacaacatcctgtgcgttaaaaattattttcgttttgggccttttttttttcttataaatggtcactaaccttaactgctttgtcaaatacctacataccaaattttaactcataatctatttttagttgctttgtttctttccacatatctgaaaaacttggttatgtttgtataacaacatatccctacgtatgatgattttttaatggatttgccaccttttactttcttgcacctcatgttgcaccattttagcgacatattttattttagaaaatagattaaaaactcggcagctacatccaacttggatgcatacagcccgattttagcgacagatagatctttacaattttataaattaatcatctctcttgcgtggttccacatctttcaagtggtgatatgctgtttatcatttatactatagtacgtacagatcattgagatatggcttgcagtctttcaatattggaccatcgatcgttactccgttagaatgttttagttaggtgatactacttatatgcgtatccacaaagtgctctttatgctggcataaacaaaaataaattcgagaataaatgaaagagagcttgcatttcttttctaggtggatggatcgatcatgcatagttaacacaatcagaacttgtacttcaattcgaagaataacaagttatttaatgaacaactcgaaaagtgttaaaactataaatttaatgaagccagcacctccttttagaatattacagcttttttctcatttcccccttgggcgatctgaactgatctctatacaatattccaaccagtgcagccaccagttaatacgtgaaaataacaagagtaaatttgtataattttttcgcgaacgtgtaaaaggattacacgtcaatatattagaagaaaaaaagttatagttacacaacgcaatcagccacggcttatgccaagggaagggagaaaaagcaaaataaaaagctgaagcttagaaaactacggcggctaaacacaaactccaagcagcgggaaggggccgagccactctacactcccaacaagcccacaaaagcggcaacgccagctaaagactacagatggccctccgagtggatggactccagaccactgagactgaagagagcgtagagtcgaaaatcctagagttccgttcattccacagctaccaagagaccaggagcaccagagagtcgaagccagcgcgaagatgctcaggtaagcaggccctggaggatggccaccagttctgtaaccagctgccacgggggagagtaattctctatcatcatgactgaatttcagtggcacgaataatattcatctctcaacgagagatctctcgttattcttggaagatctacgcgcaaggctctcgtataagccctaataattaaactataagagcatctacaataattacaaaactttcggtggacaatcaccttctccatagatttagatctatttccagtgcatatccaatccttgttggcatcctacaatttgctactaatccatatgttgttcatccctttctgcctaaagaatgtactcctgccgacctttagtttcttcttgtttaa

SEQ ID NO: 909 - DNA, 54912 bp, Oryza sativa
  unsure (1)..(54912): unsure at all n locations
gactcagtgagcagattccaagcttgtgggggtataaaggtgcaacccgcagctagctaggattggtcattatctacttgttcttgtataatagataaattttatgctaaatttatgccctcgtggcagatcatgcggtttcttttctatttgctgcgtccggcagctagatttgacgtcattttaattgtttttatcggatgttaattacgtcatttttcggttgaatgccggtaatttttttttttggggtgtaattgaggtttgaaaagaatatggaaaagatggcaggacctaattgcattgacgcccatagagaagataacctagaactcactcgatcagatatgccactcactggtatggtcaatggtcaaacagtcctccataaaaaaatccggtcaaattagctatcaaaatgtagacatctaaagtttggagtttatttagcgtgtccccttaactttacgggaacagacaataatattccccgaggaacagaagaagtaaaaaattatatgaaaaaatgatcatccggtacacacactgtttagtactccagtctgagcattatcacgcagacattctcaggcctcactcgattacagttgtgttttagttcacactaaaattaaaaatttgatttaaattggaacgatgtgatagaaaatttggaagtttatgtgtgtagaaaagttttaatgtgatagaaaagttagaagtttgaaaaattattttggtactaaacaaggcgtacttggaaatttatgcggatgtagctcaggtttacggagttttgcctacctaatagtctggtaacggcagatcgtgcaaaggatcaaaagtggttctgagtttgaacttgcgagacggaccaaacttggggcaaggcttccttttttacttttcttcaaactgtatgattgcttcgcacgtacaacgtttaaataccgtttctactttcttgacattccagggccaattagtttcggtactttcatttggcatatatacgaaaatatacaccaccatgcaaaatggtaggcacagaggtcagaaattagactcccggccgttatcttaattaaaaagaatctaaactacttctggtcagggacaaatttctaatttagctaaaaagattgctcagttttagagcatctccaatagcctctccaattgactcatttagccattctacctaaaaaaacatactccaacggcttctccaactcactagccaagctatttggctggccaaatcctcctcatcactagctacatttggtcagtctatttggttggccaatggtgagtcccacactgccaatctcctccatccccctctctctctcatccgtctctttcctacccaacctctggacgccggcgtacttctacgggaggcggcaagctcgagcacaacaaccagacgaggaggcacggggaggagcatctacgggaggcgaagacgacgcccgcccgccgctcgccgcggcccgccgcagccgttggccttcgctcgtcccgcattcgtcggcctccgcctcgccgtggcctgctgccccgccgccgcggccgccggccttcgcctcgctgcggcccgccgcccagccgccccgccgccggcctccgccttgctgcagaccgctgccccgccgtcggcctccgcctcgctgcggaccgccaccccgccccgcggtcgccggcctccgcctcgctgcggcccgccgccctaccgccgcggccgccggcctccgcctcgctgcggaccgccggccgctgtcctccgcttcgctgtgccggctccgcccacccctccgtcaccccgcacgctcgccgtcgccgcatcggaggaaagggtgtcgggaggaggcagcagtagtagtagaaggaagggagatgtatgagtgaggaaaatggggtggaagaggaggaagaaggttaataggagactgacatatgggtcaaatttgtcatagacttgtaatggagagggtagatagagaggctgttggagcaatcaatgactctgactagccaaatcagatggagagttggctatatgcgtgtttggagagtctattttagagaggctgttggatatgctcttatacgttatactttgtattcctcgtgtcccccgagcactagggggccgagcgcgggggagatgtgtctcaagcatatatcacgaggagctgtgcccgaggataggggtaccttgagcagtcccgctcgagggccgatgtgcccccagcatagttcacgggggtcgtgctgggggattggtggcagggatgtcttaagagcaggtacgataagctgactaggcgggctgcaaaaatatgccacatcatcttattcctatgtggaggaaagagaatagatgagagagaaggaagcgggcgactaatctgtcgccgggcgatacacttttctcaacgcgctaccgctcgattgcagcccgaccctggtgataaaaaacgcggtttgtgggacccgcacaccacagccgatcccgcaacgctccctccgcttccccctcgacgcatatgcggcgcgcgatctctgcctcctcgacgcccgctcgatctccgntttcctccagcgcgccatctctggatgcagtcaggctaccggcgtgggcggccaggtgcagcggcgtgctcccaggccgggaaagcgtggggcacgagacgtcgtccttgtcgaacagcaggtgcacgcatccagacggccttgcctgggacccctgagctaggtgcaccagcatggcacccgcgtccctgacgtagacgaagcgagagaagctcgtaagtcagcaacggtccggtccctgcttgggataataatattatgggttaatctagttagttgctatggtatttgagttatctattagtgcttgtagtttccatactacatagaacttggtttatatggtagtggtagtgtttgatgaataaaattcatgtcacagcacaaatggctacagggatataattcactcttgatcctacacattgacatgtacatgttataattaattatttgattataagatgtagtcatccaatgaataagctattgtacctatagttggctttaggagtgggctattagccagcagtgggctatactattagccttgctctaagtagcatatcaaatcatttcatttgaatgacttctatttcctctgttatttagtaaagatatcaaggtaaaaaatgaaatattctctttcagtcacccaggggcggatccagaaacaaaaaattagggggggggctcaattacacagtttcttcaacctccagccatttagggacctttagtttatcattcatggttaaaaaaatgaaaggggtgctccgggggtatccatggatcttgtgggtgtagaggggccctgcacccacgttggatccgtccctgcagtcaccttattggtcaaattttaaatattgatttgcttagacttcttaagtatccgattggctagagaatgtatggaatttgttcgtgcattaaattagtgctcaagaaatattttcgtcgtagtatacattttgaatcctacgaatgcttaaattttgaaacaaatggagatcttatattgtatacaaaatttaaatcctccaaatgtatattgaggaagaaaaaaaggtacacgaacatattgacgacacggcaggatttcaccggggccaaattaactcgtactacgaactggtagccacgaggcaacgactattgacgcagtttggaagcgagtccccctggcccctggtggtcaagcgtctcggtgatcgcgacgagacatcaccacaccaccgtcccctcgctgcctgcctccacctcacctgtgtgccgcgcgccaaatattccaagtagtgcacagtgcacaccgcgacgcacatacccacccgccggccacgcacgagaccccggttaaccacgcgtgtgtgaaccgcacactcctttccctttcctccgctaattaattcgcccaactaaactactcacctgcgtccactgcgatcgatcgcttaagatgtcagctatatatatactccaagctcggtgagccagcatcaccaccaaccagagctaacatagcagtagctagctagatcgatcgatcgatcgtctctccttgtaggctagctgctatacgagagcatgtgcttgccgttctcgtcctgctttggcggcaagaacgagctggacttcggcgaaaccagcagggaccccgactaccatcccctctcaaccacgcccagcggcaacagctaccaaggtggtgacgccaccgaaacgaggtatgcctaccagcagcaacggaagcccgccgccgcaccgtccaccgacgggtcggcgaaggcgccgcctctcgctgccgctgggtggagcaacaacaaggtcgctcatcacgcttaggcacaccgccaatggcagatacacaatcgctagccgctcctgcgatcttgattcaggtatttacatggtagcagctggattagcttcgcctgcttcagttatgtatagtacaagctttggcagttaaccagtcgtttaaattagctgcccttttgtttttcttctgcatgctggttcttccatctgatgaaaatggaaggcgactggaattatattagctgccgttttgttctgttggtcctcccatctgctgaaaatggaaggcacctgggagcagagttcatcactcatgtggtactccacacaaggtccaggcaacttttgttagcagaggtctttgtcagttttgttggctttgtgcttgtaggcttgtagctcccttcttcttgtatgatataatcgaagtggatcttgtgtacattcagtcctaatttcagctttggttgctatttggaattgtggatcttttcttcagtcaattttaactttacagacttgcatgcaaatgccaaatgccagtctcgttgagagcaaccatacaacagacaacactgtgaattcctgtttaaactcggacgaattctcgctatctcgtcgttgtcacaaacattgatccggaagagcatcgaggaaactgtttattgacagtgcttaaaggtcatcacaattgccaggattaattcagcctaactaaatcgcattcacctgaactagcatcctacacacaagaaaatcaatgtcatgaatatctcttctcagtgttgacgtcatttttcgtgcatgtcgattacgtcatatttcaccaggatgccatgctagtagaatggttataattgaggtttaaaaataatcgagataggaatagcaaagacctaattgcaccctttccctgtgcatccctgagctcagatgcctctcagaactggtcagtggtcaaatagtcttccctgaaaaaaaaaacacggtcaaatgagctatcaaagtgtagaaatttgaaatatttctacctcatgactttggagtctatcagtgtgtccccttaactttgagggaaaagacaatattccccggccattagagagaaacagctggtacacacactatcctgtcagtgaagcctttatctggccttcgtcgattactatgcagaagattaacaactgcatcatttgcttatcaactgcactttcaaagttttaaaattccaaacttaatatcaaagttgattatgtttcgtggtttattttttatattggcttttaaatcattaaggatatacatatataaccgtttggcatataaaatttgtattatgttgctagacgtaggccaaacgattaagctgtaaaatttgcggagtttttggctgcctaagtttggtcacgcaagattctgcaaaaatggttctaagttggaaatttttttttgaaagaatcggcaagctgccaatttcattgaatttaggaggagtaaactttacaagtgaaaaacaaaaaagcaaagctcaggaccttcggtccgagcaattaaaaagaaagtcaagtactcagatctctcacgcctgctaaggaccacgatttggcctcctctttgattttggccagaaggctacccatcgaaagctccttttgctgaaaggttctgcggttcctttcattccagatttcccaggctaccaggagcgttagtgtgcgcagagctttctttggagcgtcttttgtgtttgcggtagcctcccaccactccgataccgttgaagcttggtgccacaggctagggtttaattgttcgcatgctgtccactctgctatcgccccccagattctccgggtgtatctacactccgcgaggaggtggatggctgtctcttggcgatggcgacataagggacagatggatccattcggccaacccctggtggccagtctgttggatgtccagactctgttttggatgatcaaccatgcgaaggttttgcacttatgcggcgcccacggcttccaaatcaggttattgaagtttgtagctgtggtgcctaggagttgtgctttgtaagccgatgtcgtcgtgtattcgccgtggctggtgagcttccaagttattttgtcctcttcgtgctcaatcaggtgcagattctgcactacgctccagacttcgatgagctggtcaattagctctatcgaccagccagtgttctccggtaggtcaagatcttgcatccattgatctgagagcgaagcctgttggagcgtgctggtctttttcttggaggccgcgtagactagaggggctacgtccttcagtcttctcccttgcagccaacccgagtcccagaagctaacttttgtgccgtctccaaccgttatagatgttgcggctgcaaaaagtagcttgtcgatgtcgtcacatggcgttcctgaaccaacccacgcctttaccggtgatctccactcgtgccatagccaccgcagccttaaggctcttgcgaatttctccaagtttaggatgcctagacctcctgaggcagttgggaggtaggttcgtgaccagttgattttgcacttccacccgtcaatgcttcacctcccgcccataggaaccttctcctttgtttgtccaaagcttctaggggctccttggatgttttcaggcccgtcaggaggaatacttgctgcgaggtaagcaccgatttaactagggttgaacgccccgctaagttggaaaatcacatgaatgtttccttttagctttacattattatttttgtttaaatactttttgttcatttcgacatcccaatgcattattagtttaatagtttcgatactttcatctacagtgatatgtgtgttgcataatgttaggatagaggtcgaaagttagatcaaatgcagtgttaaattgaaaggtgtatcagagagaaggtcatggtgccgaccctatacattgtgaattttttaaagcatgtctcagcctaagagtagagagatagtacgcctgattctagcagagagaaaatgtgcttagtagagagagtatgtcacatacattgttccacaatgttagagcatatatcacatacattgtcacatacattgtgtctactagtagcacatagccacctaccggctgcaattttcccttcgctctatttttaatgtggtgggtcctataataattcctaaagctatttttatcttttcgcttatgcttatacttattagctaaaatctaaattttcaaccttaaatttgacgttgattttagggttttttcatcgaagtttacttttcagcctttgcttttaggtcgctaagaacacgtatataagttttatttataaattactttttgtttgcaaatatatcgtttggcgaataagccaaacgatgggaccttttgtacgatggaacaattttctcaggctgctaaggatctactatggttgatatgggtcccatctttactagtatctcacatgaattatacactaagggatgctcttccacttccatcgtcttagggcatccacaatgtgttgagaaatcaggtaataggcattcaatgctcctctacaacctggtaatagccattgtggaactagtaaataagtagtaccgggtagtatgcttactaccgatagcaagggaataaataatgttgtttacacaatcgagacacagagagttcaggatgaaagtatctttacttatgaatggggggggttttttttggaaacaggtggagaatattttattggtggaccccaccttaaaatctcatacacattgtgctgcctgcgtacaactactacctgtgacccaaaacctgacactaatgctcacttcaattttatacattggtgttgcccttaaaagaacacactagttatggtgagggaataaattcctactccgttcatttttcctgtgcatggacaggcatatccaaggcaagattatttcgctggtgtcaaacttgtcaagctgccagtaactagtatagtaagggacggatcagctcagtttccagtcgtgcgagccgagcatacgacggtcgaggccctggtgattgcaacgagacaccagcacggcatcgccgccgccgccgccgccgccgtttgctctgatacagattctcgtgggagcacctggtcgccgcccctgcctgccaaagttggcctgggtggttccccgcggcatcagctccacagtccacaccacgtcacgcgatgctgatgctgccggccgcccccgcgcgcgcgacacgcacatatgtacagtacagcaggcagcgcgagcccgcggacgcgcgcgaggcgtcaggcgccttcggttaagctgcggtttggggtcacgggctcacgtctcaaaggtcgcgcgacgcaacgtagcggaactagccgtctgaaccggaacttcgctggaacagacgagatcccctgaggagggggaaaaaaacgagcaataatggagtacctcgtccaattatcgtcatgaattatttacttgaaggttttataaaaacacgttttcttcctgaaaaacttatttaacggtattgattggatcactcatcctaagctactctatctggtcatataaacaataaaaactagatgaatccccgcgcattgctgtgggaatttagtatgataaaaaaaataacgtgtaagatagctagataacatcagattaagtaaattaatgtggtttatgataatttaaacttaaattgtagaatagtgattcaaacgtaaaaagtaaggtggtatgactttacgaaagaagaaaagtaggaagatagtttggaccgtagattaatcatctaaagactaaaagcaattgatgtgatacgacttagttagaggaaaaaaaggagaaatataatttggaccatagattaatcatttaagcactaactaaatgaaaatgaactatataagtatataggatatcataaaacataataaagatacacattgatgcatgatgtttaaatgtgatgattgtagtggatgatgatgtggcatcttgttaattagtggatgatgatgtgacatcttgttagtgaataatgatgttgcatctttgcatgttaagcttaaggagttagtgggggtctgcttaacgggtccgtttcccacttgcttgtacaagacttggaagaaaaaatagttagaattgtgataagaaggtaagaacaccacttacctgccccacttacatctaggataaatatttgacacagttaactttggacataacgtttgaccatctgtcttatctaaaaaatatgtaatcacattgtttttggcttgttttattatgagaagtaaaaattatgttaaaattttttgagatggcgccccaccatcctcttcatattgttatggggatcattcttgttgttaagtatttaagcatacatttattattatgatgatcttttgattgagtattatttccagttgtactgctgacatgacgttgtattgatcgtatatacacgtaacgtctgacaattttagatgtattgatcgtatatacacgtaacgtatgacaattttagtctgtttatgagccaagttcgtactgactttgcaaatatttctgacatccgaaacaatctgcactgcatccgtcctaaatccacttaagaaatactccttcggtcctaaaataagttcatttttttctcctcctgtttgttctaaagtaagttcatttttaatacaaatttattggaagtaaataaagtgaggataatactaatgggatttgatggagctaagggtattctaattctttttaactttgtattggtacgtgtgaaatgagtgaaaaatatggtatacaaacaactctaatgggaacaattaattgcttatccgtggccttgatcaattactgtgcaaaagtacccggatgaagccaaaggtttgtctgagttttggctacctaaagtttggtcacaccagattatgcaaagtggttataaattgaaaatcgtcttccattatagctttggatcgaatgcttttgtttattttgacatccgatgccaatgtgtgctaactgcataactataggtacagaggtcagaagttacggttccatcgtcttaaaaaaaaattctaatataaattctccgtataataataagagaataagttcctactccgttcagtttctccccggtgtcaaacttgtcaagctggtaagcgaggatcgactctgtccccaagcgagcaaacaacggtaaggtcagcccggtgcataatatgattgcaaccaaacgtaccccaccaccgtcccccgccgctccggtagattcttgtcgagcagcatgcgaggccgcccgccgcccctgcctgcccaatccgcctgtctctctctcgttcccctccaatccaccacgacgcgccgatgccgatgccaataacgatgccgccccgcgcgcgcgcacgtacgtacgcacgcgacaccgcccaccacagcaacgcacccgcgaatagtcccatgaacgcacgcacgcacgctcgacgcgcctacgttgggttgggttaaggcagcctcggttccacgtacgccgcgcaaccgcaaagcaacgcaacgcaactagccgtctgaaccggaccccgcgagatgccaagactcttccccccaacttaggtcagctcggtctatatatacacataacgctcactgcgccactatcattcgtgtcaaggcatcgccaacaccaacctagtcactagatcatcggcttgtctagcagcagcagtcgagcatgtgcttcaagctgggcacctgctttggcgttggcgttggcggcggcgacgactactaccgaggctacaccaccgtggccaccgacgagacaggccgcaaagccaacaacgacgtcgcaagaaaacccgtcaccgccgccgccgccgcaacgagggatgtctacggccgcgccgccgaccagccgtcgccgaagccgccggccgctgcgaggaacagcaaggtcgctgatgacacgggggtaaagcagccagctgatgctgctgctccggtcatctcgaggtatccgggtcatgtctactagttgcatttactacatggtaacgcacttggataatttgcagacaatcgagagagtttagtgcagagagtttttctgttctgtttggtcctcccatctgctgagaaatggaaggcacacatgggagcagagttagttccgtcttggagtcttgtgtgtgacaaaaggttcagagaacttttgttagtacttagtacaggtatttgtcagttttgttggcttgtgtagttgcttgttcttgtagctgcctcctcctcctcctccttgtatcatataatcaagtggatcgatcttgtgttcattcagtgctaatgtcagcttttgctatgtggaacctcttcttactttacagacttgtgtattgtgctagtgcagtgttgttcagaacaacctgataatgagtactaccagatgacattgagaattcctgtttaaattccaattaattatgactctttcatcgtttgcacaaacattgtgattggaataggatgggcaaactgtttattgcaagtgctttaaagttgataaattatcaattgttctgtgtattcacttgaactagcatatactacccagcaagaacatcaattgttctgtgcataaagtactcactattggatgttggacattaaaagcgagggtacaaggctacaggaagacaaaagtttatgccggcaaataaaaaagggacatggagataacaactgacactgtatttacacataagaagatggatacctccttttctctatacggttcttctgtttctctgttcagggttcttgacatgtggacagctgcagttttattgatgaaatcctaagaagattttcctatgtgcatatacttgtgctcgtccaatagcagctcctttaagccactcgttccttttctccttttcaacttattccatttgttatgccttgtgtttaaccatttccgaagagcatcggaatacagatatagatactgaggtaaaaatctatcatccatattcatcacatcaacttgtctgcgtgtgcaggaaatggaaaaggagtgcttctttcctccttttatttgtgtttgtggaacagtgaaagtgaattagttgctttctgtaagttttttttttaacagctgttataccctaaatcattaagtgttagtatattatattccaaacataggttcatgaagtggtaaagagtaaagactgctttctggctgaacacctaaacagagaattcggtgcgattctaccagaaaggcaaagacggcgcatgtttactatcccatccataataaaccaccaaagtatgcgacatttcttatgtggtaagtgtatttaataatgccaatcatgctttttcgacaagattaacaaaacatacaacagaccgcatttgcactcatggtgtaaagtagagaattcagcctagtgctttagcctctaacttagcaattaagatcttgatctattctctttagcttggaataagaccaagaatggagaatcaagcggttattcgatggagattgcgctcttgcctaagaactgacagagttaggaacactacaccgttggacggtgcaacctggaagacatgttgaaggcccatgtgactgtcattttcggacctccattatgtttcgttttttaactcaggaataagttcccaatcagtacttccactagcaactaaaacacactaagacatggaaacgatttggacgcaacaggtagacgtagacctggggacgactacgctagcatatgctaactttatgatttcacacatgatagttggataattcagtatgaggcttgagctctagttgctaatatttgttgattacaagcatagaaggtttagtcatgcttactgtacatgccgcttcctcggttttcaacatgctagggatgttacacacgaccagcttccagatcatttcttgatgtcctgctattgtgtagtctagatagctcaacatgatgcccacacactgactgctggctttctgcattgtgggagttggccacttgaagctcctcaagcatatggaagtatgcatacggtccccaaccttaagatgaaaaggaagagagccactttcaaaaaggaatattcaaatttgcttaaggaagagagaaaccattccttggtgaacgaatttgcttaagaaagctgaaaaaccttgatgatggtatggaggtggaaagaagtgcaagtaacagagcatcgccatgataaatcctgaaacatatcaattcaatgtgatcattatgagtatgaaagtgtgcaatacgtatgtggagaaggacagggggagaagaacagacctagtaggccgccagcaaacacatcctcccagtggtgtcgatagtcatctattctagaaatcccgacgagtgaagcaataagaaggggaagaatcataatgcaaagtttggcaacatgaccttggcgatcaaacaccttaattttgccagataggtagagtgacagaaatccaagtccagcaaaagaccctggaagcattatttgtgtaaaataatctagtcatggatttagaaaatcagtgtacaaattacttcacagtttttcatgtaacaatggaagtggtattcacatggtattcacctgacataactatgatcatgccagacagacaataagacatacaacacgaggatccagactatcgagtcaaggtccagccgtccaggtacaaaacattatttttgaaacaatggtacaaaacattataataactgagctacgggtaggatacgcagcacttgttgacaacctttaaccagtgattgatgcttgatacctcaaactaccagctactaggaaatgcaaacttatccatcaaaaatcacatccagtgtagatacgcactaaagttacaaacttacacgacgtgtgtccactaggaaaactcttgcgtccatcctttaagaagcttttctctccatgacaaatcacatcacctgtcacttgatcatataactgagataaaattaccagaacagtgccttgtcagtttcaaaattgacaaataacaagcaacataaaatggtagaactatttgtgcataaacatttgaggaaaactctacctgctttccatcaggaaaacaccgccaaaagaagtctggcctaggtcttcctactgcattctttaccacagtagttacaactgcagttatcagcaccgagtaaagcacacctgcagaattaacattctgatgagtttctcggtatatgaaattcagaactttgtattcagaagtagtgaaccatcagaagaaaatggagacatcgacaatcacctaatgttgcgtgatgaagatcatagacatctctcctagcgatataaacggatagaaagataattacagggcaaactatggatattatctgccaagaggaccgggtatccaatatcagcgatgaatgtgtgtattgagtttgtataaggaaatggaaatgcagaggttcggatacatacaggaacaccccatgctggtacagtgctttgtttcaccgggtaactaacataagtcatcatatccttcccaacaaaccggctaaatggaggagcgaaatgcagggcaatcacaactgcagcaagtaaaataagaacgacccaatcatgcaggtgatttctggccaatctaactccatgtgtctgaatcgtgtgagggcccagctgaacctccctcctcccatcctgttgaaaattaatacttataccaagaacatcagtattctacaagcaggcgtaccataattaagcctagatatgaccagcatttgagtttcaggaggtaaacataacttgcattactgcaacatgagataagttcaactaggatgttaattagattatattgcttcacatctaaatgtgaacatcatatctgaacatgagtcctattgagtattggccccaattttgattctgaggcaaatcctaacgaaacttggtttcatgtaataatcgcatcataaatattccaacacgttactcaagacttacgacgaaggggaaaattgcaggccacagattagagcaagtttaatagtacagctcactaattacaattagtcaatgttaaagctaacatgtatagtaggttggctataaggttatctttatttttttcatcctctctctttctctcaccatgaatttaatgcatatttcttggagtttgtgtgcagttagctcttgcatgagagccaacactccccacttttgtttatctctctcttctacataaacatatagcttgcttatagcccactattatccttgctcttacaggaagcagcattagactaattgcctaacaccctatgcaagaggaaggtcagatacagattacacattaggggcaaaaagcaacactgaaatcacaagcatcgccaactaagtatccgatcaatcaatgtaaagcgcattaggatttaggaatttcatgcgtctcaatggtgcgaggaatttcagatgtaaagagtactatacatctgtcaaatcgaacatccttttgcaaagcacatcagagcagtcaagagttgaacagaatgcaaagagctcattggtctcaccgtattctctccacgcattgaggactgcagaacaaaatcaccgcagatggatgcgaacctgtgccccaagtcagtacaaattccccgggtttccactgaaccaagcaaccaacttcctcagaattttcttcaagacatcagtattgcattcgcagcgtattccaaatccctaaatccaaaagcacaattagatagagaaaaaaaaacttttattgacagctttaaagtttaaaccgctcctaaaccctaactgcctagcatacgagctgaataaccaggactgtaaaaaccgaaaaaagaatgcaatggttgtggtgcgtacctagtagcgatggaagcgagaactcaacgagctcattggggaagaagaagaagaaaatcctcttttcattcgatcgagtctttttttttgagagagacgatcgagtttttttagtagagtcgtgtggaaggggacgaggcgagaaacggagaaaagaaacttcgcgagcatcgggaatcgtgagagagtgaattccggtcggctgcgcctaaagcggtggcgacatgggctgggaattccgcatcatcatggccttctcctttcgtatgggctgaaaccaagcccacaatataactaggtctgcttacaatctgggccaactaagcctaccaatgcaaagagtctctctcttatctttctttttctttttcttttttgacatggcaatgcaaagaaaatcatactggttctttcaacaatgacggctgctctcaaaagaaaatcctatatgaaatccccgcaaagaaaaaaagaaaagaataaatcctttatataaaaaaagagaaaaatcaaccgatttggattggcttgcggcggtgatgctcctgcaggatgccacgtgcttcgtacacgccggaacagcgtcacacgtacgcctctgacgtggcagcctgccgtttcatgtgcaagactgcagcaaacacagtacagccttagtactgtagtatacgtactaatcctgtttcttcttcgtcatagaactgttgattttatctgtttaaaagaaaggggtttttccaaatccaaaatcacgacgaggtctagctggaaaatggagaagaggacgcggcctaattttgcaggggagcaaagagagattcgattctctttaagctgctcgttgccctgtcaggatgtggggcccgcataatatatgctcctcctcgtaggatccacctcatcgttggatcaatttgacattgcatgattcgctgagacaacaagagtccgtcgcttgcacgtttgcatcttggaatcacatcctcactcctcagaatagttcattttcttctcccccgactatctcaaaataagttttttttttcaaaacgagaataaatacattaaaatagatttaaaaagaataactatattatgaattaaagaaaatgaggtactctaactttacatggatatgtataggatgggtgaaaaataaatttattttgggatggtgtgtatcctgtaaattttacctatagctttagggtcccttcgttttggaggaaaaacataggaattttagagaatttcaattatataggaaaaattgctatgaatgcatttgaatcaaagtatattcctatggaatggacaattctatagagattttggaggaaacttaacgagagctcaaagctattggaaaatttcttttgagtttatctctcttattcgatttctatgtttttcttacggtccaattaaacggtcattcatctgtgttttcttgtattttacaattctctattttacactttcattcatgttagaattctgtgttttttctatttcttcattttttttttcattcctactatttaaaacggtccttcgtttgtccaatttggacatatataaaacctcaaacttacatttttaaaagaaaataataaaaatgttttatatccatgggctcagatcatattagctgagttaatttcacataactcagatcagacggtagagataaatcaactgcttcttaaacagtttcagcagcaaaaggcatgggccctgatggagtatatgcagccagagacatcacatggatgcatgagtttctccttgagagatcgatgggtccataagactactctaatccagttgacaagaaaactagtagagcctattgtgctatcctgattgctctctacacacatccatatacaccggtcactttcagcaccattatacaactctgcacacaagttaacacacatagattaagtgatctacaaggttcagaagtaggtttatggagtgctgcaatgatgagagaagaaacggtagctgcacattgaactccactcagtttcctgaagatggtgagggagaagattaattagtttatcatgttatccaatccatgtcaacgtcgtatgaactaacatggaaaactaagtcaacgactaaggctgtcgtgcatacaaagcctatgttgagcctactagacaccaaaagaatcacaaaggaacaatctttttagctgaacaattcttctcatgtgcctgatactatcgcttcattacttaaatcaaaggaaatttaatggttactgtatactcatcctaatatatatcctccaggtatctaattacaatgtactaacagatttgcaaggagtacaaaacatgaaagaaaatgatatgtgggtgctttaccctttgttcttaagaaattagcatagatgcatgcatgacctgatgtccattaagcccacttgccaaaaataagtttttgctggtacaccaaacatgtcctcatataattgtttttctaattactaaaccaaagggcctctcatcacccatgttctggtaagattcccattatgatgagcatccattaattattgacactgagcttctttttaaactaggagtttatgttcattagatggcaccaggagtacgaatttggagtgtcttttcaaaaaagaagtacaaatttgcattacacagggtgcagagaaagtatggtgcactgtttagccatgtgcacagcagtttatcaacaaaacctttgtctagcacgcaggtaagctgttttacttagcggcattcattcttgcgcgtaaaatcaaagcgaaactctgcaaaagtgctaattaagcatcttcagattattattgttgctgttgctgaatatagactgaaagccagaatatgagatgaccttcttttgctccagttatgctctttctaatttgaaccaaacaaggtggggtgcagaccaaacatcaccttggttcgaatgattgaaatgataatatttcagaaattggataggcagtagtgaagagaaatatgctacagaacagttgcatgaaaaaacaacaggaatgcgtcgttgtcacagagcaatcgacaatcctgtgttgtgttgcctagaatgagcccaatcctgcatgcacgtatacgtcgtcttctccgtttcatacttgagagacttcgaggtggtcgaattggcactcatggagatggagaggtgtagcaattgtcgccatggataatgctggatattggagaaggaacattggggtggggccctcccgttgttatggcccactctgactaatccatttggtccatcaccctgatcagctgataccatgatggcccggtcacccaatcctattggcccatgtcggatggtgggccccacatgcatctcatcaacttcacaaataaatgggcgtagtaaataatactccttagttcaacctaatatagacgtgatatatctaagattaagattgtcaatatctcaattagtattctagtatcttatgatactacgattcacgaagaagaaatgatactgatcccttcgtatcataattttcatagcatctcgatctaactattcatttccacacgattttacgaaatcttagatagtatcctgatactacgatcctactaaatattatttaaaataaggtggattaaaaataatgtaaataaatatgctcaagtttacctaaaaaccaattaaatttataaaaaacaatatatatactttaatttatacaaatagtatatattttatataaaaatatgtaatttctacaatctaatggtatcctgatcctaggatactataatactataaatcacgtaatactaaagatcagaaaaacaattctacatagtattgattacgactatgaatttgtattatgatgcatttatatttggacagaggagtcatgtattactgaggctaattatcgcgtcagttaaaacagttggatggaagtgttagctgcaccaggagatcgatcagctgttgtgtgcatcagcagagcaacctgtatgtctctttacctaattttgctgctggtaaaaacattcactaagcacatgtaggttctgctaattggagtacctaacaaatgcaatacgagataaatggcttcttttttacacgatcaaagttcttgcacaaagtgcataatgatatgacctttccctataagagatcaagcaatcagatatctgcaccaaattttttttttagaaaaaaaaaagcagaggtagctttcagctcgagagagaaactgggacgtgtaggagaaagcaggtggctggtcataatcgccattcaccatcaaaatgctgagtcttttctatcataggatcaacaccaaccacctctgcaattgccggactatttaatcggcagctagcgacttttgaccgagggatacacaaactcacactaatttgtcgccgttggataacgatcggacggcacggtaacattgtcacatgcatatatctctcacgtcgcaagaaatttcacacgagactatatttccatctgtttatttgtctgttactgttgttgctgttcaatgatcacttgcatgcgcatcggatgtgaagttgtgaacatgaccgatcgactatggtattggacaattcccatcgtgcttgaattcacccgccattggggacttgtggatgtccatgtccaattggtgagtgttttgctcatatcttcttattggggttatgctatatatactgatgtagcactagttatgcatgaaacaagatttcactgaaatggggcatgagtagatgattaattatctttcatctttaatttgcttgtggatatgaaatgtgttctttcatggacatgaggtaactcggatggcgatgggtttgtcctccttgatatatactaacgcttgctagtttccttaattcttattcagttatagagttgctttctgacgatgtttttttcgctttatgcgtacatgaacgacaacttgataaatatacgagttgcctacgcattcaagcgacaagaggagaggggttgttgcatcagcaatcgctgattgctagctccaaattaaaaaggtcatggctcgatctctgccagaaaaacaaagcagatagataaatctatcaatcttcaatcgtcgacagttcttcacaagtactcgtaccagtactatctagcgtactagtacagtagtacgtgttagggttatccctaactgcgaattaattaaattaattagtagtaatttgttgcgcttgtcagtaagtaaattcgtcagcaacgtagtaaggcatactacgtacgagcgcaccatcatcatccagcactaggggggacaatccgtattgatttgttcaacgaacacacacgccgatcggtggaaagtgagaaaaaagacggtgaatccatgcgacgaccggcctgcgcatgcataatcgtcgattcgatcgatcgatccaaagtattcagtcaagacctgatcgcagccatgttcgcggagaccaattattcagtcaagtctgtcaagacggggaactactacacactactagtgcagaagagcataaaagcagctagctaatgcactagtattaactagtatcgcggcgtacgtctctcaccggttggtgcatcagttgtgtgaggagtgaagaatcgaagctgcccggccggccagcacgaaggcgtacgttgccaggtagcagctggacacacagcgcggcagcacgtactcgcgagagcgagacacgaccacgcacgcacgcacgcagcgtcacgaacgcggagaggccctcgcgcgcggccgctccacggctcggcacgcgggcggggacgccgtggatgcgcgcgcgggggagtcgagcgagacgtgcggcttcctagcgcggagtacgggggaattcgctggatagatcggccgtttgacgcgacgttctccttttccatccgctgcgtcagtcatcggatgtcgtggcagacgccgtgtgcgctgcctctccgggcggacgaggggcactcgcctcgcccccgcgtccgactctgatccgcacatgtaggacccggcagccgggtgatgggttggattattggattggattgggcgaggcgttcgcttcgagcaaaatccgcccatcgattcatcgtgtcggcccagtcacggaaaaggaacactctctactgtactactctacatacgtgatcgatcagtgcgtccgtgctagctgtgcatccatcaatggatcgattatacatgatgacataggatcgatagagagaaacaaaaaatgagatatgaacaacacgctatctgtatcacgagtcatctttaacaatatccatctcatcattttattgcctgccgaaaaatattcagttcagcctccacaccgctcggtcgccctgccccgggggcgacgcgggcggcgaaacaagccgtgccgcccctgcccctctcctcccccctcccgcctcgccgctgcccaagccgcaaggacggcagcggcgaggcactccctccctcgctcgcggtcttcatggtcggggcgtcggcaaaatcggagcggagggcaagacgccggcgccaagggaagccgccggcggcgtccagatccggcgctgggaaacatggatccaggccccccatggccggatttgttgctccgggcggcggggagccgagctagcgcgtgggcggcatcagcggtgtggttggcggccggtggcatgcatgctgctagcggggttgtacacgaggcgttcggtggcgagccggacgaggcggcggcatggacgaggtttcgcggcggcggcatgcatgctgctggcgacctcagccggcggcggtggcgtaggggttggggggcgaggtggctagatccgcctccctacccaggctcagtgcacggcggcggttgtagcagcggtggtcatgcaacagggtgcggctgcatggagggaacggggaggccgactcccgtgtggcgacggcgacgacgtctatggcggctgcgtggctgtggctagggcggcgaccgtcgcggctgttgtggaaatagtcggcgtgggtgtgggcggcagcaagtggaggcggggaaggagtctaccggtgagatgcacggcgcgcaggcctgacggcctcgggcggcttgctggtgtggaggcgaccgtggtgcggtggtaggaggcacggttgtggtgaccgtggctacacaaccatggctaaggtggggcgaggcatggcggccttggacggctagccgagggcgtggcagacggctgcatctggccggcacggcaacgtttggaggaggggtcggatccggcttggcgcagagtggcgcagccgatggcagcggaggccggctcagcgcgagaggcgcgggcgacggagatggaggccggcttggcgcgagaggcgcggccggcggtggaggaggcgacctcagtgtaaggaggagctgccggtgggtgtggcgcggtcttcggtgcacgaagactagccggcggggggcgtcggtgcagtggtcccacatgtcggtagaggttgagtggtggaggagcatcggtgcgttagccgtggatttgcaggtggtgaacggcgggtgaaaacctagcccggccttggccggaccggcaacgatagttaattccccctcctgagggcgttgtcgtgctgtctcacccccttaagggtgtttgccgggtgaaagcccagtcggagcttctttgagcctcgacggacggcggcagcagttttccgtcgcttctcttcttgaagacgtcgttttggcatcccctagctgaaacctctagatcgattggtccaagctcgctctaggagttgggctttgtgttggttgtgagggcttgggcgatcccgtttgtgttcctttattggtctagcggcggttggtcacgcttagcggcggccggtccggtactaaccttcttccggcttgtgtgttggtgctgtcggtgtgtggtggaatttttttcctttttcctggttacgacccttcagggttgtaatcttgtaatttttttctgctttatcaatataacttcgcaccgtctcgtgcgagtcgttcaaaaaaaatcagttccattttattaattcattttattaattcgtcatcagtcatgcattcatgtagtccaatatttccatctgatgtaatcatcctgaaacagcgcgacacatgatattgttattttcctctcctactccagcacgtacatacgtacatcacccaagctctcgttgaccaatcgattgctagcgttttaggttgctctaatctgcaacccattgcattgatccatcatgatgatctatcgattgtacctactatcttttactatgtctcaacatatagcagcaccaacacataattaattaaccggttaagatacccttctccaacaaaagcacatccgttgttaattaactaagttagttcagttcttctggtgcgtacccttttgccacgcaagaactaccttagctttttctccagctggtgcttgctattactctatacgcgatacctaacttatacgtcaaattatatcaatatcaaaagattttaaaagtacgcaatttatataagaatgctgctcgatcggaaattaggcgtttcgatcagctggcctgcactgtacgtaagcttggagtctacttcatttatctcgacagaaattagttgctctcaatgtctccatcatttttcgtttgatatcctctacgacatgtacggagtatatctgtatatgtaaaaatatttctgattaatccatactcgaaaaacatttttttttcttttactgatacagtaaagtcgatttgatctgttgatgtgatcagcctggctgtcagcccggttgttcaattcccaagaaggttaacgtttctgcttgtccaacggccaatcacaaatcttggatcttgcatttgtagcattacttttgtaattcttcggcaggtttccattgctcagttccttttttaaaaaaattgtaccagtacgattctactgttccatcggtgtcaaatgcaatgaaccttgctaatttgttgtttcaagctgtcacgaatatattaagtcatccgatgatcttagagcatgttcattttaatgccatttttaaccttactaaattttggtaaagttaccaaaatagtggttgtatttaatttgctgccaaattaattttggtaactatataagaaatcttgccaaaattttggtaaatatgctaaaattttgtcaatgctaaaatttggtaatgttttttttcatcaaagtaaacatgcccttagtaagaagaaaggaataaaattctttgctttgttgttttctcaacatcttattgctttagatttatattctcagagagaaaataaagtcgttgccgtggaaatcagactaataccattggcaaagggcatcatctacactgatattctttcaattttgtgttgacaagtaacaaatacagtacatactgaagctcgaatttgaaaaaaaaaatgctgtcttgtttagggactttcacttagtaattcaactattttaaaacaggttaaatagctcagtctcacttttcccttacaagtacaatttaatggtatctcaataaatattaagggcttctttgatttggaggaaaaatatatgaattttgaaggatttcaatcttacatgaaaaattcatataaatcactttgaaccatatccaatcctattagcaagagcttaaagcccttagaaaattttcttcgagtctatctctctcatccgaattataatgtattttatatcaagagttatcaatgagaaaaaaaaacaaccattatcattgtaactaaaccctaaaattcgaagccaaaataaatcttagatcctcctaaatctaaaagattcatttcactgctagaacctagaaggtctgtcatctaaaataaaacagaaatggttgagcctttccttttggttaacggaggaatagggaaagaaaaccgctccaggtgagccgccgtgcggcagctagatcacagggccgcaaacaataattcgcgatatttccttcaagtgggccccaccaccttcgtcttccccctttcctcagcctcctccgcgtttatattccccgtccactccgccaaaagcccctcttccgatcttcttcttcttcccccaaaaatctaattaaaatcccctcccccaaaaacccctctcacccgaatttcctcatggactcggtgccggccgccggagtcggcgtcggcggcggcggcgcgggcgcgggctacccggagtccacggagtcatccccacgcagccggggcggcgactcgtgggacgagcccttcccttcctccgccgcggcggcggccgcggctgccgggggagggaggctccgcctcatgtgcagcttcggcgggcggatcgtgccgcgccccacggacaagtcgctgtgctacctcggcggggagacccggatcgtggccgtcgagcggaacgcctcgctggccgacgtccacgcgcggctctcccgctcgctcctcggcggccagccgtttactctcaagtaccagctccccaacgaggacctcgactcgctcatctcggtctccaccgacgaggacctcgataacctcgtcgacgagtacgaccgcatcgccgccacctcctccggcggcggctcctcccgcacgtcgcggatccgcctcttcctcttcccggccaagcccgagtcatcctcctccctcggctccctcctcgacgactcctccaagtccgagtcatggttcgtcgacgccctcaacagcgccatctccggctccctcgacggcatcccgcgcgggatctccaccgactccgcctcagtcaactgcctcctcggcctcgaggacgactcctccacgcactcccgcggcggcccgcctaactcttctcccgccgaggaacagcgcgccaaccagcagaagctcgccgcggccgcggccgttgctgcggcgaggcacccgcacgacgtgcagtccgtgccggactcgccgatgattgacaagaactcctcgttcggatcaacgtcctctgcgccatcgctgtcgaatctaccgccgatacgggtgcggcccgaggatcgcccgccggatagccgactcgccccgcaggttcccgttgaggatcacttcgcccagatggggatctccgatcagccggtgcagcctgtaattgggggatacatgcagccgccgccacaggtgccgatccccaacatggctgtccccagcatctccccctcggatgcgtccagccgagtgttctccgacgatgacaagtccgatcacggcggcggcggaggtcggaagccgcagccacccaagccggaggttccacctgtcgctgaccccaccaacaggtaagccatttgtttttcgattcttatactggattagtaatatgcttggattggctgtatggaaggaaaccttatgctggctatgtgttcgatcaaatgtttcagagccatgtactacaacgatagatcgcctcctgctgaattgaagcgtgacatgccggttggaactgatgctgccagctatcgtgtgcctgtgccagcccaagatgctgctgccgccgccgccgctgcggctgctgctgcccagcaacccccagctgggtatgtgtatgcacagatgcatgcgccgccaccgcagcagcaacccccaccaccacagcagcaacagccagtcccacagcaatatgtcactgcacaaaatcagcatttcattcacaatccagctactggcacattcatcccaatccaatcctattaccaccatccggtccctcagcaagcaccacagccgcccatgccgcagcctgtgccacagccacaacaatcacacgctttcgacccaaatactggcatgtattacattcccatgcgcacgaatgcgcctcaggcatatagcatgcctcctggtgccgctgctgtgccgcctcccacccttgttgacactacaccaaaaccaaccgtgccaattcctcagatggccgtgaagcagcctgaactgcagcaacctggtttgtaccgaactaccgcagcacctacccctgtaccagcgtctaatgctcctgcgtatgctgggatgggctaccaccatgttattcaaacacaccatcatccagcgccacagcctgcagcgactgtggcaggcaattttggatatgactatggtgatcccacgcgagcacaggtcttctactcgcaggcagcggcaccaccaacattgccacctcagtatcagcccatgggctcgcccgatgctggccaggctgacctgaaacaggcccgggcttcatagctcaaggatttgtgaactctggtatgttgagaatcctagaagtgtagttatcctgccgttaattatcactattgttattacatgttacatgagtcagttggcaaccagtggatggatgatggcattaggcagctgtgcatttgggatcaaaataagatgaaaatgggatggtagttcttgtgttgggtgaaactcaagagggtgtttgtgattggttctggagatgccaatcgccaatgctggagcaagtggcggggagtggcttccaattccaattgccgtcttcttattttttaaaaaaataaatatatagtgtctaaagaactcggtacaaattctgaatcaagaactcatcatttgtgtagccctttgtatatttgaacctggaagttattgaggttgaaatgtcagataaaagtgtcattactttgcttgtagaaacttcatttgagttaaatatcatatatatacatcattcctgtctctgtattttgccattgatgttgatatgtttcttatggtttattacattgacttgaatcttgctgctattgggtcatcacagttccgtgtgtgtttttcctttgggccagttgcttttgaattggaacttattggctcgcaagtccaggtgatttgtttcttttcaatgtatatcgctttctgtagactgcccgcttgcaaatcaagtcagcatgaacatctatcctgttcattctataacgtaatgttacgggcacggagacagaagattgtgcatttatatggactgcgagccttcagtatcagtcccatgtattactaggttatcaaatgagcatatatattttttgacgcaaaaaatgagcatatttgcttagctgctaattcattactttttttactgtggatttctaatttgtataagtaatcctgattttcttgcaaaatttgtataagtaatcctgattttcttgcaaggaggaattcaccctgctatgatttgccaatatgatggatgcactaattcagtggggggtatttgtaagagttgctaggtctttctcagttgattttcgcatccgctgaagccgcgcatatatttggcacgagataatctgttgatacgccaccatggtactcctaggttgcacctggcctgttattttagcacataattatgcgtttctaatgtggtgtgatttgccggggatcatattctttttcggtagcgagatcccagtgccgctttgcgatctcgaagcgatggttgtaatcgattgcttggactaaagaggcaacactttcttttctttcttttggagccacgctagcttaagatatagggtaatgctaggtggttgatcgatgggatgatcattgatctcgcccttgcctttacggcttgtctgctaaataatttaagcgttgtgtgtagtatatgattacatgtgtatctctcggtggccaagtcgaagcacagctctgcccatgcgcaattagtttggtacgataaaatgatctcacgaacaccactttacggctatctttctactcttgagtacagtatattcaatccaaagggagatctatgcccattaatcaatctctccacttgcaaactcgcaatcccttcctctttctggttctcgtttcagaaactcacctctcctctccacttgcaattccttcctctcctctcagttctcgtttcagaaacttgtttgggtgtgcagtgttcttgacatgggattaccgctgtgtgtatggtggttcctacaaaactgcgcgagttgttttgggtgaggcgcacgatcgaactgtgggaggaggcgttggatccggggaatccaggaggacgcggcacgaggcccgggtacgcaatccaagctggagatgggcgccacacacttgcacgtggcgtctgcgccctcccacaccctcgctcccctgctgctgctgctgcgtcgtcaaactgatgcccacctgagcagatcgacgagaggtgcgcgcgtctcgggcggagccgacgccgacgccgacgacgaggagcaagtgaacaagcgcatgtgtgtgtggacggtggatcgggtgattctcctgctgcgccaccatcgcatcgtgagtcgggaaacatggagttttggacggtgcgccgtatccattctccggcttctcgccgtgtccgagaactccagtacacgcaggtgaggtaggggccaacgccacgctgccgctgcgtgccgtgcctttgcccacatggggggtactactactactactgctactcgacatggcagattggcaggcagagagaccagtagtgcagtactgcgatgcaaggggaaagccaggcaagcgtgcctcccaaaagcccagatgcgtgtgcatggttttcctctcctctcctccccggcgcagcaacagcagcaatcatacatggctttagatgggtacattgccaccattgcatctctcctcttttgactgcctgcccaaaggccaaaaacctggctggctggctggctggctccatttgtcggaggagagatatacatactgtgtgcctgcgccaagtattaccagctgctgtgacatcaagctggagctaggggatccatccatcagcttaatcaatcaataatcatcattgatcatcacccactacgacgtactgtactacgtgtatgtacattttgaccggcggtttcggcgacctacctctcatctcaattctgacaggcagaccgtcgtgcgatcggcctacctaatcctgcttcctgttcttcaggctttcagctggacggaccacgcatcacatactccatacctggccttaattgctactaccagtagagtacatatggtttggttgatctaatccttgctgaaaactgctgatatccatagatcagtttctatatatatactgtagccgactctggtagtaccggtagatagcagatagacgggtgagcgagctagtcataaagaaacacacatggtgctgtccttcatcacatatacactttgtggcctatgtcatggtgcatcatgatgtgtctgcatcttgttcttcttggcgtgatcgatatatggagatacttaaggaatgagtaggtattaggtacatgtatatatatacattggagttttgcgagatcacatccaaatatcttaacccctaggggagaatgagagagatggatatgagatgatcgtccaagggaagatcatggctgttggtcattaccctcaggcagagggaatataatcttttaccggataggtgtgtgtctctgtcctgtccggcctcgccattaatgggtggagcccatgtgtttcgcagtcggtcaatattgccatgcctagtagtactgtcctcttgatcttcttcccatggtgatcagatcagacaagatcaaaggcgatcgtgaaagcgaaaagaacggagaacgaaagctgtgtatgttactatgaacaatattaatggaagaacagctttgtaacagccttttctttcctttcggatgtacatgcacggatcatattcttaatccggtttaaagagcgttatatgtacacatcacatgcatgtgatgttaggtcatgcacggtcgatcgatgctgcaatcttaattggtctcgatcgatcgatctccttggttgattagttgctgatcaattgattcaatttgcagtggctcctctccctcttgggatcttcttgaaaacaccagaatcgatgtcgccgacgtggctccggagatcgtgcaccgccgtcgacaccaggtggtcgacctcgctctcgtaattctcgtacatcacaggcagcgtcatggtgcctagcacaactgcgaacagaacacagccatgatcagaaaactaccatgagcttatatatctctgacgcatgatcaagagatcaatcagaaatggagttctctgaagaattaactgggagtttctgaagaaatgggtatcagttacctaggtacaggagagtcagggagctgaagcagcttgcgatcactgacgctatgaacagggagaacaccgtctgaaacatgcacaggagcagataacgtatcatattgatacaggaagtatcaatctttgtgtgcagtagcagacactcaccaagatgaacattttgatgtcctttccacaagcaatgtcgtagagcctgtgcacgaaccaagttagcctgctgtgcaaggccaggatcacttgcctggtggttctctccgacacaaaaatttcagggattcttggagccggcctgcagttaccatctcaaaacttagaactttccaggattgagaacgatacagcccatgaaaaacgaaatcttgggctaatttggtagtatcaaatggccgtgctttgtgtaaattaaatgggctttatccttgatgaggcccagattttcagataaaatggaagaacagagagagggaggaagagtgagtggcttacaggttgaagaaagcagaagcattggcccatatgaagacgacgagcatgccgagcatggcgaggtagcatgccagcgacaggaaatggtactccgccacctcgaacagataccatgccaccgtcgctccggcgacgatggacgccgacaccctcctctccctccacaggatgatgtctgcagctgcattcatcaccaatgcaaattcagaacagatacacttcgagtgattcacatcgattgcaatgagctcgtttaagcaaatccatgaataatgtactagctcgcaagaactgatcagaattatcaaaattagtcacctttgtgtccacctagggcgtcatgcagtggcctttccctgccgaagagcttggttgtcctgtgagttcgtacagttatagccattctgttgatatccgaatttgatgtggcaatacaactgcccaggatttgttcttataatcggcttcgccattgcattgtcaatgaacaaggcgtccattgcctgggaaaagcaaggcataactttggctcctggcttctgttatcggtattgatcctttggtgtccaagtgtgattgtttggggttgggatctgatccaattcttgtgattttggattctgtatgatcgcgtttttttgtttggttgttgaaatgtgcgttacttgtattggagaatgagacttttcagttgaaattctgtggagtaaaatgagcaaacttgggagcttctgtacgagcatctctcaaagacttcttacaaatgcaacctctggatttcagatttggtgcttgaaaattcttagcgatcaacttgaaaacttgagaataaagtttgtgcaagtgagaaagattcggcattaaacctttaaacaactaaaaaaagtacaaggttctttcagcaggtacgtttgtaaacatatacagtatacttgtgtagaactattgattcagaaatactgttactactgtactactactcttcagtggagtgatcagaaattcagaatacttgcatgattcaagtaagaactgaacagaatttcactctttttgtactgtgactgtgacctgttgttgatgatttgaataatttcaaacgattttatatttttgttgaaaccaagcacacctttatgttttgctatcgtcctattgttcatcccaatgaaacaaaagttccactggagtactacatagtgtcgttcgaatgatcaaatctgacaacagcctgattgaacattcagatcttcaaacaacggacagtaagcgttttcatctaccgcgtctgtccttacatactatttaacatgtcaactcacaagcaatttgcaagagattagatccagaatgatattctttggagtgacatgacctggccaagatgcttatatggtggcttttggcctgcttaaattattaaaccaccatgacaaattgacaaagacacaatgcctttccccattagcaaaagtaggagtatactatggtgccaatcacatgatacacgttagagcagacggccgcagcgtcaaatatccgcatctaacctcataatcactcactgtatagcagtagtagtagcagaaatagttcgtctctttggtcccacattaaggtgtagggtgcggttgttgcgtcgtggagaaaacgatgcttttttgctttgtaaatcatgttgtttagtaagtctaatgggtcatttgcattgtatagttgcagtactactagtatatcgttgatcagtgcgttcttatctgcttatcccttaatctggccttgggcgtttgcaaggggcaggttttacacaggcacagtgccagtgacagcgtaattaacgacttaatcacactgttttttctctcccgagtacttaattacactttgttagtgctaaactgctaattatttgtttcggccgacggcgactggccgcggaggaggaggtggttgccgacttgccgtcaactgagacggacgttttggcgggagtatcacgggagggcccacctgtcatcgagctgttcagggctaatcgccacgtttcgacggtaacccggacgtcaggttcggctcgctccacgacgaaacgcgcgacggacaaaggccacgtcagatggccctgtaggtcacaggcagcgcgggcccacctgtcatccgcgtggcccacgtgtcctcgacggcatcgatcggggcccaccacaattacaggtgggacccgcaggaggtcccatggcactgtttgcaagacattgttgccggcttcctaattttgttttctgcacgcttttaaaactgctaaatattaaatttttaataagtttttatacgaaaattgtttaaaaaattatattaatttattttttaaaaaattatagcaattattaatgtaccgctccgttttcatttttgggttgggaacatgttcatgcgaacacacctgttcacgaacagtatacagtacttggctgtagcgggcatcttgtcctggcatgtggggcccagtagcagtgacggggacagatcacgtgggcccacatgtcagtgtaccatgtcaaacctgcgcaccaactcctactctataaaggaaaaactcgtggtcgtcttcctcctcgagccattccacaaaattcggcaaaatccagtgctccagtcagtggcagtggcagtggccatggactccgccatctccacctcctcgtccttctcgcctctcaggttgtctcagaatcatgggagcatcatgagcggtagcaccagggctcaggtgctcccggtgggcaggcagcagcagcagccacccgccggcggcgccacccgcctccgcgccgtctcgccgtcgccgtcgccgacaccgcccgcgccgcagccggcggagacgttcgggttcgatgccctcaaggaggccttctccgtcgacgtggtggcggccgaggcgcggccgctcaacgtgcccctggccgcgcccttcaccatcgcgtcgtcgcggctggacgccgtgtccaacgttgccgtccgggtggagctccggagcggcgcggtcgggtggggggaggcgcccgtgctcccctccgtcaccgccgaggaccagcccggcgcgctcgccgcggccacccgggcgtgcggcgctctggccggcgcgcccgccgcgcccctcggcgccgtgctccaggacgtcgccagtgccctcccgggacacgacttcgcctcggtgagacatttcacgcaatcccgtcgaacacctgactccaatttcaccttaatcgtcgtagtctgatactctgatctaagataattactgtcacgggattcacgttgatgagtcacaactgtgcctttctttcttggcgttttctctgcagtagctgcctaatttgtgtgctggaattttgtgagaggtcattctctctggtaattggagtgttggatactgccgatatttccttgaaagcaaaagatagttttgctacaaatatgtggttgctaagtgataatacaggctcatgcccatcatatggcaacacgactcgtaattcataatcgcacatgagataaatcctagatgaacaatccaagttactcctgtaaagacccttttgggaaaaaaaaagttacctgtaaagaaccatgaattacaagcctacaataacagaggtttcacatccaaaatcaggttcacctgttcttttttaattcacatacaagtgcaataatgtaaggcatcatcaaatggttctggcctttcttttaggactacactatttcgttgtttgtttggtacaagatttatccattgatgtctattcaattgtgctcttctccaatgaaggctagagcaggagtggagatggctttgattgatgcaattgctaacagtatccgcatccctttgtggagattatttggaggggcgtcagacagtgtcacaacagatatcacggtatggccatctcagcatcctctgcattgattacagaaagcattctttcttatgaaaatcgttaatttcttctacttttgaatttagattccaatcgtgacaccaaatgaagctgctcagttagccgcaaaatatcgaggacagggatttcagactctgaagctcaaagtcgggaagaacttaaactcagatatagaagttttgaaggctatacggcttgcccatccagattgttcatttatcttggatgcaaatgaaggatacacagctaatcaagcaattgaagctcttgatagactaaacggtttgtacccctgtaaattgtaaagcttcctatattctgaaaatctttgcttttttttttgcggggaaaaaatcttagctatttaatatctgagccgtccaatcttctcctattaagctatttttttgttactgccattggtttcagaaatgggagtgactccagtattgtttgagcaaccagttcatcgagatgactgggaaggtctccgcgatgttagcattgttgccaaggagaaatacagagttgctgttgcagctgatgaaagttgtcgtagtttgcttgatgctcagaaaataatggatggaaatcttgctcatgttattaacatcaagctagcaaagctagggattcttggagcccttgaagtaattgatgctgcaagaaaagcccgcattgcgctgatgataggcggtatggttgagactaggatcgctatgggctttgctggtcatcttgcagctggtcttggttgtttcaggtttgtgtgataattatataatcattttttttccagccaaagacattgccaccagtatgattaaaatgaaaaaaaaaatgtcacattttcctgggtttctagaccttacttctgtcaaaatagccactgatgttttcccccctcttgtgaattcagttttgttgacctggacacacctcttttactgtctgaagatccagtgttcggtggctatgaaggtacaaaaacattttatttcaatctcctttgtacaatgttcgatggttaagtgaaaaaaactgttgaatgtagttcatatgacttactcaactaaacttctttcatcagtttctggacctgtatacaagtttacaaatgctcgaggccatggtggtttccttcacttagacaacaacggcttggtaagaagcatttcactcttgctgtttaagttaaatcttcatgtcctgcaatagcattgtttctagtatccaaatgtaataaaatgaagaaaacagtttttccttcaaaagcatgaacgaaacagtttggaaccaaattataatcaaatttacctatcaaacatggtaacaaccagaggcacctattcagattgaccagtataaaatggtgttcttattttaatgcaaatggtctcctcagtgactaaaaagatgtataactgattggtatatcattttattttacagaaataaggaatgccctagccctttgggagcttcacagacaacggtgacacgttcaatgaacaattaattgttcattatttaccttcaacaataatcaattggagttgaaaccaaaggagcagttgtaaacttgtaatcctatatgaccttgaagaggctaattattgttgccagtccagttaggcctgaaatatttgatcagtctgtagatggataaaataatgaggcattttcagctggccttgttgttctgttcgataaataaattactaaatatggtataaaagaccttatgtatgcagcctcaaatatgctcaagtacaatgtattatgcttacttttggtgttacctgcttcagtgctactcatacttgacaagttgctgccgccgcctagctcccttgccaccgtcgccctgctgccgctcgtcgccgtgcgcccccctgctgccgtcaagaagacatgggaggagagagtggtaaagaaggaagagaccgaggagagtatgacaagtgggcctcactttattttttttaattttttttatgactgagatgacacatgggcatcacgttagcgaattggacagtcaaaatatccggtattgtgattgacagatacgaatcagatgagacctataatttaaggtactaagagtggacttattttccacaattgacagccatccatgtttatgtgacctgattaggcctgcgccatctctccggaagagagctcaaacggcccgtcatgtcatccgatctctctccatatacagttgggcgggaaaggggaagcggagtacgtctggcactccggcctataatgttgggcccaactgacggcgagcctccggggagcggcccaatcaattattcataatccggctggacattgcacgagacagcctcagttttatgcgattaaactttgaccttaggtctgtactgatgtacatgaatccaattagcccggagccccggacacagaaatttgatctcaaatttgttcttacatagcagaggagcaattcttcttcttcctcctgtctactgaggcagctgggaagatcagcctgaagtggttcatttggacaggtattgcggccgtggtgtcacccactgtgtgcttcctccagaaaacctgggtgctagaagcggttctcctcttacacctttgtttcttttgccacttcccgattgaccaagaaggtgtccacggccgagatttgatttgtttttttgtctagttcttgtaatcgtttttgcttttgctgtactcctctactcgtctcttgtttgtttggaccataaaaatctgtggatcagaatggcacattgacacctcaataacgaaaacgaccaacatatatccagttcttattatcttcttccctttcagttcaggaagatgacgttaagtcagtgagctgctcctgcagatgcattgcacttagacagacgcgaagtcaaacaagcatgagcaaatgaagaacagaaacacgataatattatctcgtaaacatttgcattaacatttgataatatcaatcatgtcgtcatgagaatgatcaaacaaacaaacaagcaggagcacacagcatggtgtgatggagagcgaggcaagagagattcatggagcgggagcagcggagtgcagcttcctgtcgagcacctcggagcagatggtccccatgatgtggtagaaggaggcgaggtcggagagctggtcgatggacatcttcgccatgagcgccctcgccgccgcctcccgctcctcgttcagcttcagccggttgatgtaccccgacgcgttcctcaccgtcgcgcccatctgcttcagccgcttctcctgctgcacgctcagcgccgccgtgttcgactgctgcaccacacacaccacgccacggcggttagctttgaagtccggcggctggcatccgtgcgcgccggtggaggtgcggtggttgggctgggtttttacctcgaggaactcggcgccggcgtcgaggtcgcgctgctcggccggccgcggcgtgccagcttcggcgccggagacgtacaggttcttggcgagcgagaagctccggacgagcaccttgcgctgcttctccatctcctggttcagcttcggcgaggcgggcatggcggcggcggcggcggccagcttctcctggtacgcgacgacggcgcggacgaacgcctggtaggccatggggcagcccgggtagtcgaactcgtcggagccggccttccgcatgcgctccgggtggaactggagccccatgatgaacttgccctcgccggggttgtacgcgtcggggtcgtagaacccctcgacgaggccgtccggcgcgaacgccatgggcacgaaccgctccgccagccgccgcacgccctggtggtggtagctgttcaccgtcagccggctgtcctcgccgtcgagcgactccgcgaaccactcgtgcagcggcgtgccggggaggacgcgcaccgggtggcggtgcccgtcgtagttgtcgtagttgatgtggcgaacggcggcggcggcggcggggagctcgtggtcgacgtcctggtagagcgtgccgccgcaggcgacgttgagcacctgcgagccgcggcagatgccaaggaaggggatgttgcgctcgagccagcggcgcgcgaggcggagctcgatgaagtccttctcgtggtcgatgccggcgtcgctcgggtgaaggctccgcacagcgtcgagctgctccgccgagagcccccccgaccccgcaccgccgccgccgtacagcgacgggtcgacgtcctcgccctcgcacagcagcacgccatggatgggctcgaacgagtcgagcagcgtgtgcacgccggcgacccgcggcacgatcaccggcactgcgccgtatcccacgatgaggtcgaggtggtactcccctgcgaacatgcatgcgccatgcagcgcatttcagccaacgtcctaaccaacaaaaaaagaaaaatccatggaggaggaggaggaggagatgacgagagctcaccgacgaagtcgacgaacttgttcttgcggacggtgcggcgggagacgatgagcacgcgggggaggatccgggcgagatcaggggagggagacatcgccgctcggctcgacgaacacctgctgctacttaatctctgcaagaaatcaaccgatgatttcaaggcgattactcgagaggattaatcgatcgattgatcgtgtgttgttgatttgctcggatttgggagggctcaggggtggggtgaggtatttatagaaggtaatcaatcggaattgcagcttggattactagacggaatcgatcttatcaccgaattaatttaatcttttttgctttgatgaagcggatgcgcatgtgagtgcgagagctagtgcgactatgtctgggcgccgcgttacagctaccaaggtcaaaggggcaaatgactggaaattgctacatgtccccaagagatgtctatgccttgtcggactgatttcatcagtactagtactggctatgctaatccagcagtactattaaatttctatttaattgtgatgaaactatataattcggattatctttttgtagctataatccacaaatataattgctccgtttaatattacaagtacttatagctggtttggcgtctccttttaatattgtataagtctaacttcattacaaactttgctccagtagtcgctcaccggaaaagaggatgaacttattagagttagagactttgagaagaagatggccgggacatgaatctcccatatcaaattgatacatatactaaaatccgactaaatttcactaaaatgttgaaaaacaagcaaacaacttgtgaggatgttattagttgggatatatatacaaaatacacacaataatttctttagttctaggataaacggtgaatattgcataaatcaaagttgaactaatcatcacaactatgagggaaaaaatggtcgaggagattaagtgattaaatcgtttgcaatccgtgacaaccctgaaagggacatgttaaactagtgctggatgccatcatggaaacaagataaacgtgtgctaggacatacaagctaacaaaagaataaaaggaaccatatggtttttaataaatatgctacatcattttatctctgtggatattatggatttttttaggtccataattcacaacaatagaagtaacaacccatatcatatgccccgatgcttgtctattgatgtggcaactatctctttgctttggttgattatcctagttattctgtactacgctgaacacaaatacatgatggtttttatgtgggcgtttattcattgagttctctatgatttggttcatttatagatctactgctcggtgacccttgacattctattgggcttattggctcacctttgatagattcaaatgctagctctttgtcccaagggttttatagtctgcattgctagcttatatgtgttttatctttgcactagaaaaatttctaggtacacctcttgttttgacccgttatcaatgtattttaagcgaagttaaatattaatatatgcactagtgaactatatctcaaccaattgacaacaaatttatggagggaacttttaagtgtgccacataaccgaaaatatgggtaagaagatatttaaggaagaaattgctagagctcaaatttaaatattgtaaactaatatacaacctcttgttaaacaaaacaaattaaattgtgcatggagtatggcgtcagcaatatatnnnnnnnnnnnnnnnnnnnnnccatgcaatttgccgatttaaaatttcagtagtaagtggccggataactgttggaccaaaattcggatatacaacgtgtatgtacttgataagcatactcatctctaagtagaagatcagcatatgcctattagcaagaagcatgtactactgtcttgggtttgattgtgacaattagttgcgttgtttatgtaaaatttgacaaattctgcgatatgattactagtactactccagtaggtttgacctctaggaatgggaatggagtactcagtgccgacgtgtttggtggttatccaagggaggctgatgcggccagtgacaagcgtctgatgtgtcggtctgagtgcgtgtgcgtttaaatagccctaataaaattagaaccatttcatacacgtttatttattttgccacgttaatttacacggacaatagtgatcactagtgacgtgattataaatatattattcgtctatctgcaagactatgggagaatagactcgagtgaccggtcattttattctacaggaatgaacggcgtgcacagcttataattaaataaagactaaatctttctatcaggttaaaccttctcttctaggataaactaaagaaattgaagagcatttgtaaacatatgcaagcatggggcacgccaaactcatattaagctcgaaaagatactcgcttgtcttttatagtagctgattggttaggtccagtagagtacagagactagcagctgtgtacacagtgcatagggaacgcgatttcggccagcccatgcgatgcacgcttgagactcgcgctgcccatacattgtgtttgtggcttcattcggagatcgcacgtatgagtggagtattctattttaaaataaacaaatttatagcgtatcataataaaaaaaatctacgtctagaattgtagcactaatatttgtttattttgaaacgggagagaaaatcagtgcggatggatgcagtgttacagagtgggggtgtgtcaggtgatctatggggaggcggggatgcatggaagcatcgggtgctgcaaagtgcgaatccaacgacgaactacgggcagatcggtcacgtacacgatagatgcagatgcaggtggtatctggggtgctctgaactgccgcctgccggcggcttggcttgccgcgtcgcgagccgaccggttgccatccaggggaggtgactcctggacttggacgctccaaatcatttggagcacgcactcctgtctctgtctgcttgcctgaatcctcacttgctcagtgcagaactgcagaccacaaattttaacaatgcgatcttttctgaaaactaattttacaaatgaaccgtggccaaaacttattttaaaaatgaccatttttttcagcgccaaatcgtatggcgctgaacttagacacctcagcgccaaatagccggcgctgacattggcacgccgactcagcttctcatccgcgatgacacgacattcagcaccagttgacgtggcgctgaggtgtctaaattcagcgtctctgaaataagttttggctacggtttatttataaaattagttttcgaaaatggttgaattgtcataatttgtgcagtgcagacagtggctcactagtcactactcaccggagaagtcacctacctacctcctcttcttctaccagaagagccattctttttctagcaagatcactacctaatgctgaatattctaggattgatcatggttcatggaccagtttttaccacctgcaaaattcagagttaacacagcccaaaggggccatcaactctgatgcacctgagaagccggagaacggaagaagtgaaccccccaaaaaagaaaaaaaacatttcgtcctaattgtgtttgttctcaaaatcagctgtgatatgtcggttgattttgagaatcccagcatttcctaatcaaacaaaacacaacaatgtatatatgatcctcgtttcagtttctttaagttcgagtctacgaacaagtagtaatgaagactgtgctgaatcatggatccacaggaacagagctagtagcaatgtgcacatcgtgcagcgcgttggagtctgaagagcccattgggcgtcaccggtgacgccatttctcaacaaacaaaagctttgcttcaacttctgtaaccatcatgcaactgcgcacaacaacaaccgtcctggaaagggttaattatcgagttttttttagagtaccttcacgtgttcacagaatcacactaatcgttgtacgctttatttctaaatgctacggccgatttcgctctgtcactcgcaagttcgaagcggcacagaagtacacagctgcttgtgtgttttctgaattctggtaaaaaaaatttcttatatatacagtacattattggctgaacctgtttagatgggactaaagctttcaagtccctatcacatcggtttggacactaattataaatattaaacatatactattaataaaacccatccataaacttggactaactcgcaggacgaatctattgagcctaattaatccatgattagcctatgtgatgctacagtaaataatctctagttatggattaattaggcttaaaaaatttgtctcgcgaattagcttttatttatgtaattagttttataagtagtctatatttaatactctaaattagtatctaaatacagagattaaattaagtccatggatccaaacaatatcttaagcttttgctgaaaccattgcaggaacaaaacaaaaacatcatgcagacatttaccctatgtgatccaactatccaagtacattctgaaccctgacaatctacaaactgaacgagacagaaaaaaaaaagcagagaactgctccgcattctcgggctgcatcgatgggctgtgtttagttcgcgaaaagaaatttttcaggtgtcacattggatgtttaaccggatgttagaaagggttttcaaacacaaatgaaaaaactaatttcataactcgcctggaaaccgcaagacaaatttttttaacctaattaagccgtaattagtacatgtgagttactgtagcatttatggttaatcatgaaatgattagtctcaaaagattcgtctcgtgattagtttttgtttttacctatatttaatactttatgcatgtgtcaaaaatttgatgtgatgtttttgggaaaaagattttgggaactaaaccgggtctcaatggagatcactaaactgaagcaggtgatcaccgttgagtcatcttctgtacacgacgcggcaaccttgagcctgtacgatgggaggcacatcgccgtcgtcacggggacgccgcgctatcgcggatcgccgctgttgcctttttggctcctgggtttcgccgcctgagaaagatcagtttcaacgtcacgtcacgcgtcacggctcaagcatcagcaggaaagcaactgaagaaagcaagtgtagcttcttcagagattttctgaagtttttgtgcacgtgcgagctgcgtggagagaggatgatgtgtgaggaagcagcctgcagccgtccagatcacgcagtgttggtcctgtcgaaatcctgtatattggatagtacctgcaaatcatcatcagacgtttacagttctgcaatttagcatcagaagctttaaacttttgagctagtctcagtgatcattatctgaagaagacgactcctaaacatcattcaacacaagtacctccaacagtagaggttagcttattcttttttctttcttaaaaaaaaaacatagccgattccattttaattatatgattccgaagattttcttgatgtgggaagcgcgtgggacgcggtggagaataggcggaagcgagattaatctgataccatgaaagcgtaggtgagtaagcccgataattagattgattatagacatgactacatatagggacggtacattcttatatctataaccaacttataaaaacagaattgggatatgattaaaccgaaccggatacaatacaatatatctctaacagtgagcagtaaagacaccagtgcagatgaacgatattgggccgccacatggcccatggctgcggcccatacggtaatcccagccgcctgcgtcaccttctgaatcgtagccgcacgcgcgccaccatccaacggttgccttggacccagcaggggtcggagaatttccccaaacggctcgtccccctcctccccgtcaccgtcaccgtcaccgtctcgtctccgtctccgccgctcgtcgtcgacccttcgtcgagccgccgccgccgccgccgatccttctcctcccacctcgcccgcgccgatggagcagctcaacgccaagctctacgacaagtacaccgccctcaaggtatacataccgcctcgtctcttcccccattctgtaaccctacccatggacacggatttgatttcttctcaatacgtttcgcactgccgctcttgatgcgcgtagaagcggaagctgctcgacgaggggctggaccagaagcgggctgccgacatcaaggagctccagcaaggtaaaccgaggaggcggatgtatttcgtcggtttttcgaagggaggagggtttaagacctgggagggagagaaatgcacatcttttggaattgggaggaatttctgttaggttgttgacttcgctccgttttgttgtttctgatgatgcagccatgaaagattgggtcgccgacctccagggcgagaacgagcgcctcattgccaagctgtaagattcaaatgctgctcctgcggcgatagggtttcacgcgttcgtgctgttttgggcttccgctgtttcggggaaatgatgcctgatccgttgctttctcttcttttgttaatttcttgatgatgccaggacccaaaaggagcagcagcttgtggaggtccagacacttttgctcgatgagactaggaagagtaagaattctttttgctaagattataattttataaggaaatggttggtagtatgcaagtataaagtataaaccatgattgggtggaggtggaactgatgtgcgtctttggaaatggagggaaacaatctgttgctgattgaaagcactatttggtctgagttctgtcttccatttactttggtattaatgaagttgacttaattcaattttgtttacaaaacatgcagcaaaggagctcaatagtgaaatattgaagcttcagtgtctcctggctgagaagaatgatgcaaaccatatagctacagggtctcctgacacaaccgctgaaatgattatagaaaatcaaactccaattccacctgcaaagaagacaccaaagtcaaagagcagggagagaaatatccacttcattgaaaaagcgactgttccttgtaatggctttcaggaggaaggaagagatgtaagttttccgtaacaggaactacttattagtgaagtacaagtatgcaatagaatgagtgtgttgagctcttctaatttctgtttatgatttggattggttttgtagcttgattcctgtagaaggcatatgagcatctcaggttagtggtaatatacacacatgcagtagtgaattgtttgaacttaaaagtatgttgtttgcagggagtgcgacagaagaaagctccagtacctgtatgtttcatatgctggctgaatcagtagttgggatgaaattttcagtgaagaaccaaacagaaggattttcactttcagtctcccatgaagctagtggtatttggaacatcaaattttatgctattattttagccacagcatagtactggaatatctcatcatagttattattcatcatgttttacttgtgttcatttctctttcacattcatttgattttgcatatagccacctccatgtttgccaagctagctgagtattcaagcaaacagttatgcaaagaacaatcttcaacctgaaaaatgtcctttaaaccaccagaagagttgtgtgaatacatattttaatgctttaatatctttgtcaagcatgtacacatctctttggagcttagccgtttgtagcagaacttgtataccagcatacagtgtagttacatgttgggtgcagaacctgaggatcatgtcaccaatgttagaacatttgatttgtaaagatcataatcaagtgtaaggaacgaattacatttctaactgaattttttaaactgttgtaggctacagtttcaccctgacatgggtagaccaacctggtggcggtgaatggtcatatcagtactcgtcgttgggcaccctggacaggattgctatgggctggatgaaggaggacataaaattcagcagggccatgtgtcctgtattctttcagcagatatcgcgcatcctcagacaaggctaagctcaactgggaagcttagtttggattttagaggtcctgacttttgctagacagtggactgaaactgacttgttttaggagtgacacgaggctttatgtatcctttcgtttggcctttgttgttcctgttgtgaacataacaattagcaagtgattcgagatgttggtcgcctggttgccgtatgtctttatgtatagcccctgatttgaactctgatggttctgaaaataagagcttcgacattgctgtccaatatatcatactcggtgtgaattttgaatgggtgcctgtggaaaatgattcggaatacaaactttgcgtatgagagtaagacgtccaaattgttactgaacccttcaagaatttaaccaagcaaggagtcgtttgggcaggtaatgaggatttcacgtaggcaagtgccaggtcaactggcctaaggtctggtcccccattcggttcggtatggtggccttagagttaccgacttaagaataatttattagagccttacgtctgagatggctagggtttgaataaagagcaccaaacaaaccttggatcggaactgaaacaccctatgatgaattggataaggacttgtttgtggtgtcgactaaattccttattggtgatgggcgaaaggcgagattatgggaatcaaattggattggtggccaaagcctaaagagcctggcgtcaaacctctatcggcactccaagaggaagaactgcactgtccaagatacaatgcaacaaggaagatggatcaatgacatccgccataccctcaccgtgaccctttttacatagtatctgcgaatttgggtggtcctagcacgtgaacccccccccccccccactaacggagggtgtgaaggactcaattgtccagaaatggacacccaatatggaatataacggaaaatccgcctaccatttccacggcaaagctgacttgggaggtgggaggtgtgggctccagcaaaatgtaagatcttcagctagctcgcactgcaaaaccgggtgtagacagcagaccggttgcaactcaggggatggccaaataactattatttttcagctttgcttcagaacaattgaccatctgttgtttgaatgtccaatctcgaagtaaatatggtttggcatcctaaaatggctacgacaagggcacatcatcctgaggtggaacaccagcatagactgttggattggtgactacaagggacaagcctcccggaggaaacaaaacaaaaagggtttatcagcgtattttgctgaaggttcagtattttgctgaagtaactatgaacacaatgccaaccatatctgttgtttttttagtagaaaggcatgagttctgtctctcttttttttatattaagaagggaagcaagcggtacagagttcagtcaaatttctcaacaaacaaaactttgcttcaacttctttaaccatcatgcaactgtgcacaacacaaccatcatggaaaggattaattatcacgagttcacagaatcacactgatcttcgtacacttgtattccaaatgctacgatggacttcgttgttgtctgtcactcacaagttagaagcagtacaacagaagtacacagctgcttgagtgttactcgtatctgagttttggtacaacaaaatatcacgtttaaacataaacactagaccagctggcataaaagaaaacacatttttaattgtcttctaattctatatacattcttggttaatctttctctgaaaccattactggaaaacaaaaacaggatgcacgctttgtgatccaactatccgagtacagtctgaaccctgacaatatacgaactgaatgagacacacaaaaaaaaaaaaaaagaacacagagaacttctctgcactctcaggttggcaggcgatctccatcgactcatcatcttctggacacgacgcggcgagcggcgaagaagcggtgatccgggtggtgaactccgaggaggccgagccaggcgtcggcggcgtgcgagagggaggcgaccagctgcctgtctcgcccgcccggtgcccacgccgcgaccttgagtctgtacgacgccatggcgaacgtcgggaggcacatcgccgtcgtcacggggacgccgctgttgttgccttttggctccgggcagatgccgcctgaaagatcagtttcaacgtcatgtgtcacaggctcaaagcgtacagcaacccaaggaaagatggtccagttgttcggtgttttttctgtgaagtgtttgtgcacctgtgagctgcgtggagaggggatgatatgtgaggaagcaggcgtccagatcgcatagtgttggtcccgtcggaattcggtatattggatacctgcagcgatcatcaggaacgaagaattcagagtcaaatattttactccagttagtctgaactctgaatggtaaacattattcaacacaaggacagtattctgctagtaccatgcgacggacatccaactggttggcgacaaatcacagctcctgagagtattcagctccggaaatcccctggcaagactacaaatctgcacgagttttttgattcagaggagtgacaaaaacacagtcattttcatcagggagaaacgataagagttcttggagtaattgttggcatgccttgtcagctagcggttcacgctggtagggaggctcggattccagaaactcgaagatgagctgctcgtgggaaattctcgttgattcgctttcgtcgctcgatgcttcgctggtggaggtttcgcaggtggtatcttggactgagaacgcatccgtgctgcttggacatgagtcgtgctcaaggtcgctcatctcttcactgcctgtgtcttgacagtagtcgccgtcgctgtcttctccacttggcctacgattggattgaacaaacaccatatcagaaacaacactagggattaacataagctgattccgttttagtgatcctcaggttaaccctctctcctactctcctatctgtttctgttagttatctgtacccgtacggtgctcccagcagttgcgtgactgcgtcagcttgaatcgtagccgcacgcgcgcctccatccaacggttgccttggatccagtgggaacaaaattgcatatactaacagtaaccgctccttggattacatttgtgatttgtatacgatgaattggagacgtattgtaatcactatgggttttgccttcctaatgaagtttcttaagtgcattcaggatacgaactttgcgtatgagaaatccaaattgttactgaagatagtgcagcctcaatggagaagtgtagaaacagagatagggacctatagtaactcgtactactgaatactgattggccctgacactttaagtcaatgctcgcaaactcactcttcagagttcagatggctttacaagacttgttttgtctttatgttcctctctcttttttttgagaattctttatgttcctttctcctgatgcaatggtcacttaagcacctaaaattcattttattttcctgtcctctcataggagacgcaaaatgtaggagtacttctcaaggaatgtattggcaaatgtacttgttctgtaattctgtaattatgaactacattacaacctgaagtgttgttctatttctaaggttgagcattgtgctgaagtaactatgaacacaatgccaccatagctaataaaccatttgtcttaagaacatctacaagaagtgattcaacggtgatttgaggatgtattacctggaatggtagaaatgcctccttaatcttccataaagctggattgcagataagtaagggacgtaatactgcaccacaccgtcactgcaaccattcagaacaattggcacagcgataccatatgcgctgctctctctgaacccatcccagaggtcgcccaaactgaagaatggcagcgcattttcttcatcagattgcttccaaccattcatgctcttctgcaaagataaccatacgaattttttcatgtcacagaagctgaaaagaacctctacttagtcagaaattgttaccgaaatgaattaaggcagttgttttctgtttcttcttagtcagaaattgagttatagaaacaaaaatgaaaaaaaaaacaacatctgttttggaacatacataattccgtattagcagtgaggcaactaatactcttgaaagatcatcttggatagtagtatcagaattcagaaatgggggaaatcaggaaatgcaacagatcgatgcatgggatgaaaagcgtatcaccttggaggagcaggctgtcgtcgggacaaccggcgtggtggcctcgaggaacagctccagattacaccgtctcgccgtcgccggagcgccggcggcggcaaacctccggccacaattcgccatcagctcagcgccctgtgttctgctaatctgttgaattggagctcgaaagcaatacgcgattccgattcagttgcttgtttggtggatggcataggccatagggaggtttagtggagtttaattgagaagaccatataaagcaggtaacggctacgctattaataagctgccgttttggcttccttccagaagtgcgttgaaggtgccgacgcgtggttgaggatggacacgtgtagggctgggatggggttggcaggtcatgagaacgatgggtggaccggccttaatttgggcggtgggagctggctgggcacccatggacggtgtcgtttatggggcaagtgacgcgtaattaattaagccggtgatgctccatcagcggagtccttggccggccggcgccactagctactactactagctacgtcacctcgtacaacttcgtcacgagacgagacgacttcacctagatttttatgggccgtgcgttgcactgcacgaggcggattagccggg

SEQ ID NO: 910 - DNA, 23655 bp, Oryza sativa
  unsure (1)..(23655): unsure at all n locations
ttgtcgacgatctgctcgactgctcgtcttgctacctcgctttcgtctccgttagacctggccctgtgatggtactaggctggtagcaacacagtcaacacgtcgggcaatgtcgaagtaacgcaggctatgctgctgttaagtcatggtctcatggagcagtggagtgctgaaccagctgatccacgagctgatgtatttgggccgtacagtccgtgatagcccaagcagaaaacaacggcctgcctgcctctaaagatgggtctttctctatccaaaaacggaggcccagctattgtccgtctggcaggccggatgtaaccggcctcctttgcagccccgctttggatggatgccacgtggaaaccccagccatcgaacggatcgctcgtctcggcccaaagcgcagcactaggagagcgtaggctcggctcgagggcacacgctgattctcctttcaggctccctatcggctcgatcgattcgagacgcggagaattttcgacatagcctggcgactctaatcctccgatccggcgccgacggcgtccctgagactgacgtatccataatccatgggagcacctcagaaccacagcggacgtgccgagctccgcagctgccaggtgaccaacacgcggcgaggaataagaatttgttggtgttcctaattaatttggatccagatggaattcttgaagatttgtttctggagcttgaaacgttctgattccagcagctggtggtggtgcatagccgacggccacttcatcacgatccgagaacaatcgatatgatgcgtagcaaacaagatagatcgattgattcataaattggagaagaaccggaatccggcgtcatcgccggaatcagccgtagtcgccgatgtctcggggttcgtccgcgacggccgccaccccgatcggcacaggcgccggttcgtcggcgtcggccacgaaaacgagaagacggctgcgcggagccgacgatgaacctaaaagccgcgtcggactctgagccgagcctacgccctggccgtgctagggcctgggggtggagctgagtcgagcgatccgttcgatcgttggggtttgcacgtggcatacatccagagaggggctgcaaaggaggccggttacatccggtctccaccaaatttttttccgtggaacattcgtcaagcacaagttaaactaaaactgaataggagtagtacatgatttccacagaaaaccataagagaacgaattaatgattcaaacagtaataacgtctaattttgttgttcttgctaatctgctctacatacaaaaccaaagctcccactctggttttctttaatttacagtctactagccagttgtctgcttcaagtatagtcattccatcgccacttttcacgctgtgcttcccggtgttgataaccttgatctgctcgacaaaaacgcatatcgatcttcgtcagcgattgatcatatggaattcagcgttatcagaaaaaaaaaaaacagagtgatcagcaactgatcaacacgacactgaccgctgcgtgaaatccgaggcagaggaggggtagctcgacggccgcgacggggacgacgagttcgagtggtacggccgcggcggcatggcgagctcgtggacgcttctctccagcatctccagcaccttgcccatcgacggcctgttcgccggcacggtctgtatgcaccacagcccgatcagcgccatcttcctcgcgatctcctcgcctcccggtgatccggcgccgccgccggccgtggcggcggcggcggcggcgacgctctgcagcacgccgccgtcctcgagcaggtggtcgtagacccagagcgggaagaacgtgccgctggcgcccttctcggcgtaggccttgacgttgctcccgccgccgaccatctccagcagcagcatcccgtagctgtacacgtcggacttggtcgagatgtcgccgaacccgcgggagaacacctccggcgcgatgaaccctatcgtccccctcgtgtccgccatcgacaggatgctctcctttgggttgcacagcttcgccatcccgaagtcggcgatcttgggccggaatccctcgtcgaggagcacgttgtgcggcttgatgtcgaagtggatgatccgcgtgttgcacccgtcgtgcaggtactccagcccccgcgccacgccgacggcgatctcctgcagcaccttccaccccagaacatccctgtcagggctcgccgtcgccttcgncttcttcgncttcgnncgcgncgncgncgacgtngagtagatgtacttgtccagcgagccattgggcatgtactcgtagacgagggctcgtttggagccctcgaggcagaaaccgagcaggaagacgatgttgacatggctcgtcccgccaatgctgaccacctcgttgaggaactcctcgccgttgggcttgaagtggtgaaggaacttgacggcgacggcgcggcggtcggcgagcgtaccgctgaacaccgtgccgtagccgccctcgccgagccgctggctgaaggacttcgttatcttcttcagctccgagtacctgaacctccggggagctagggatccgtaactctgcagcagcttctccacctttgcagtatccgttctgcttgcaccgtccatggcgttcagaaaactgaaacgattttgcatacgtcggcgacacttgtagacgatggcgatgcatgccaatagcaccaacccagtcgcacagatcgacagtgacactgaaagcgacgaagcaaacaattagtatagattagtaattactaccaagtggtaaatttatctagataattgatcatgacatcattattgaagaaacaattgatcatcatgacatatacgaagaataaaaacaagttgaattatattattttgttggattagttaagcaagaattgaagactgaagcggatgcatacctatcaggatgaccttgttcccggacttctttgcatctgaaagggaagaatcatttcattttagtcaacatatgtacaaaatatcgccagtctattccaaccaattgaaatacattgaacgagcattaatttatttccgagattaatcaaagaaacagttcctgatcaaagactaattgttccacacacagttgcgtcattgatttcctgatgactaattgaaactggttggaccaattaaggtgtctgaactattacttaggaacaattcagacaacagatatcatcgtaaatttgtacatatgtacgacgttgctttattcgaagtatttgtacagtggacagagaccaacatgtatctgacctaaccagctacaggagagtgcagcaacagccgccgcgagcagcaacatatctcgtttgattcagacatgatgaacaaaatgatcaaaataatcagatgaaatcaaacaaaatcgtctcttttcggacacaaaagttagttttagttgaccattttgctcctatcattgtgatttcaaagtcaaagtcgataagtaagcactaacaactaaccaaccacacgtgctggctgtatacgtattctacatgtaaacgttgctgagatcggagaacgtgaaattccggctacttgtagctaaagtatagcttcacagatcacactggggcttatgtggagtccattattggttctcggcaaaagattgtttcatacgatgagatcgtgacagccaccatatgttgattcagtaatttaattagtccaagcccgtgcaaaaagtcattccagttctattgtacttccactattgctagtcctatcaagagccttgtcctgaaagtacacttcacctaattaaaacatgcataaagagatcacctttttttcagttccagaatcacaatctacacttttttttcttattaaaaaagagcaattttacggtccttgagaaggtaccatgaggtaccactttttgtattgtaaatttagtacctcttggtacctagatactatgaggtgccaaattttacactaaattttcggtacctcatggtacctcttcaagaaccataaaattgctcatcagaaaaagggagcatcattaggaaattttaaagaattttggataacgtgaacggtcaccgattgacaaccattgttagattgttaccctccatataaatcacgttcaaaagtcaaaatagcttaatctacttacttccttttgtcagttctaaccaccctggtttttggcacgaccacgcaaatacgaactactactacatgttcgttgatcctaactactgcttgtgctgatcaatcaataaatagttaatttgaattttaatactctcaagtctctaactaatttaatttgagtaatagttatgtatttcccaataatcaaattcagggaaaaaaactgaacgaatttagcacaaagaacagatagatttacacttaccacatatccccgggcgcgatgagccgtcggagcagatgcaggcgaacgcctccgtgtcggcgtcgtagccacactggccgccgctggcattgcacgccatgcagtcgccggcgggcgccctccactccagcatgtagcctccccggagcagctgcgggtagtccgtcgggctcgcccccggcacgccgaccaccggaacggccgcgtagtcgcagcctccggcgaccactctggcggcggtgttgttgtagctcgtgtcgagccggaccacggccttcgctcccgggcacgtgacgttgacgaaccctgccggcggcggcctgctgctgctggtgcagttgaagaggaagacgagctggctgttggccgggctggcggtgaacggcgcgagggtgaggctggcggagacgtcgatcttgggcaccgggcagccgctggcgtcggtctggacgttgtcgttggcgacgacgacggtgcggttggcgtacgacacgccgaggatcttgtacccgctgcggaaggagcgggccagcgacgcgcggctgccgttgtcgcagttcacctggaacgccgcggggccgcacggcgcggacgacgacgacggcggcggcgatgagtccggcagccagaacgggtaggcgatggtcacgttcccgcacctcctcggcgcgcagctcgtgacggccgcctccgccgcgtgccgcggcgcgagcagacatgccgccaggaagggaagcagcagcagcaatggcgtgtccatcgcgacgacggttggtggcgcgatgcggcgaggaagaggcgttgtattataggcgaagcgatcgatggatggatcgaggagacgaggaattttacatgtgtgtagttgacttggtttcgtgcaccacttgcgtcatttgcttggtcactttcttggaccattctctcttcttctggagtagtacggagtatgaaacgaaacgaagatcggtaaggagagttcgttggggttggcagttgccactgctcatattaatctgcatgcgagttaaagttaaaccgcgattggtgcatattatagtacgtgctgattacgtcagcacgcagtgtttggtgagtgtgcaccttcgttgataccagcgtacggaacttcaaaatatttcaaatgcaagttggataaagaaaagcgcagaggaatgcaggtacttgtctcactgggccgttagctgaagagggccagaataggctttacagcccaaactatgggcctaaattctgacccatcacatagtacgggccagaattttgtgatgcgtccgtgcagcccttgttcggttgttcccttctccccggcgccgccgcggcgtcgccgtcggcggcggtgcaaccgtgcaggattgcggccgctgccgtctcgcttcgtgagccgcagcagtaaacgccagctgctcggccgtaggcattgagggagtcgccgaacaacgctagtgttctcctccgctgcgttggtggcggtggtgactggttagggcggcggattggggatggattacaaacacaagcaacggggagccggggagatgggcatcctgtcctgtactttctgcgttgggcgaggcatagatcgagcagatgaactcatcaaaagttcgaaggctgagtagaggtgcccgctgcttcttcgtttcttcagaggaaccgtggaggaatccagtaagtaacttgctctttgctcttttgcgtactacttttccgtgaaaattttggcactatgatgatgctagtttttgagcccatagatcaaactagggaagtgggaaaatgtgataattattggcacggaatcgtaaatcgtagcttctggtagatcaaattgttgaattaaattatgaaacaagttagggggatggacagaattcagaaatatcttcgattcagctaccttaaacacactagtcaatgccatgacccatgaatgtgtgatgatactatgccaaaatttgactgcagatcatctttttgcatagttggtagtcactgtaggatcctttgaattaacgaggcttgtctcctcaacccttagcacttcacttagagcttgtgcagctttggtatttatagtagaactcgtactttctgtgttaatctcctgagctggatgttctctgaaaaacagaaatagcatagatgaaattcactgaaaatattaccagtccaaatcataatgtgtagagaaagtatcttacagtaattcactgaaattttgttttggtggcatttccagttcatccaaacttctctcgaacatatctaaaacctgggttattgtcggccgatgcataggcaatacttgtacacaccacaaaccaattaaagtcatctttttggctatttgctcaacctcacttgtgacttcacaagcttgtaatccatcatccagagcaaagtggtcataaatccaatctggaaaatacttttcacttgaattttcaaccattgacttagcattcttccggcctccgaccatctctagcaacatcattccgtaactataaacatctgactttgttgaaacaattccaaaggatcgatagatcacttcaggagcgataaatccaattgttcctctagcacctgtcattgaaagcttgctctccttggtgcggcacagtttggctaaaccaaaatcagcaatctttgggcaaaaatcctggtctagaaggatattctgaggctttatatcgaaatggatgattcgtgtgttacaactatggtgcaagtattctagcccacgagcaatcccgattgcgattccgtaaagtttttcccaccctagaatttctttgggattttctgaatagatataatcgtctagtgaaccattgggcatgtactcgtaaagaagagctcgttttgacccctccaaacaaaacccaaataagctaacaatattaatatgagaggtcctgccaatgctcataacctcattcacaaattcctctccatttccttttgagtcatgtaagaatttcaccgcaaccagacgaccatcttgtaaccttcctttgaatacaacaccataacctccttctccaagcttataattaagaaatgatgttatctttgttacttctgaatacttgtatcttgttggagctattgatccataagatattatgagggcctcaatgttcctttcactggtgctgctagtctttgtgtaaaggaaataccgtagttgtttccccttcccatgccatattagcacatatatacatggcaagagcaagcctgcagctgctgctgtcaaaactgagattaaaacacatgttatttccttttacaaaatcataatggtatactacgaccatttattttgcgatatcattggcttttcctattaaggatattatttccttaagtttttattttgttattatggtttatgattcaatggtattgtggtaaatgtttttgacatacctattaatatggttctcctgccagttttcttgctgcctgaaacaacagattttatcagcaaaagtaatgtcaagagtagaatatttgatgttgtctcaaaacaaatgaagcatcacgtttgaagttcaatattctttagatgatgcctgatttgttgattgtgttggctggagaataatcacagttacggttagctagaataccaagtattttttttccttcaaatctatatgataaagatagttaattagaagaaaggtatgtgccatgatcccagccgtagaagtaaaagaacggctcagattcggccaaatccactcggtggagttggccccagcttcaggggatctgaacccttctggccagatgattcttgtaatttcgtatctcaccttgttggtactgactctatagctgagtaatatacctctcttttcccacaaaaaaaaagtagtatattagtatattttcctcagcaacagtggggtgcgtttccttggtgttgattgccacttcaagatttctggcctaatttgccggctggcatctgtaaaatattgacttatgtgtagatttgcgcgatttctggctacggagaaggacaaacttctatgactgggtcgtctacgtgactacgttcaaagtcctctcgcactttgcagtcgtctctatgtagattatagcatatattgaccgggacgtgatatgtttctctagaaaaattctatagcaaaattgttttaaaatcgtattaatttattttttaaacttaaaataattcatattgaattaactatacgctaatagcatatcgttttatgtattttctcaatctttttttctctcatctcaaacatactcgattgagagactttaaacacatgtgtatttgaaatgggaggaaaagagaagattgagaaaatattatgccattagcatatatatgagtaaatttatagtcattgataagttaccgggaggtatcgtattttctattgtaaaatttggtatctctatgtacctgtagtactagaagatatcaattaggagataccaaaaattgcgctaaaattattattcgtactacgaattaggaggtagaagtatcaaaattaggagacactgtaaaattactcctctcaatatcatacttgggtactacgaattactccattcgtcccaaaaaaaaaaacctaatcttatgtgtccaggttcaaactcaggattgcgtttttttttgggacggagggagtaagccatatggacgaacgtgtaacaatgtttaaagatcattttatgttttcgaaagtagtggaaactggaataggagctcaccggcgcatatcgtccctcgcagctctccgtcggagcagaggcacgcgaacgccgccgcggaatcgttgttgtaccggcactgcccgccgctcgcgttacaggcgtcgcagtcgccgaacccattcttctgccactccaacacgaaccccttcttgaagagcgggctgtagttggtccccgccgtcaagttcaccggcgactccggccacagcaccggcaggtacgagtacgtgcagttcccggctttgatcgccggtggcttgtcacggtcgtagctcccgccgaggtacgcgtagataggcttactgcagttggagatggtggcgttcacaaggccgtcgatctccggtggctccgtgccgttgcagctgtagaggaagcagatggcccggttgctgctgctaatcgtgaacgggctgagagctagactggacgatatgttgaagtcggtgcggcacacgccgtcgccgccgtcggcgacccttttgtgtccagcaacgaatgaactgttggtgtagtcgatgccgaggacgaggatttgcgagcccctcaacgacgccacgccatcgcggctacaccacaactcgaaggacgggtggccacaggcggcaatggccaacgacgaccggttgaggtcgggaccgcttagccagaatgggtacttgatggtgaggtcgccgcatgttgccggctcgcagacggcgtgtgcgtggtggcacaggaggagcaacgtagccaagagcgggaagaacagcaacttcgggttcatctagccactcaaatggtggagctagcagctgcctgcaggctactacacatggaggagtggagaaaagcagaaaactggaaggggaggaaaaggtctagcttgagaaataacattgccattgccttgttttgcttgacctttttccgatcagttagacgtcattttaatcaacacaagtggaaaagtcgccgtcgcctcttttttttttttttttttgagggaacaccggtggggactccacacctgaattaaattaaataaaaccacaatccaaactgtacaagtacaagaacagcaagaggagatacagagttacagcagttggaggggggaggagaggatcgaaagccagataggcagaacaaagtggtcacatgggttgaaacgattaacccagagcctagcatcctgaatgcagttgtggaaaagtcaccatcgcctcttaacttctgaggaggggggaaatgacaatttcaatcttctaagggcattaatagtgcgccacccattttactcagcttggggctaccacataggatgaagacacaagaagaataatacttgccacaagtctcacagtgctatgtagtctcaaagagtagccacacaaataaaaaaaatcgtttctctctcccttatcctcagtccgctcccaaccatctccgcccacgcgcctcgccccttctcctctcgccgcgcctcccctttctcctccggcgcggcggcggcgtcgagccacccaactgcggcgtggagcggcgcggcggacgacggcggtggcgtggagcggcgcggcggacgggtggcagcacgaacggcccgagcggtgacgtcgatgctggtcagcagggcggctcgagcgcctcccctccttcttctcttccggccaccctagatcgaggggcggctcggccgacggcggggctgttcgagcgcttctccatctccgcccgcgcgccttccctttctcctccggcgcggcggcggtgccgcgccaccgagttgtggcgtcgagcggcggcagcggcggcggggtggtcgagcggcggcctgagctacgcggcaccgggcggcggtctaggagcccctggtggcacggcggcgcggcgcagatcgagccgccgcccaccacaaccactccctccatccccgctccggccacctccctgggctccctcccctccccgtcccctccggcggcgctgggcacgggcgtcaccctctcctctccccggcggacgacgatggcggcgccgtcgagctcgccagatccgccctcggacagtgacggcaccgagctcgccagatccgtcctcggtcggcagcgacgacgacgatggtagtggtccatctttccttcctcccttctctctggcgagctcgggtggtggcctcgccggcgacgaccgccgcccccttgcacggggccatgccctctccggcgatgctctcctctccccggcggcatcgggcggtggaagcgaggcagggttgggggcggcaggacgacgcggcccacgagtgtgggccccacctgcgaaacaaaggaggaatggagagccaaagttggcttcgcggtcttgggcaagccacgcggattgccgacgtggggacgaatattcggtttctaggggtgaggctgaatgccacatgggagcattgtgaatggcctaatcgcgatgcctgattaatttatggtacatgccgtaatcagttactagcaaactattttcttctctagtgtagtctgtaggccgatagaaccgccctcaaccaatcatctcttattataacccactaaattctaaatcttaacaggtaaaatgtcacatcattatccattaacaattattatttaagcatcatacaaacatgctatattatctataattttataatttattaaattttagagatataaaatacaagcatgttaaatcatcccacataattcacataatatttcagtatatatctccatcattttttaatgtttatattgtttaaggtatcttacacattatttttttgacttattatcatcatagtaaactcccacagcaatgcgcagggtttcacctagtcaatatggaaattgttggcgcctccgaaagtgcaagttattctcatgactcgtcattcaaaatacagtgtggacgacggacagattggaacgaagagggtggcaaaatcagaaggtttgcccgttatgctatatggccgacgagtatgcggatcatctactggcgaaatatagggccacactgacatacaattggataagtgggatgaccgttactcagtcaaacactggtggaacctagtgcttgagtcccctaataaccccgtctaccatttcgaactccggtgatcctagtatcttgggaagtatggtgcaagcgtaatgcaacaatcttccgccacaaagcctcaacgccggcctcaatcctagccaagagattaaggaggaagctggagcataggcgaaagtagaagcaactagactctaagagtttggaattttaggagatatcatctaaggtttctttttctgggtctatcattctttacaagctctgtatatatctttgtatatttttctcctactctatattgataggaggcaaagcttttgccactattggagaaaccatctttgctgggttggccaaaaactacaatggccccggtttgaatagaaaccgggactaaagatgattttttgtcccggttttaaactttataggccctagatgatctttagtctcggttcattttttgtccgaggctatacagtatataatccctatgacttatcctcccaaactcctcatcttcatattccttcttatcctcccaaactcctctctcttatccttatcctctttctcagagtgagcgagcgaggtcggcggagctgggagggtaggcggccggccgggggtgggggcggcgagatggaggccggccggcggcggctcggcgcggggcggcgggatgggagaccggccggcaacggccagatgtgggacggtgggatagaggccggccgtcggcaaccgggcgtggggcctcgcccggcctaaggggaggcgacgggatgggtggccggccggcggcgggatgggaggccggcccggtttgatttgtttgagtttctcttgattttttgatgatttgtggatgttgttgatttgtgaatatatatgtgaatgtgtttgtgaatgtttatgtgaataaatttgtgatgatgtgttgtgaatgaatttgtgatgttgtgaatgaacttgtcatgatctgtgtgaatgaatttgtgatgttgtggatgaatttgtgatatgtgttgtgaatcaatatgaaaggaggaaaaaaaacggaggaaaaaaaaatagttccggttggtatcaatcgggactaaggatgcatctttactccgggtattttaaccggaactgatagcgatctttagttccagattcgtagtccagatttgctactcgggactatagagggttgcaaaccgggacttaaaaaaaggtttgtgcagcagtgtgccctcctttcaatttttttgtctcctccaggctaagcgaaaagtcggtgatggttctgagcaggagcgcgtggtagatggaattatcttggcaccgacttgcaaattttcatagaaaacaaataagtacagattaactttggtataaccagctttacacacacagttcagatattagccatctctcggcaaatcatcacaactgtttcaggccttccaactgctcttaaaccgattaaacttcaattttttttaatgactcacacaagacagtgcaaagttcatattgatagagcagaaaaaaaaattcaagattacaaccctagaagaccgtaaccaggaaaagaaaaaagtataccgtctcccacacaccgacagcaccaaacacaaacccaggaaaaaaccagcaccggactggccgccgctaagcgtgatcaatcgccgcaaggccaacaaaggagctacaaaagggatcgcccaaaacccaatccttacaaccgacacaaaacctcactctatccacatctcagggattcagggagagagggtgagagagaagaatggaaccgctctccccgtaggccctccgatgtgaccaacttgtacaaactaggacgtcgataaaagaggaagagactctagaacgagcttgcaacaattgtttgggtggtttcggcaagggcgttgcctagacgacgtctccagggagagaaacgacgaaagtaccgccgccgccgaccgtcgaggttagaagaatcttgactgggctttcgcccgacaaccccactagaggaggtgagacggcacgacaacgcccttaggagggtagtgacgctcgagcgccatcgttgccggcctggctgggtttgcacccaccatccacacctacctatccaccgttgacgccccgatgctccaccgccatcaaatcctctgccggcgcgcacgcatcactgcatcgacgcccctcgccggccagtcgccgcatgccgccatcagcagcacccgctgccatcaacctgccgggacgcgccggcctccctctccctgccgccgggcgtgccggcctcttgcgggacgtgacgacctccctgtcatctcccacaacgccctcctcctccgccagccgctcccgcgcctactcccacgtggttgccgcgcctggcaccacacgcacagctcctgcacctaccaccgcagcacgcatcctcctgtcgtgggctgtcgtgactgccagtcgcccacggtccacgatcgccggtcgtcgtcgtcctcctcctcccgtccacggtcgccgtccggcccgtcgcccgtgcatgccgaagccgtggacaccacctccagctactatcggcgccggcctccctcagtcgcgccaaacgacgacgcatccggcccgtcgcccgccactgctcgcgccgtctcccgctacagcctcccgtcgcccttcgtcgcgtcagctgtgtgcccccgactgaatccgtcgaggcggcgctagatccggtcgtggggacgccggatccggtcgcggcggcaccagatttgcatctccaagccggagactcgccggcgccgccgccgtcttcacggagctcctccttctcacgcaagaggcggagcgtcgctggggcttagccccgctgccaccatcacgactcgccgcccggctttccgggcgacgtgctccggcggcggtgaggcaaaggagagggggaagaggggcggcgtcggatggctagggtttcgccccgagccgcccacgtgaggacaacgcggagctctaatgtgctcccttaaacttcaatttgaaacagatgagcaacgctaaagacctttgctgcaaaatactgtatttgcacctaagatattctgttatttgagtttgaacacgcaaaggaattgccacgggatgaagtcattcaaaccagagaaggggaggaaagattagcaggtgggttaaatattgatcattccttttccttgattttgacttttacatggagtaaaaaggcaatgtcggtaaatgattctgattaacggatatcggttgcgatcaatggtccagcctggtggagtcacctactcacctctcaccattctgtcatcttgtgtttctggttcttctgccctacaagtatcaagcgatcttaccactaaaaactactagaggaatattatctgaatccatcactaacacgtccattatttttaagttccttttgaacgcagtataatgaatttgtatgtagttgatggacccttttagagatgacacttggtattgtgtgagtactatcggcactcaccagttgacaatgctggttaaactgattcgcgaataccgatcggtatgttttatctacggttcagcccaaatgagtacgaaatggtcaaactgatagtatattcatttcggctgcttatgcgcggtaaaagaaatacagaggtttcaacgagtcgcgggacaaattactcaccgcatgtcgccggctgcaggcggccaccggggcagaagcacccgaacgccatggcgccggcgtcgtagcgtcactccccgccgctgccgttgcacgccgcgcagtcgcccggcacccccggccactcgagcagaaacccgcgcctcacgaaccccgcgtagtctcccgccgatctcagctccgaccatggcagcacgggcaccaccgagtacaggcaacccaccgtgtccaccgcccgcttggggccaccgggatcatacatccggttcagggacatgaaccactcgccgccgccgctgaaaccggtgcagttcaccggaagcgaccccgtcggcggcgtccgcgagcagttcgcggagaagaggagctccgagttggcgcggctgacggcgagcagcgagagcacgaggatgctggacatgttgaaccgggtggcggcgcatgctgagctgtcgaccaggttggcatggaaggccattacggagctgttgccgtagtggatggcgaggacgcggaggtaggagccgttcaggctgggcggcgtcgcggtcgcgccggtggggtcgtcgtcgcaggtgacggcgaaggtagggtggccacagtatgcaggctgccggccgcgcagccagaacgggtacttgatggtcaggccgccgcatgccgccggcgcgcagctctcgccgaccaccggctgcgcgcgcgtcgcggtggcaagcaaagtgaagagcgctaccaccactagtagcatatcttaggaaaaaatttgaaaatatactttattttttttatattttgcgtttatatacctggctgtgattaatttgcaaaaatatacccaatccgcggaacggttgcgcgggagcgaggataaaccagccggtcccgctggccggggacgcggtaccgcgccggtcccgcgggctgggtgagcgctgcaacgctcccgcatgccggatgtgcgggaccggcgctcccacatgccgccagccatctcggttcccgaattggatccaatctcctatgcacggaaaacggagcaagccattagcacataattaattaagtattaggtaaattttttttcaaaaatggattaatatgatttttttaaacaacttttatatagaaactttttacaaaaagtacaccgtttaggagtttgaaaagcgtgcgcgcggatgagttggaaaaattaggggaagaatacatctccaacaacacgcggcctgttcggttccgcgcgttggaacctcgggacagcctcggtcccgcgccgctgttctgcggcaccgactcgctatcccgtgggctccatcgctcccgcgcaatggcgtcgcggtaccgactcggtcccgcagtccagtagtgcgggaccggctcggtcgcgcatcccggttccgcgtgaccggctcgggttccgctcccgcatcctcagtctgcggttcgtcctcgctcccgcgcatccgttccgcggattaggtatatttttgcaaattaatcacagccaggtatataaacgcaaaatatgaaaaaataaagtatattttcaattttgtttcgcatatcttattgctccgtagttcgtatgagattggagcaaataccaaaagcttgagtagactatatattttcatggagagtgtactgtgtacaaatacaatccggagggatagggcttctacgaccgtattttttcaatctacattagcgttgaccgacgaaaaatatagcatccgcagcagtaccagctggctgcgactgctgcgtcgccggaacgcctgaaagtctcaaatcgccaattcacgttgaattgtatgctttgctgccggcctgaccaaaccaccgatcgaacaacagggcctaatacgtgcattttcgattttgcctgttaatttccctccttttcttttattatctctactactataaattctccttacattctcttatcccaccacgcgcaacacatttgtatcttcagtgtgtaaccaccagatccaatatattattctctgtaatacttttagttcatctctaataatacggccttcatccgttacaatatactagcatattacactactggaaaaagcattttcgctggtgggggaaacgtgtcttcccatacagacggccggtcttttaaagaaagaggtagtagtagataccagcatacttgatttcttttttaaaggaaaaaaaaggccttgtttgtcacgtgatgagtgatgactacatccagcaagagattcggctcctaccagtgcattgaacttccattgcaatttgggccgttgatcaactaggccttttccgcgtcgttttcttttggaacaagttcacttcgtgaccttcaaaaagtgatcgaaatctaatccacggccctaaaccacaaaaccggatatctcgaccccctaacttttaaaatcagtgcaatttgactccctaggcggttttggagggcggtttcgctgacgtggcgcctatgtgacagtattgactcggtcttctttccatgtggcgttgacgtggcgcttacgtgacgttagaaataaaaaatgtgtgtgggaactatttgttattctcgcacaaaaatatattgtgggacccattgacatgtggggcccacatgtcatactctaactctttctcttcccttcacaagtgttctcttcccttcacaagcggtggcggtcgagggaggccggcacattagagcaggcggcggtggcggcagtggtcggtggggccagatcttcctcctccctttctccctccctcatctctttctcccctgtttctcttcacgggagctaggggtagattcacaatgggggcgggagggggggtcttgagactccagtaccgcccctaggacagtggagacccccctaaggccccactaattttttttccatagatccataggatgtggggactggaggttcgatttatgctgatgtactttattcagtccccactactattttttttctagatccgcccctgacgggagcagcagcgacagacgggggtcgggtttggcggcggcggcaaatgagggccggagcggcggcgatggcagccgcgacagcagcgtggcggcggacgttgcccgccgtcgccgccttccttccgccgccgcgcccgccgtcgccgtcgtgctctacacggcctggttgtggcggtggtgatggagcccctcatcaccgtcgcctgccgcgccgcccatcttcgcctccgtcgctccggctccccgcacgaacatggcaccgcccttgagctcgagaaaggcataggagcccttcccctgcgtaggccggcaccgggtagtggggcgaggacgtcctcgaggggaacggcggcggggggaaactggcggcgtgtcactgcggcgcgcgagaggggaaggatgagtggttctagctgtggctgaacgacgcggtggcgagcgaccccgaccaagccccctgcctcgccgagcagatgagcctcgtctactaccccgtcgcgacgactagcgcaacgccgacggtgtcatcaccagggtcccctcctgcgcctccacctgcccttgcttgcccgccctcttgccgccgccggctcccgcgtgtcgctgccgccgccactggcccccgtcagccgtcacacagccgccgctcgccgaagggaagagaaagagagagggggaggatgaagagagcatgatttatgtggtccccacatgtcgggtggatcccacccacacttttggtggatgacaaatgggtcccacacatatttttttatttctaacgccaactaagcgccacgttaacgtcacgtggaaagaagactggtcaatactgccacgtaggagccatgtcagcgaaaccgccctccaaaaccatcgagggagtcaaattgctccagttttaagagttggggggggtttcaaaatatccggttttgtagtttagggccacggattaaattttgatcagttttgagggtcacaaagtgaacttattccttttcttttcggtctcttttgtcaaggcgtaaattctggcccactctatcttatgggcctcaatttctatgatggggtcgcaccctattttctggagatttggaccgagccgtgctgcctagtgcccttggtcaccacggcggcgcggcgtgtcgctaggattgcggctgctgcagtcctgccgtctcgcctcgtgagcggcagcagtaaacgccggccgcccgtaggaacggagggagtcggtgaacaaagccagcttccgccccaagccgcgatggtggcggtggttactggttactggttaggatggcggattggggatggtgtcgctgaagagaggtagtgagcgatagaggagatcttgatttggccagaagcttatcaagagttcgaagattgaagaggggctcccgctactttgtttcttcagagaatcagagaagaccttaaggtaaaagtaaataaattgctctttgattgtgcactattttccctggaaaagtttggtgctgtgagcctgtgacgatggtagttgtcgagctccaagatcaatcgaggaaaatgtgataattttggcacttagctctaaatcgtagccatggattgatcaaattgttgaattgcttatgaagcaattagggggggataaacggaattcagaaatatcttcgattcagctcccttaaagacactactacactaggcaatgccatgaatgtgtgatgatacaataccaaaatttgacttgtgtcttactttctgtatactgcagatcatcttgttgcatagttggtagtcactgtagggtcttttgaattcacgaggcttgtctcctcaacctttagcactccactaagcttgtgcagctttggtatttccagtagaactcttactttctgtattcagctcatgaactgaatggtctctgaaaaacagaaatagcatagatgaacttcactgaaaatattaccagtccacataaaaatgtgtagagaaagtgtcttacagtaattcactgaaattttgttttggtggcatttccagttcatccaaacctctctcgaacatatctaaaacctgggttattgttggtcgatgcataggtaatacttgtacacaccacaaaccaattaaagtcatctttttggcaatttgctcaacctcacttgtgacttgacaagcttgtaatccgtcatccagagcaaagtgatcataaatccaatctggaaaatacttttcacttgaattttcaaccatttgtttcgcatttttccggcctccgaccatctctagcagcatcattccataactgtaaacatctgactttgttgaaacaactccaaaggttcgatagataccttcaggagcgatgaatccaattgttcctctagcacctgtcattgaaagcttgctctccttggtacggcacagtttggctaaaccaaaatcagcaatctttgggcaaaaatcctggtctagaaggatgttttgaggctttatatcgaaatggatgattcgtgtgttacaactatggtgcaagtattctagcccacggccaaccctgattgcaattccgtaaagtttttcccaccctagaatttctttgggattttctgaataaatatagttgtccaaagaaccattgggcatgtactcataaacaagagctcgttttgagccctccaaacaaaacccaaataagctaacgatattaatatgagaggtcctgccaatgctcataacctcattcacaaactcctctccatttccttttgagtcatgcaagaatttcacagcaaccatacgaccatcttgtaaccttcctttgaatacgacaccataacctccttctccaagcttataattaagaaatgatgttatctttgttacctctgaatacttgtatcttgttggagctatggatccataagattctatgagggcctcaatgttcctttcactggtgctgctagtctttgtgcaaaggagatgccgtagttttttccccttcctatgccatatcagcacatatagacatggtaagagcaagcctgctgctgctgctgtcaaaactgagattaaaactcatgttatttccttttacaagatcataatggtatatcatggccatttaatttgcatgaacatcattagcttttcctattaatctaaaaaaagtgcaaggtgacaaaagctacaaacaaggtaaaagggcttctatattttatccaaatcaaccagtcatttataagattacacaaattaaggatatgtgtttgcgtaatattttaggttattatggcttctgattcaatggtaaatgtttttaacatacctattagtatgatcttcctgccagttttcttggttcctgcaataaccacgaacttaattaacaaaagtaatatagtagaacatttgatattgtcccaaaacaaatgaagtatcacgttggaagttcacattctttagatgatctatacatatcttcaagttagtgaactaatcctttgaacgataaatcctaggtttgatacaagggataattaacaattacgtaggtcatcttgtctggatgaacattctatgtggagaacaactcctctatttcattgcgttccttgtgaaacttaacatgatggacagaagtaataccctgttttgaaattcaactagctgggtggcccgcgcaattgcgcggctagcacccaaataaaatcatatattttttagcatgattttacttaaaatttattaaatagctatctcatgtcttaagagtttgaaagattaaaccttatcatccccgtgtttctaattatatatatttttttaatagtcacaccagttgctaccccttatgacatctccttctttatttgcttgttcgatctaccactatttctattcattctccttgaaacctttaaaaattgtatcttatagtttttagagtttattatcatgttgggtttcgtttttataattttcagacgtctcgtcaaacgttgccattatacttctctatggctcgtccactgtctcttttcttaattgtcattgagattttaaaaatcgaacataattatcgtttcggttcatttttgctttctagaaatcccgccaaaccgtcagcggctttgccattgtacttctctacggctcgcccgctgcgtcccttctttattgtcattgagattttaaaatcgaacatgattatcattgtttttttttactttttagaagttcggaacctttaaaaattgaaccttgtagtttttagagtttattgtctcgttgggtttcattttttataattttttagaagtctcgtcaaacgatgccactatgctcctctatggttcgtccgccgcctactctttctttattatcattgtgattctaaaaattgagcataactatcggtggaattcattttttattttctagaagtcacgtcaaacatcagcggctctgaaactatactactatacaccccgcccactgcttctcatttttattgccattgagatttaaaaattgaatatgattatcaatggggtttattttttattttttactttctagtagtcc

SEQ ID NO: 911 - DNA, 6406 bp, Oryza sativa
cacaagttttagttatttataaattgtattcctaattgaaatcttatttttctttttctaatttcagaacttattttttttcaaattttaattaatatcgtattgtgttcttttagtatttttatttgtattttttattttcaatttcagttgtttcaaaattgtattcctacttgaactctcttttaatttttctaattttgaatattattttattttttattctgaattttatctaatctcgtattgggttcttatatggattcttatttgaatattgcttatttttaattccaaatttcagctaattttaaattgtattcctacttgaactcttcttttttttctaattttggattttatttttttattcccaattttaattaatctcgtaattgggttcttatatggactctttttttaatattccttattttaattccgattttcagctattttataattgtattcctaattggactatccttttcttttctaatttttattttattttatttttattttaaattttgattaatctagtattaggttcttatatggaaacttctttcaatattgcttatttttaattccgaatttcagctattttaaaattgtatttctacttgggtctctttttttctttctaattttggattttattttatttttatttcgaattttgattaatctcgtattgggttcttatatggaaacttctttcaatattgcttatttttaatttcgaatttcagctatttttagattgtatttctacttggactctccttttctttttttttctccgattaatgtgggaatttctagcccccacagcgaacgtggtgccttctttcaaagctgtattttattataaattaaattttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccgatgcataagttttctggtctatttactctttttttcatccataggtaaaaaaaaatatcacattttaattctaattataccggctccaaaatatatatgcacgcactgtgtttgaatcctaatcacctgatctgttgattgatccttagtatccatctaggataaggaaagaatcaaagtaggagtacgtccacctatttggacttgtattctagaacttgatcagtgttgtccgtttgatctagcagttgttttctattcagacttctattatcaaagttaatctacaccatcaaagtctagtcccagtataatctaacagtctagatttttcttttttctctgattaacgtgggaatttctagcccccacagcgaacgtggtgactcctttcaaagctgttttaataatataactagctgagtggcccgcgcaattgcgcggctagcacccatataaaatttatatttttaatacctttactcaaagtttattaaatagttatctcgttgtcttaagactttgaaagaccaaaccttatcatcatcgtgtttctaattttatagtttttaaaagccacatcagttgctaccccttacttctgtcatatccttctttatttgcttgctcggtctaccactgtttctattcaatctctttggaacctttaaaaattggatcttatagtttttagagtttattgtcctgttgggttttatttttataatttctagaagtcccgtaaaacgctgccgccattatactcctctacggccatccactgcatcttctttttattgtcattgttattttaaaaatcgaacataattatcgttttgattcatttatttttactttctataagttccagcaaaacgtcggcgacgttgttgcagtactcctctacggcttgccagctaccgcctttctttattgtcattgagattttaagatcaaacataattatcattggggtttatttattttactttttagaagcccgaacctttaaaaattggaccttatattttttgagtttattgtctcattgggttttatttttttataatttttagaaatcccgtcaaaccctgccactattctcccttacaacctgtccgccacctaatttttattgtcattaggattataaaaatcgaagataactataattggaatttattttttttactttctagaaatctcaccaaccatcggtggctttgccattgtactcttgtacgacccacctgttgcctctcatttttattgtcattgaaattttaaaaatcaaatataattatcattggggtttatcttttttactttctagaagtcctgccaaacgccttaactgattgcttcacgacttgcccatcgtccttccttttaatcatcattaggattctatttgatgttttattaatagcttttacatgtcccatcaactgccaccacttttctcctttataggtccgtaacttaattaatctcgtaatgtgtttgagatggtcttttcttttaatagtttttatttttatcactaattttagttatttataaattgtattccaagttgaaatcttatttttcttgttctaatttcagattttttttgaatttcaaataatattgtattgtgttcttttaatattttcattttttattttcaatatcagttgttttaaaattgtattactacttgaactctctttttaatttgtccaatttcagaatttattttattttttattccgaattttaattaatctactattgggttcttatatgtactcttatttcaatattgcttatatttaattccgacttttagttgattttaaattgtattcctacctgaactcttcattccttttctttttttcaaatttcaattttttttattttttattccgaattttaataatctcgtattgggtttttatatggactcttctttcaatattgtttaattttaattccgaattttagttattttaaaattatatttctactcgaactcttcttttccttttctttgctattttcacattttattttatttttattctgaattttaattaatctcgtattgggttcttatatggactcttctttcaatagtgcttatttttaattccgaatttcagctatttttaaattatatttctacttggactctccttttctttttcttagattaatgtgggaatttctaacccccgcagcgaacgtggtgcctcctttcaaggttgttttaataatataatagatatatagatagatagataagtaggagagattgtcgccgaaataaacgataaaccttgaagagtttcgatgatgagcctcctgcggcggttcgtgtttaaaaattgaatataactattgttggaattcatttttttattttctagaagtctcgccaaccgtcggcggctatgcaactgtactcctcctatacaccccgcacgctacttctcctttttattgtcattgagattttaaaaatcgaataggattatcaatggggtttttttcttttacattctaaaagtcccggcaaccgccttacccgtttgcttcacggcctgcctgtcgtccctccttttaatcatcattaggattctgtttggtgttttactaaaaattttatatgtcgtattaaccaccgcactttactcttttataggcctgttaattaatttatctcgtcgtgtgttttagatggtcttttttcaatagtctttattttttatcatcaatttttgttatttataaattgtattcctaattgatttatttctttttctaatttcagaatttattttttccaaattttaattaataccatatagtgttcttttaatatttttattttttatttttttgaatttaagttgtttcaaaattgtattcctacttgaactctcttttagtttttctaattttggatattattttatttttttattctgaattttaattaatctcgtattgggtttttatatggattcttgtttcaatattgcttatttttaattctgaatttcagttaattttaaattgtaatcctacttgaactcttattttctttttttgctaattttggatttaatatttattttattccaaatattaactaatatcgtattgggttcttatatggactctcctctcaatattccttatttttaattactaatttcagttatttttaaattgtattcctatttggactctccttttattttcaaatttccaattttattttatttttattattaattttgattaatctcatattgggttattatatggactcttctttccatattgctttttttaatcccgaattcagctatttttgaattgtatttctacttggactctccttttcttttctccaattaatgtgggaatttctagccccacagcgaacgtggtgtctcctttcaaagctcggcctagacctcgtcggcgggagggccgacgccaaggacagtgtaggggtgctccaggtcagcgcgcgcacggggaacccaaggcgactgcgagtaggtgaaggtgcgacggtgccgcttcccagaaagctccggtgaacttaggggctttaagtccgttaagtaacccaaacctttaggttaattgatttggattttaactcttagggttctaacctgaaattagggttcttcgaattttgggaattttgtcgggaaatttcaatctattttattccctcttttcgagttaggggagttttaatattgtttatcctcttttaattttaggaacttcaatctagtttatccctttgctcaattttggtttttcctttttttgctttggcaagcgtttcatcgtgcgggtggggacggaaggcgccgctcggtcccctcggaaagatttagattaagattaagataagataaaattttcaaggacgacggaagtaaattgaatcggattattttttttgttttaatgttttttcgcctttttttcgttattacttgttacggacaacggaaacgctttcaattttgtaagtagaggaaacgctttcaattttgtaagtaagtagaggaaacgctttcaattttgtaagtaagtagatatagagatagagaagatagagatatatagtatcgtgtcacatataatatgataggattcgatttttttccgcgtcacatataatttctttattttggaatcagacagatttgttttttattttttcgtcccttttttaccgcgtccacagaattcgattcatttttttgcccggttttttcacccgatttttccccggttttttttttgcccggttcctttttttaatcggaacgattcttttttttatttttttcgccttttttatttggaatcagacgcctgattttttttcgtccaattcctttttttataataggactgattcttttattttttttttgcccttttttacacagaatcggattttttttcgcccgttttttttctcggtcagatttacggacgacggaaacacctcttgttttttaaggactatatagatagagataacgtgataatttctttagagcgaatatagtacaatttaagtgcataaatattttattatacatgcatgtataattagatttagtgtataactcttatcttctgttttatagataaaattgtagcattgtaatttagtcctaccataatctattggaatagattttaatctacctttgagcgcttaataattaacataatatttgcttgttctttcgtggatgaacgtgcatgactctaattacttccacgccatatgaatatccgattccaattgcaaatctcactaaagatttacaggctcaaaaggccatacgcatgcatgcaaatacatgcatgtccgactcctagtcaaattagtccaaatacatgcgtgtccgattcctagtcaatctctctatatgtttttcttttggactcacgtattttgctggttgatctggaccatcaaaatctacacaaatacaatccaacgacacatatatttctcttttttttttccaattaacgtggaaatttttaacctccacagcgaacgtggtgccttctttcaaggctgttttaataatataactagcatggtagcccgcgcagattgcgcggctagcatcattatattttatctcatataatagcatatatgttttctcattatattattcaaatatattaaaatgacaacaaaattttgaattttacaataactttacgaaactactaatgtgtaatattcatattgtattttatatacgtgttagttattaattatttttaatatctaattttag

SEQ ID NO: 912 - DNA, 23619 bp, Oryza sativa
  unsure (1)..(23619): unsure at all n locations
ttctatgtgtactctaaactcatctttcaatattctttaatttttaatttcaaatttcagattgtattcctatattgactttaaactcttcttcccatgttattcttaatttttaattttagttatttgtaaattgtatttttatacagactctaaacactacttttaattttattatctttattccgaattttaattagttttaaattcctatatgaactctatactctacttctaatatttcttttttttaattccgaatttctattttttcctaattgtatttctatatgaactctatactctacttctaatattctttatttttaattccgaatttctattatttcctaattatatttctatatggactctatactctacttctaatattccttatttttaattctaaatttcagttattttctaattgtatttctatatgaactctagtctcctcttctaatattccttattttctaattccgaatttcaactatttctaaattgtatttcaatatagactctagtctcatcttctaatatttcttattttttaattctgaatttcatctatttctaaattgtatttctatataaactcatctttcaatattctttaatttttaatttcaaatttctgttacttctaaattgtattcctatattgactttaaactcttcttcccatgtttttcttaatttcgaattttagttatttgtaaattatatttttatacggactctaaactctacttttaattttattatgtttattccgaattttagttagttttaaattcctatatggactctatactctacttctaatattcctaatattttaattccgaatttctattttttttcttaattgtatttctatatgaacactatactctacttctgatattctttatttttaatttcgaattctagttatttcctaattgtatttctatatggactctagtcttctcttctaatattccttatttattaattccgaatttcaactatttctaaattgtatttctatatggactatagtttcctcttataatattccttattttttaattccgaatttcagttgtttctaaattgtgtttctatatgaactctgcattttttttctccgattaatgtgggaatttctaggccatgagagcgaacgtggaggctcctttttctattcctttaataatataactagcatggtggcccgcgcagattgcgcggctagcatcattatattttctttcatataatagcatatatattttctcaatgtattattcaaatatattaaaatgacaacataattttaaattttgaactaactttacgaaactactgatgtgtaatattcatattgtattttatatacatgttagntattaattatttttaatattaaattttagttatttgtaaattatattcctatattgactctagactcgtcttttaatatttcttttttttaaatccgaattttcgctaactgtaaattgtacttctatgtagactctagcctcttcttccaatattatttatttttaattctgaatttttattattttttattgcatttttatgtggactctaaactaatctttcaatattctttaatgtttaatttcgaatttcagttacttctaaattgtattcctatattaatttagacacttcttcccatattttttttaattttgaattttagttatttgtaaataggatttttatatgaactctaaactctacttttaattttattatgtttattctgaattttagttagttttaaattcctatatggactatatactctacttctaatatttcttatttttaatttcgaatttctattatttcttaattgtatttatatatggactctatagtctacttctaatattccttatttttaattccgaatttctattatttcataattgtatttatatatatggactctatagtctacttctaatattccttatttttaattccgaatttctattatttcctaattgtatttctatatggactctatactctacttctaatattccttatttttaatttcaaatttcagttatttcctaattgtatttctatatggactctagtcacctcttctaatattctttatttttttattccgaatttcaactatttctaaattgtatttctatatggactctagtctcctcttttaatatttcttatcttttaattccgaatttcagctatttctaaatgtatttctatatggactatgtttttttctttttctccgattaatatgagaatttctagttatttcctaattgtatttctatatggactctatactctacttctaatattccttatttttaattccgaaattcatttattttctaattgtatttctatatgaactctatactctacttctaatattccttatttttaattccgaatttcagttatttcctaattgtatttctatatgtactctagtctcctcttctaatattccttattttttaattccgaatttcaactatttctaaattgtatttctatatggactctatgctctccttccaatattatttatttttatttctgaatttttattatttctaattgtatttctatgtggactctaaactcatctttcgatattctttaatttttattttcgaatttcagttacttctaaattgtattcctatattgactttaaactcttcttcctatgtttttcttaatttcgaattttagttatttgtaaattgtatttttatacggactctaaactctacttttaattttattatgtttgttctaaattttagttagttttaaattcctatatggactctatactatacttctaatattccttattttttaattccgaattttttttcttaattgtatttctatatggactctgtactatacttctaatattccttattttttaattccgattttttttcttaattgtatttctatatggactctatactctacttctaacattccttatttttaattccgaatttcagttatttcctaattgtctatatggactctagtctactcttctaatattccttatttttaattccgaatttcagtaattttctaattgtatttctatatggactctagtcttctcttctaatattccttattttttaattccgaattttaactatttctaaattgtatttctatatggactctagtctcctcttctaatattccttattttttaattccgaatttcatctatttctaaattgtatttctatatggactctgccttttctttttctctgattaatgtgagaatttctaggccatgagagcgaacgtggaggctcctttttctattcctttaataatataatagatagatagatagattcctctattttgttttgaagtgaaacttatcttgtgttccagatgcagccttatgataggttatggccatgggctttatgtcgtctgaatgggcagtatgcaatttggaaccaagaaagccgctgctggtgctgggtaagaaatgaatatggccctatttggaagcaggatatcagagaaattcacagtacttccacacatggctcaatatctgccaggaaacggcagcttataaacgaacttaccgcacatgaacccggaggacgttatgccttcggggcattggcagtctagcccatcgtaggtgacattcacccgacaccagcggccgctcctcgagcaatcttcgcagtcgtccggccctgccgtgtagtcgagaagaaacccacccttgatgagccgctcgtagtccttggccgctgcaccgtcgtaccccagcaccgggatcatcgacaccgtgcagttccccggctgttgtctcaaatcgtcgtcaggcttgtacctccccgcaagccaggcatacgagttgggcgattcattttccgcacaactcacgggcgcccaagaaggtggaagctgctgcaaccgactctggttgcagttgtagaggaagatgagctcccggtttatggggctaatcttgaacggcgtgaggccgaggtcggaggaggcgttgacaaagctctcgatgacgcactggccgtccgtcaactgctcgtttgtgaccatgaaggagctgttgtggtagaagatgtgctggatttggtacgtccagaacccgttcttgagggaagcatttctgtggtcgcacgtgacctgaaaagctcggtagccacactccggcggatgcttgccggcgagccagaacggatagccgatggtaaggttcccacacctcgccggctcgcagaacggcgatgtggtgttggtcgtgtttatggcatcaacagtggagctagctattgggagagtgagcagtagcatggctaagcagagcacgacagatgcaggggcaggaaacagatgcatctcctgtagtgcaagtgatcaagaccacggtgtactactcctcgatcgacgcggagcagatttgggcgacgctagtcgagaagataattgatgccacgagtatactgaagatgtgcagctgattgagcgtggctgctactggctagtactatatgcggagatggtgccttatgcagtagaacagctagtccgagttgaaagctctgttattgtttgacgtgtggaaacttccgcgtgcatatcggttcattttagcgaaataacactattgcgcgtgtggattgccacttatttggctcaacttgcaccgcctgaaaaaactcggaatttggtctctaaatttgtgtgttcaggccatgaacaaaggctgtgtttagattcaaagtttggatccaaacttcagtccttttctatcacatcaacctgtcatacacacacaacttttcagttatatcatcttcaatttcaaccaaaatctaaactttacgctgaactaaacacagccaaaactagagtagaccgtgtcgtctgtagactatagcagtattgacagtttgacaccacttggaaggaggccgccaacacactggtccacaagcggtgaccgcatttagagctacggcaagtcacgcactagctcagatcaagacgttagcagctctgccttttaggaaagacaaaaaacaattcactagtgcgtaatactactattttctcttcctgtcttccattaccttatcatgcttgactgtgctgcatatactttctccgtcctataaaaaacgaatctagaaccggatatgatatattctatgacatatgtccagattcattctactaaaatatgtcatattcgatactagattggttttttatgaaacggagaaagtaccttggaagttccgacgtggagcaaggcgagctgccaaagtccggtgttggttggtaaaactttttttttccatatttgtttcaaacttttttaatagatgcttcgattttcattattagtactgactggtttaccacttggttccaagttgccaccatattatttggaggttcatgtagactaagcgcgtgcactgttggatacttgctcaaatggatgagctcatgaatgaagatacttgatcaaatggataagctcacgaacgaacttaccagacttctgcggcggcggcggctgccatgtcaagaggaaaccatatcactgatgagctgctcgtagttgctcgcgtttgcctcgccatctctgcccctcaccggcacgatcacggcgtcgcagccctctagtaagtgtacagactcgttgtaactctcctcgaggcgagcgaacgtgttgttgcttcatttcgtctcgacgagaccgaggagacgccgcaccgccgccgtcggaggcttggtgcagttgtagaagataagattatggttgacacggctaatcgagaatggccaaccgaagcttggaggaggtattggacctcgggacatggcagccactggagttgtcgaagtcgtccatctttcggacatcggtgacaagcaaggagctgttgctgtagaagatgtcgatgatctggaacttgaactgccggttcttctgagggtaaccgagataagggcgaagagggacggggttgtgaatagagtatataatgaattaatatcatgtgcttaaagaagctaactcatcttcttattgtgacttgttactgatctattcgctcgtctataggacatggccggttagctggtctccaaccgctgtggttttcttgtttgaaatggcaggaggaaagaatcgaagagatgccaataaacgtgttcgtaatagtttcagtaatagtttcagcctttcagggaggctgggagggtgaacttaccagaagatgtcactggcagctctggcggtggaggcactggcggtggcaggttcccccatgttatgaggaagcctccacgcacgagctccacatacctgctggcgttcgccttgccatcaggcggcttcagcaccggcgagaagacggtgctgtttctgctgcagccttccaaatagtacttgtcgtagtcgccctccccgtcgtaacgccctcccagccgagcaaacgtgttgttaccgcatctcgtctccacgagccccagtttttgctgctgctccgccggcggcgccttggtgcagttgtagaagacgaggttgtgattggaagggctgattgtaaacgtgacgggcagcttggcgaaggtgttaaacactgggatactgcagccggtggagctattcaggcgagctagcttatggacatcaaagacgagcatagtacggtccccatatgatatgttgatgatatcaaacccggtgtccgtagagctttgaagagttgcgacgccggtggagtagttgcaatatacctggaaatccagacgaccacacggcttatccgcctggccctgggtgatccagaacggagaggagatattcaggtggccgcatttctggctgcccaggcagcctcctcctccttcctcctcggctcccctcgccgccgcggcgagcatcagcggtaaccagtataaggcgaaaaagcaagtaggggccattggactattggaggttggagcatgagatgagattcggaagatttgtactggtaacgaacagggagttcataaattattgaatcgatcgatgacgcgttgtgtactggtgacgcaagtctgaccttttcttcgatcacgttggtttaggccgtgtttagattcaggcgcgaaaagttcgggcgtgccatactagatatgcgaatactttgaagtattaaacgtagactaataagaaaacaaattacagattccgcctgtaaactaggagacgaatttattaaatctaattaatccattataagtaaatatctactgtaacaccatattgtcaaattatggaacaattaggtttaaaagattcgtctcgcaatttacacgcaatctgtgtaattagttttttttctatatttaatacttcatacatgtatccaaacattcgatgtaggaactaaaaagggccttagtttgcgccatgggaattggaaatatctcatgttttctttctttctttctttttttaaaggaaatctcaaatgtcttctaaacgaggaacggagaccttgagatggggtgcctgaatttaaacaagatcactgcatgtactaatcttttttttgcaaaactcttacaaacaataatctcaatcggttgatttaaatagatgaaagttatagataacttagctgtactcacagcgtgacatttagtattaataagagtttataataagggagtagctatatttatagcgccatatttttcaccaaaaaatagtcggcatgtatttacattgtaagtccctacattacatatgtaattttagtttatttacgatgtaagtctcaaaattacatatgtaagtgggatgtaactactgtgtaaatttatataaatatatgatgaaaagtggggaacgcctacggatcggtcgccccggaccgatccggggctagggaaatcgggcgctagcacccgatttacgtgcaaaactactttaaactgattttttctcctaaattacttatccaaatcataatccgattgcaccattaaattcattgcaattaaatcttcaaaacaagaccacatatggatatattacgacgaaaaaaaatagcttattattgaattatttttaaatgttgcacgatgttccaccagatatatcggaattgtttcactaagtagatcgaaaatgtttcactcgtttaaatcggggtgttgtttcaccttatataaaaacaatgtttcagcaaatagtgaaagaatgtttcagttcactgcaacattagatctatacatagtgaaacattgtgagtacacaatgtgaaacatttttcggtggaacaaaaaataaaccaaattttcttaatagggggtttccaaaatatgtgcgttttttttgttgcaatggaatgttttgttcactgcaacgttagatctatacatagtgaaatattgtgagtacactaggtgaaacatttttagtggaacaaaaaataaaccaaattcccttaatagagagtttccaaaatatgtgggttttttgttgcaaaagaatattttaatttaatgcaatattagatctataaatagtaaaacattgtaagtatactagatgaaacatctttggtagaaaaaaagagagagaagtaggtgggtccagcagatacgcacgtgggggaaggggcgcgcggggggagcgcccgatccggctcccccccgcaccggtcgcccggagtagagcattatcgtgaaaagtggtattttttttcaagaaaactatcgactaagacataacaattccgtatataaaaccaatcagaagatcaggtggatgcagctgccgcagcgtttgcatgtgaacaaatccaatggacacggaaaccgactaagatttgtgaaaaaaaaattgtcgccatctttatagcaattccgttataataattttgccccgttcgatctctcaattgatagaaaaattttcggtgcacgtaaaacgagaaatctcattagcacataactaattaaatattaattattataaaattaaaaaatgtagttatttgaatattttaaacaacttttacacaaattttttttatcaaaaacgtataatttaagagtttgaaaaacatgctaacgaagaacaagaaagttaaagtttggagttgagaaaaaaataatatacaatattaattataaattaattatataccataatatacaatattccttatattatggtgatctgattcaaattaatgtatttttgcccatgataagcccttttttatatgctaaaccgtatttttcttagatacgtctatatataatttctcaaatatttggtgtatagtcaactgctacaatggtcaaatcaggggcaaaagagtcatttgaagtcccctttagtgctggtaaagctgacatggcccttcccttagataaaattggtaatttgtaaaaattcattctctcctgtggtatttctgtaaatttggaagagtggcgatgtcaagagtaccgcttcgtaagagtggcaaatagttaaaaaccccctcgatggatggcggctgattcatgcatcgccgccgccgccgccgcgggcggcctctcccgtcggcgaactccctcgaggttttggtggctctcgtctcacctcttgcttggtttacacgctcttgagggtatattgttgcatcaagacggcggccgccggccggtaggttttattttatccatccgccgcctccgtctcttcagcgcgacactgctgccgtcgtctagggaatcagggcatcggatttcagcggcgttggctcagatcgacctcgctgatgagaccaataccgatagtgtcgtgctgttgcaggtaggggctgtgagggaagcaggacaaccgccgtctcctcgcgtgacaagaaggggcggatgaaggtggtgtgcttctgcaacaaacttccagactgggctggctgcagatgaccccaggtatgtgattaattcttgatgaggacacctatctatctatcgaactgaattgtgcacctctgctaaaacaactttgccgaacaggttgttaagcttttggggcaactttgccaaacaggctgttgagcttttgggggtgagtttagttgttgcgataagtaataaatttaatggcttaacaaaaacatacttccattcatttactttagctgagtggcggaacatatatagaatgaatcatcccaaaagaaaattcttagttaagaataagatgaaaaatacgatggcgctgcatgacatgaaaggatcggcttcgggggcatctccaattcgttgatgttcttctccagcatttctatgaccttactcattgaaggacgatttcctgggggcagtttgtatgcaccacaggccaactagtgtgatcttcctcgcaatctcttcattctcgcatgtgacttcatggctttgcaaatctttcgctaaatgatcataaatccagttggggaaatatgcactagaattatcagtatttgttttaacatttttccttccttctaccatctctaacagcatcattccataactgtaaacatctgacttagttgacacaactccgaagcctcttgaaaatacttctggtgcaatgaaaccgatggtacctcttgcttcagccattgagatggcactatccttgaggtggcaaagttttgccaatccaaaatctgcaattttaggacataagtcttcatcaagaaggacgttgtgaggcttgatatcgaaatggatgatccgggtgctgcaaccctgatgcaaatactccaatcctcgtgcaacgccaattgctattttctgtaaactttccaatccaatagctaacctcaaactctcagaataaatatacttccccaaagaaccgttagccatgtactcataaacgagggctcgcttagatctctctaaacaaaagccaagtaaattaacaatgttgacatgagatgtcctaccaatactagtaacctcatttaggaattcctctccattgcctttagccccttttagaagtttcacagcaaccatacggccatcttttagattacccttgaatgccgtaccaaacccaccttctcctaatttttccttgaaacatttcgttattttcttcaggtctgagtacctgtaccttttgggagacagagactggtatctctttaattcctcttctgtatttgactcatttccagtgtacttgtggtgaatgataaaaccaagtgtttgcttccgtcggtgcattatccaaacgagacacataaaaaccacgccagctgtagcggacaaggaagctggagagttatacaaaaaatgagtgaatccttgtcatacaagatgtgcttgtgttatgtacattatcctttgtaaatgtgaaaaatcttgaaaaatatcaggacaccaaaaaatttagttagcggtgttccaaaatatgacatttagcaatctgaggcaaaaataaatagcactagaattagtcattttagtatcacaataatagagcatggaatggagctggggtgccagcggaatcatgtgattctctgtatgttcacatagcttattcaccaacaaaagacatacctatcaaaattgccctgacattcagcttccgattactccaatctgcaacaaattacggttaaatcaatgaaaaatttcagctgttaaaacatgcaaaggaataccgattgaagaaaagctcacattcttttttatatcaattcgatttttatgtaagctagctaggcttaattgtgagatatataacggttctccgtactgctctaatgtctgacggttcgtggagtcgtgtagatgatgtgtgttgggctcacttcttattcatgaataaaagcacttttttttttctaaaaaaggccacgaacagtttatatacataactgcatctaaattaacaacggctactatctgacacagagagaaactcagcaacaccaaggcaacaagctgtctgacattggaaattcagaacagtagtggatctctggattgcatatttgcattgatgaaaaagagagagaaggaatttgagggcatctctttggagaaattgaagcaccttcctgactaagtgtcattggctgccaagccagcttccggagacatccttcatcaactggtggatgaatgcaagaaaatagttccctcagaagtagagaaaaggctttgacacagtcgtcatcttggtcgcctggtcaatttggaaagagcgcaataacagggtgttcaaacatcgacagcgctcgtggagggaagtggccaaggacgcagttgatgagtgctgtgcgcccccccccccccccccggggcggtcgtttaagtaatatcgcaagagataggcttcttgttaatttccattttcctttttttaagtgttgaccgttgttatctcaaacttctctaaatcttaatacaaaagatgcacaagccttttgtgcattctcgggaaaaaaaaaacaccttcctgacttcggtaagcctagcggtacagttttgtaatttgaactttgaagcactatatttttgcctggtctattttgttactagattggtaagagttgtagatgttggactgctactaatgaattcaaacagaacatgtactagaagcaagtgtgggagagtactgaaattagtttcattgtcttgaaaacgaaaattgggagagcgttcttacatggagatgtcgaattcgagcagatcaacccgtggcagctgacgcactggaacataagttgttggaacctgcactccccgccgtttcttctgcatgcgtcgcagtctggatctcttgttaccgccctctgccactccaagacgaacccatcactgatcaatcgctcgtactgttgaattgacccattaccatttccaccaatggacccaccaccatcaccatgaatgatagttctaccaccgatcgtatcagcgatcaattgctcgtagtgttgatctaacagcttcattccatctccaccacgcaccggcaagctcacggagatgcagttccctggaatccccgacggcggcgtgctgttccaccgatcggagatgtaagctcccatcgtcgtctggtttgcatatggccgttgcagccgagtgtcatcaggaagcgtgcagttgtagacgacagatgttgctgatgatgaatgggtacggagtgaggctggatgtcacgttgaaatccgggatggggcagtcggcgtcgccggcgaaggtggtctgcacggctgccaccagcgaactattctcgtagaatatattgtcgatgcggaacaggtgctcccggaacgtcctgctgaggaaggcgtggccggttcggttgtcgcaggtgaggtccaacaccgggtagccgcagtagagcggctgcacgccgctgagcgagaaggggtacgtgatggtcaggttcccgcatctcgccggcgcgcagcttgtgttgttgttgctgctggtctcgttgccaactgctgctgcgacatgcagcaaggaagctgctatgatcatggctggtaacaactggaaggccatctcaagtgtttggtagggactagggactggatcactggagattggagtgatcagttgttacttattcttgctggtgagatgagaagaggatcggtttacatttctccaacgcggacccgtttgggcgctattcattccatggaattactacatttcaagtccggctctgctggaactcttgatcaccaaatactagtgccaacgcatactgacccatctttggttgaattaactatcctgcgcgtggaatttgctgactaatgtactttctccatcctagaaaaagtgaatctaatattgaatacgacatatttagtataacgaatctaaatataggtattgtcgaaacatgaattcggcaataataaaaggggtagcgcacgaaacctaaaagtggatggatgcggagacaaaggatttagacaggttcaggccctctcaatgagaggtaataccctactcctgtttggggatttgaatccgccgagtgtatatagatctgacgatctagttgtctcatgccccctagagggcttcctgcccaccttatataggatggggggcagaattacaagatagaaaccttaaccaatacggtataggtttcctaaatctaatttacaatattatcaaactaggactttaggccgttccataatatacagggaaacgtaatacccaagtcatgatccgttacatattccatagatataagttatcccctataaccagtcgaataaccatgccatgtgggtatggggtacccataatctccacagtagcccctgagaccttcacagtcgaaaagataatcttctctcgaactagattattccaaagccgagtgcttcaatcatcttcgccttgatctctcgagtactttaatcaaatcagaagactgtggagggctgaaaaataaagtcaggtgcatcgactagatgcacctaataggtgtagccctcgactgtgtggttaattgaacaaacaaagcatatagtcaaggaataaataatccaaccaaccgagtggcttcgataattatagtcaaccaagcgactcgatattaatatgtagcatatgcggtgtgaatccctgaataacatgatccgagtgatataccgactgctttgtaaaatatgataagtgtaacctaaagttggctacatcattgaaaattcacatagcaaaacagctataaagaagcttgtatgttgtgaataaagaaatttccaaagtattgggcatacgccatgcgcacactactttaacagatgtgcttaagtccctaaaagacacatggtttcaccacacctgaaaatatatggcatatgtggtataaaatccgagtaaataaactcataaaggatttaacaaccgcctggaaaatgaccaaaatatataatcagcctaagccataatattggtcaataaaagtgcacacttacgtggcaaaaagcaatgatattgtatcgaatcaattgctttacgaacccaaacaacgccttgacttatataaaaaagtcagcgaacagctatataaagcattactgtttggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgagctgcagacatattaggcctaagccaaaaaaaaatatgctttcgacaccctttaaaggatgacgcatgtaacatgctcccgagtgataaatcttccgggtgatatagaccaagtacagctcatatgaatagcttctgatctgagtgattatcccttatgggatactcccaaatagatatagtaattgaatcccgactggcgcaagtattcggttgataaccctgacggggaataataaatagtccagtctttgagcatagaaaataaactcatgatcataaattcatgttgcatgtatccggaataagtccaaattgaaggtatgatacttgtgtttgagctagtaaacccctgagcatatagtttgtccttctatcgtagtcacaattgtccattgaaggtagctgacgcagttagcatagagacaagacgaccaatatagagataatattgcccaccagaggtggcaaaaatattggtggtagtgaagatagtgataccaatcaaaagtgatgaagttgcacagccgtggaggcgaagaaaccagtcgacaacagtcaggtcagccagcaatgaataggaaggcgcccagtgataaagtgacatgatgaagatgacgatgtcggcgatccagtcaatagtagtgtcgcaaccaatgataatgacgaagacgctcatcagcatttgcatagtaggtcaaccgtgaaggtgaaataataagtcggtgaagacataatcatccattagcaacagcggagatgtcagggccgatgaagcagaggtgatggtgatgatgtcagtgacaataatctatcaaactgttgagaagatatcaaagcttgagaagtttccttgatgtgagcgtgtgcataaagaagactgatgcaacgccccttgattaatgaagatgacagtagaacttggtgttatagctgctgcaaatgcttcacttggaggaaagtagatgttgttgtccaactcgtcaaaactgagttgattggttgataactccaaactctggtgtaataatcggagtcgctgaaattaaatgtcggctctgaagtgaagacgaagataataactccccgagttgactcgtattgattgattgcttcatcttgacataaagcttgtcgaattttgagccgtgtatttgtgtagccccccgactctttggttagttgggaaacacctgaacatagaatcgaaaactatagtttcttgtcgtcaagtaaccattgcttgagtgaagatgcatgttgaagatgtccgagtagaattctcttgtagtcgtcgtggttggtgaagtagcaaggcttgcgaagtagaggcaatagagtttgccggtgccgaagataataaagatgaaatcgctctaccatggtgacaaagcaatcaacgacggaagaagtagaatgatgacgaaaacgcgcagccgtggaggtgaacaagccagtcggcagcagacgtagacagcttgcgttgaatgtgatgacgcttatttgcggggcggcgacgcgcagccgtgaagacgcccaacaacggcggcataataggccagccgtgcaggcggaaacaccagtcggcggcggacgaggcggccggtcggtgaagacgtggacgcccaacaacggcggcataataggccagccgtgcaggcggaaacaccagtcggcggcggacgaggcggccggtcggtgaagacgtggacacccaacaacggtggcataaaggccagccgtgcaggcgaaaacactagtcggcggcggacggaggcaagccggtggtgatgttctgactgatccattcctgaagcgtgggagataagcttaaagccattaatccctattatgcatatctggatctggatcctgcagaacaaatatataggatgagtagtatctgatgtaaatataatacttgaggaaaattcaagtattttaaaatgtttataagtatgtatttctcctctcgtcaattttgatttccccgagcagatgactcattacgtttaaacactctgcccgactagtcataaccatcaagcaccgggagtcggcctaggcacttcccaaacatgcatatgagtgatatgagttcgtcattaatggaacaaagtttcacggatcggagtttactactcgggtacttttgcaattataaagagcagaaaataaatttatcttatctctatgcttttgatttattccaaataatacttagcaccttgtgttactcggtccatccaacgagcccccgggtgctaggaatcggcccaaaggcaactatccattggcaaaccaaacggaaagcataggaaaatggaactccataactcgataggcacttttgtactcagattatgtcgcaagcaatcaagatgaatattatggaaattattaaaaaatatgatataacatctgtagccccccgactccctagtcaacggtgaaccagttgatgtagtgaggcagagggaaaggaaaatatcatataaggaaaaatgatgatgacttagctttgtaatattccccttgatgatggcagaggtggccaatgtggaatcaaagtcgtccatcaatgacaatgaagaaatcaatcggcggcgacggaggcggtcgacggtgaaagcgatgcccaccaacagcggcataataggccagccgtgtaggcaaagacaccagtcggcggcggcaaaggccagccggtcggtgaagacgtggacgcccaacaatggcggcataataggccagccgtgtaggcggtgacaccagtcggcggcggcgaaggcaggccggtcggtgaagacgtggacgcccatgaacggtggtgtgaccaaccaaccgtataggcgaggacaccagtcggcggcgacggaggcaggccggcggtgaagtcgtagacgtccaatagcggtggcataataggccagccgtgcaggcgaaaacaccagtcgacggtggcaaaggccagccggtcggtgaagacttggatgcccatgaacggtggtgtgaccaaccaatcgtataggcgaggacaccagtcggcggcgacggaggcaggccggcggtgaagtcgtagacgcccaacagcggcggcataataggccagccgtgcaggcgaaaacaccagtcagcggcggcaaaggccagccggtcggtgaagacgtggatgcccatgaacggtagtgtgaccaaccaatcgtataggcaaggacaccagtcagcggcgacggaggcaggccagcggtgaagtcatagacgcccaacagcggtggcataataggccagccatgcaggtggaaacactagtcggcggcggcgaaggccagccggtcggtaaagagatggacgtctatgaacggtggtgtgaccaaccaaccgtataggcgaggacactagtcggcggcgatggaggcaggccggcggtgaagtcgtagacgcccaacagcggcggcataataggccagctatgcagacgaaaacaccagtcggcggcggcaaaggccagctggtcggtgaagacgtggacgcccatgaacggtggtgtgaccaaccaaccgtataggcgaggacaccagtccgcggcgacggaggcaggccggcggtgaagtcgtagacgcccaacagcggcggcataataggccagccgtgcaggcggaaacaccagtcggcggcggcgaaggccagctggtcggtgaagacatggacgcccatgaacggtggtgtgaccaaccaaccgtataggcgaggacaccagtcggcggcgacggaggcaggccggcggtgaagtcgtagacgcccaacagcggcggcataataggccagccgtataggtggagacaccagtcggcggcggcgaaggccagccggtcggtgaagacatgaacgcccatgaacggtggtgtgaccaaccaaccgtatagacgaggacactagtcggcggcgacagaggcaggccggcggtaaagtcgtagacacccaacagcggcggcataataggccagccgtgtaggcagagacaccagtcggcggcggcggaggcaagccggtcggtgaagacgtagacgcccaacaacggcggcttgatatgccagccgtgtagacggagacaccagtcggcggcggcgaaggcaaaccggtcggtgacgatggctccagcagtacatgtaaagagaaaagcaatctctaattagcatcaagaaaattaatcttgtgtacgtatgtctgcatatatgaagcatgcatatattttttgattggccgattgatctcctgtagcatgaacagtacacgcatccacacatgcacgtcaccagacagattgcaggctgccatccgtgcgtacagatcacgggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttgatctgctgaatcaactcatgcatgcatgaaatttctccgagcaagctataggcggctgctcccatgtgcccgtggtggcgtggtggccgcaacgcatccgtcggcgctgctcctggcgatcgccgtcaacagctccgttttaacctcagccgaccagccccatagaaagcaaggaaaacaccagaagagcaaatcacaattagaaattaatctaataacagttagatcaaaacgccgaacccgactgaagatttgagccatcgagattaatctcgccgtttcttctgtagttgattccatcacacttttcgatgggtaattcgacgcagcccctacctgacgcgccaactatcgaaatatgaattcggcaataataaaagggggtagcgcacgaaacctaaaagtggatggatgcggagacaaaggatttagacaggttcaggccctctcaatgagaggtaataccctactcctgtttggggatttgaatccgccgagtgtatatagatctgacgatctagttgtctcatgccccctagagggtttcctgcccaccttatataggatggggggcaggattacaagatagaaaccttaaccaatacggtataggtttcctaaatctaatttacaatattatcaaatcaggactttagtccgttccataatatacagggaaacgtaatacccaagtcatgatccgttacatattccatagatataagttatcccatataaccagtcgaataaccatgccatgtgggtatggggtacctataatctccacaggtatgtccaaattattagtactagaatatgttatatctagtcctaaattgattttatatgagacggagggagtatggttcaagctttagagaagtgccctcggacgagggcaacccataattgaccaagtctaattctccaagtctactctaagtctaattctccaaagaagaatgaacccataactgtgactagaaaatcacattccgcgatcgagactactcgtcatatattactgccttaactacattagacacgtggttcaggcggtaattctgaaaaaaaaatcattacaaatgcacggctgcagagagaagacaacatactagtgcttctttttgagctaggaagacataatactccctccgtattttaacgtatagggcagctaccgtacgggattccgttgcaacgtagcagccacgggataagatctccattaccttatctccttcctttcccctccacaaactctctctcacacaggagaagaaaacgagagcgcggagatgaagctggacaggaggaaggggtcgtcatcgtctccggcggccatggatgacgacgtcacggcgtcggtgaggtaggggcggcgtcgagggtgatctcgccgcacctccacgacgtcgtcctccgcccgctgcggcgccgcctccacacgctgtggcgctgcttcttccactagcgctctcgtcgctgccggcgccggggcctctcccctcctccctcgcgctcctcgccaaggtcgccgtcgtccttgtccgctactcccgccgcctccttgccggtgagcgcaggtggctcctcctccgccgccacagaagcagaagaagccggcggtctcctcctctccactctgatacctggtaccttgggtataaggtatctggtacctttggtacctggtacctctggtaccgactgatacctttggtacctggtaccaggctagtacctagtatctagtaccgtgatacttggtacccgtgatacctggtacctgatacccgtgatacctggtacctggtaccctggtgcttggtgcctggtacctgatacccgtgatacctggtacctagtagcctggtacctggtaccctggtgcctggagcaggaagagagagagaaggaggcagccgcgtggagcaggagaaggaggaggcgcgcgaatccggtggtcggcgaggcgaagcgtggaggaggcagcggcgaatccggtggtcggcgaggcggggcagccgatgagaagaccgacaagggcggggagccagagcggcgctgcaagggaggcgagcttgaggacgacccttgccgaggccgcgccgtcgtcgtcctcctcggcggccggggtcctgagccagcagcggcttccccggcgccggcagcggcctccgcgccaccgctcccgctctccctcttgttcaccgcacccgtcgccaagctcctcgtcgtcgccgcctcccccgcggcggtggccgccggctccgacgaggggtggggcgagggcaacggggacgacggcggccaccggctccgacgagtggtggggcgacagcgatggggacgacggtggccactggctctgatgatttgggggagaagagtgaggtaggaggaggggatcgatccggattactatcccgtctccacaggatgccgtggaatagattttctgtttaatgtatgacgtcgttgacttttcgatcaacgtttgaccattcgttttatttaaaacgtttgtgcaaatatgaaaatatttatgtatgtttaaagaacatttgatgacgaatcaagttacaacaaaataaatgatagttacataaattttttcaataagacgaatggtcaaacgttagataaaaagtcaacggcgtcatacattaaaatatggagggagtagcttggagttacggtccctacttataactgacttaactgaggttgtgtttggcagcggcagttggaaactaatccctagtgcacgcgcaaaatagagagactcattaacacatgattaattaggtattagctattttttaaaataatgaattatatgactttttaaagtaactttcctatagcaaactttaaaaaaacacatcgtttatcagtttgaaaaacatgaaagaggaaggtgaattggaaaagaagggaaagaacgccgccttagaccttgtttggagataacaataggtatagaataaagggacaattgcttatttgaccctattttgaactgtaattgtcgatttggccctactttttaaactttgcttatttgaccctctttttcgagtacgaagcttccgtctgaccttcttttgatgactccgttagggttcgatttttttttaaaaaaagaaaatgtttcaagagttcctaatgacgaaaataccctccaaaccctattttgactctctctctctctctctcactcgtgcctcacggtctcagctctctctcactcgtgcgtgcagcggcggcgacgacctacgcgtgtggcggcggctagctaagggggcggcggcggcgagctgagggggcggcggcggcggcgtcaagcactgccccgccagcgcccactcgttgtggtggagggcggcggcggcggcgatctgagggggtccgagtcggcgccgatctgagggggcggcggcaacgatctgtgggggcggcggcggcgagctgaggaggcggcggcggcggtctgatggggcgcggggcggcgccgatttgtgggagcggcaacgccgagctgtgggggcggtggcgccgagctgtcgtggcggcgacggtgagctcgatgacgaggaggagcaacggtggtggtggagctcaggccatggcggtgtgcaagcggtggatccggtggctgctgggtatatgagccgcagatctggcggc

SEQ ID NO: 913 - DNA, 1731 bp, Oryza sativa
ttttttttatattatccaaactttacaaacagggtcatacaagcaaccaaacaagatataacagggccaaataagcaagggcaaaatggcctatttaccccaaaattaacaccgtcaccttacacaaacggaatagggtcagaccggagcttcgtactcgaaaatgagggtcaaataagcaaagttcaaaaaatagggtcaaatcggcaattacaattcaaaacgaggtcaaataagcaattgcccctagaataaatgatctctaaattcccctcgatctcctgcggaagggattaacctaactaaggtcttattagtagtaacttgtgttccattgggttaaaaaggcccggcctatgaagtgaacttcccggcccatcaacatttttcggttttggatactgggcctccttttgtgatgggccgagcccacttcttcggaccttgggaccaatggccttcacggcccatgcgtagcgtcccccacaaccaaacagcaccaccacccggaagccgtgtagatgccgaagcgcccggcgagcggccgccatggccgtgaccggccacagttcagtcgcaggtgtaaacgccgatttcgcggccttagccacgaagggagtcgccgaacaaaggatagtccccaccctgtccggctcggtgatgacggcagttagatcggcggatggggaattgcggcagcggtgagccggtgactgtggggaattacggcagcggcagcagcgccggcaggggaggctgctactgttgttcatacacgagtagccccggcacgttgggcagaagcttatcgaggtcggagagaggtgcccgcttcatctccagaggagacagtaagtaacctacccctttggcctttgctcgagtgctagattctctcacaaattgctgtgatttcgctagtttggacactcgtagatctaattgggtcaatctagcatatgttaatttatccattgaattgtttgcaatatgtcaatttctgaaggaaataatgggaatacttcagaagcgattggaccccggggcttgaatttccggatagatccatagaaaattaaataagttgagattgaagttcttcgtttcaaacatactttgatggaatttggagcatattttcttattccttttggagtcttagtatgtaagagtaagactgactgcaatttaagatattcataaccttgtctttctaaaataataaggaaaccagagtagcttcagccttcttgtttagctgccttcaacaacaagactacagctgagagatgttaagccaaaacgccaaatttcgatggttttgtattaattctgaatactgaaggtcatctttttcacagagttggtagtcattgtaggaattctgaattcacaaggctaatctcttcaacattcagtatttcactaacagcatatgctttgtcagtagcagagcttgtgctttccgcatttaacttgtgaaccggatgttctctgcaaaaagaaatggcatcggtgaatttcatggagaatgcttgtaccaatcagcacaaaaaagtgggaagataatgaggtgtcttacagtgattcacagaagctttgctttgaaggcatgtccagttcgtctaaagctttctcaaacatatctaaaacctgggttattgttggatgatgcataggtaatacttgtacacaccacaagccaattaaagtcatctttttggcgatttc

SEQ ID NO: 914 - DNA, 264 bp, Oryza sativa
cggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaat

SEQ ID NO: 915 - DNA, 481 bp, Oryza sativa
gacttgcccgccgacgatggcgggaagaagcggagcgtgcgctcctgcggctgcgggaaccggtgcggctccgcgaccatgcccgcctgccccccggcggagaagaactggtcggcgagccaccgtcggccgaacaccgagacgaagtccgccgcgccgccgcagtcgatgttgtagctgtggttccccggcgctggaggaggaacacaaaaccaaaaccaaacccatcaccattactaccatctcaagctcaatttcagcaaaccattcccactgatccgagtgagcttaccgccggagaggaaggggtcgtcggtggcggcggcgcgcgcgaggccgaccgccgccgcgacgagcagcggcagcagcaggacctgcattggagattcggtggggagtttagggggggtttgggagaaatcgatttgtgttgtgagcttccgaggtggaggtgtactgggcgaggtgaggaggaaggaga

SEQ ID NO: 916 - DNA, 16316 bp, Oryza sativa
gatcctctagagtcgacctgcaggcatgctttaactggttaccttttgacatcactaccagggaactcccattatttgctccagcaagtgcacctatatagtagttcctttcccattggtccataatccattccttcaaatgaccagaaaaccatggaatcacatttgacaatgtatacaagagcttccttatatgtaactttgccttgaaaagttatgtgattagtttgctaagattttccaccagttaaacaaggagcaagctactcaccttgtgaagaaaatgtggtgaaagttcataaacctgggaagtgaacccagtgccagcatccatgattagagcccacagatttgagcaagatgttatgcaactgataaacagaccatcttcattccctttgtcaatgtgttgtacaagccttgaatctgcaacgttgtagtgatacctgcaaaatatagaacatgtatgttgcattgtactgcattaacaaaggtggatcatatagctaactataaactaaaactttcgggcctcataagaaaaagtacctttgtttcataggccgtctggcattataaacactaatccactgtgttgcaggcatacccatcctgatcttcttctttggttgttcatctgtctcttccatcaataagcgacctctcttttggccaactagatgtataagctttagagaaattacaaggaagattagtgcaaccaaagtcatgatttttaagcagtataacagattgcaatatatgattgtattgtaccttctgagcaccatcggtgttaattggcctgatatctggatttgggcccactacagtatcgaaaagggatatacactttgcatagttaggttcttcatcaaacttcaagttgaccacatactctacaaactccctaaagggttgtgggcaaaagcagcacaatgattctggagacgtagccattttctttttgcacacaaggaaacccttgttttcaccctgcaggcacacactatcaattatttaaatgtattactacaatcagaataaatggaatggtgggtccggcgaattacctgataaccttgccaaggtagacgcccccgtagaagaaaaactagtgtgtaagctagagattctaaatcatcccttcggctaccgattctccctagatgtgcatgaacactagcatagcgaactgtccccctgaaatagcagcaaaagcaaggcagagttactgatttgctataagcctacaacatgaagaatgagttggcattcaagacagaaattagggctctatttccatgcagaaacagccagtcaccaaacataatagtgaggagtgattgaccagcaccagtgccagccgcatttagtgctgttgagaagtaatgaataatggttgtacaggaacaagcagaatgcggggaaaaaaaagataaaacaaaatttaagtgaatgaaaataattgttggccagaaaccagtacaaagggtgacctgatttggctgcatcctaggactcaaccaaaaacaggaaacagaacctacgaaggaaatgccacagagcattcaatattatccataaaagcactagcgacaatgtaaatgatgcctattgattatcataaaatttccatctggtcacctgaaaacatcaggtcgctggtcatagtcaacgtggaggccagttgaagcatctctccacttggtagctgccatttaaagatagattaaactcaattaattcagactcctcaatctgctgctaccttaaaacaattgaatagacaatgatcgagcagttggttaatctgtgaagatttagttacctaaaccaagatcgacaaggaagagtctcttttcttcaggagttccaataggccctagcaagaaattttcaggtttcacatccccatgaacatatctgcgattgcaaaacattttctattacaacagaggaaataaaatgtattttggtggggaggggataataataattagagagatggcaaccaacccttttgaatgcattttctcaagtatggagatagcttcaatagcgatgcacgcaaccatctcaacagacattctgaaaaccaaaacaaactatgttagtgataaattagaagtctacataaatgttagctaaattggaaaactcacgtgtgagaattattattccaaacatcccaaagactgggtcccagcatatccataacctacatttttcataaaccaagttaattaaaattttggaaagggcaaaaagaaaacagtttctctcgtagtagtcaaaatgaggtgtcattactataacatagtattcgccttgacgtcctttatagtggactcgaggaaccccatgaatgccaccgatggcgctgtatatacgatggccatgataaaagtcaggtacctatatatagcatgcaacttgctatgcataatggcagatcatgaggcacatacttgtaaacctgccattcgtaaggaggcccatggttgcatcctttactggttctatgttcaaactttagcgccacctaccattcgaaagcacgatatttattttcaaccgttaataccatccacggttacaagtacagttttacaaataggctggcactaaatacctcagaagcacctggaccgttagctaacatgcggcggccaacatatacttggccaaatcctcctttaccaagctttttatcaactctatactttggtgaactgcccacctggacctgcacaaagccaaaacaaacagattagaaaaaaaaatcgttttgaataaatggagacaactgaagctaggatcttttgggatacaaacacgaaatggctaccgatcccaatcataactgtcgcttaacctctggctttacaagatgaaaacaatttagcttcgtggatgacgggtgaatctactgaataaatgttcaaaacggctaccaatcccaatcataaccgtgaaccgtcgctcaacctccggctttacaagatggaaacaaattagcttcacggctgacgggtgcatctacgtgttcggaacagctatcaatcccaaattcccaatcataacccttgcttagcctccggctttacaagatgaaaacaaattagcttcacggatgacgggtgcatctatagaataaatgttgtatgattgttgtatccagtccacgcacaggcctggttgatgattgctgcatccagtccacgcacaggcctagtaagcacaagtatcaaataagagaacatctcaccgtatcaggtactggagtggtattcccctcgtcctcgacggcctgcttgtcggcgctgcgcgccccgctgtccgggccttccatcttcttctctccgccgccttccctccccaaatccgcgacctcgatctcctcctccctcccctcttccgcctccggagcagcctcgacggcgacttctggctccttcctcctcgccgcccttcgcctcctcgccggcggtggggccggtgccgccgccgccgccgccgccggattctcctgcgcctctcgggccctcctcgccgcgctacgcagcacaggcatcctcagccatggagccccatatgccccccgcgcccccgccgcctcctcagattcctccgccaaacaccaggaacgccgccgatctcgggggagtgggtgggaagcgagcgatgcggcgacgctcgggtcgcggcgcgcggcggcggcggcggccctagcacggagacggctagggttggggtttgtatgcggatgcgatggaatgggggaggagacgggagggagggagggagggggaagcagatggtggtggtgctgacgtcacccgcggctagacgcggagcggagtactgtgttagttctacgggaagggaaaaggatttagcgcggcggccaccgtgtaaaatctggctgtgtacatcatttcaagtttttctatctcaaaaatatgctgccacttgcaagactcgactccgatttcgcttggaggaccttaatcagctacttctactattctcccctctataaattactctcctctagatgtttggaggatgtatgtttgtcttcggtcaaactaccaaaattataaactaacactagataacgagatacgatttaggtttagttccacgtcaaaattgaaagtttgaagaaaaaagttaaaagtttatgtgtgtaggaaagttttgatatgatggaaaagttagaagtttgaataaaaaagttgggaactacacaagcacgtagtgtctgatgaaacagaaatttgcggaactgaaattggctaagaacgagtacagttagtgatgcaagtgggctctaaaaattgtcacattatatttgtgcttaggtgaaggagcgagagaaaaaagtgagctacagagttaatatatcatgggttaaaaccatatgtgtatgagtatatatttatatgtaactattttatggaaagattgttaaattggttacatatgacgtattaatttttagaattatggctttataagtaaacttgttctaagtgtaagaaatgaggtggagtacataggcactatcttcaatgtgcataatcacctatattagtggtagaactacatgtatgttttcccctgttaattctctcacgttacatattttttttatattgacttcaaagtgttggtagtagaaagtaaacagttaaaaatttctttgttgacaataaaattatgcttagtttacatgtatcaaataagtcctttatcttctattggtataataatatttatctccatcgagttaaaaaatagagcaatcttgttccctgccactccttagtttcataaaacggtttatatgttctagtaacatcttataatcttctaatggaagttgatcatcgtcaatgggtttataagcttttctcattaacttggggattcctattttacgcgcgcgctggctacggaagtagcacgcagccgtacccccctcaacgccctgcagcatcgtaattagcggtaatgatggtaattagcaatattttccttttctggaaggttttctttttactaatagattgataagaaatctatacgtgaagtccaattttgaaaaactttcaactcgaaatttgaaaaaaaaattcaagtcagattttgaaaactttcaacttttcatctcaaatttgaaaaactttcaactcaaatttgaaacttttaacccatatttgaaaactttcaacccagatttgaaaactttcaacccagatttgaaaactttcgacccatatttaaaaactttcgactcagatttgaaaactttcaactcgagatttgaaactttcaatttggattgaaaaactttcaagtcaagatttgaaacttttcaaatcaaaatttaaaaactttcaactcaaaattttgaaaacacatatgtttaagattaaaaaaagtcaaaaaaaatgtgaaaataaaaggctacaaataggagaaaatcgaaaaagaaaaaggaaaatcgaaaaaaaaggcgtcgcgtggaggctgccagctggcgcgcgcgtgccaaatagcaatcgcgcattaactttaggtatgaaatttattatgctaacgatgcggtagggttttcggaccgactacataagggctttcgacactcttatactgccggtttgttggatggtttggaagaagagaaacgtgcgtgtgtttccagaatcagagccgaagctagggttttcaaagatttaggtgagtaacatcttattgtaacccgtctttctttctgaaagttgctattgtggcaacctccattcacttcagcagcctcttgtcgaagcctgaattctgtatatgtgtatatactctattcttaagtaaatttggtcatgctaaaaaaaattattaggcaaaaaatttactacggtcctatacttttaaaacgagttatttatttataaaattcatgtaaaccttctaataaaaatgcatgtaattgtaagcttcatctgttacgtacacacgagaggtggtgcaagttttatggcgtgaagtgtgaccgcaacgacatggtccggcacttcaatgaattcaaggactaagcaggcaagcacgcggtgtctacgaattcaacaaatccgatcaatcctaaacccagatgctcggccaagaccccaaagatcgattggatcgatgaagagtgatggaagcgctttggccgcccttcccctcctgattcatgcgcctctaactatccccgtcggcgccgttgtctatctctactgtaatatggaatttccttaaagcatgaagaaaatttgatgttacaatcttatcaagttcaattgcatcaagacgcttaatttctcacatgccttgaatcgcacagacttttaagttaatcagtttggcatgctatctacttgttttattaagaaaattgttaaactggcctctacatctaaaatagattacacggccaggctgtcatgctactatgtaactggagttggttgaaaaactttatacatatctagttcccttgttatgtaataatgcgattgattctgccatcattattgaatcagtgactttctaaattaattagggtatcatgttatacatgtaattggcgttggttgaactatccagttctgtgatagtgtgaatatgtaatgagaatcgtcgaatagtattttttttcttctgtgaataattatgtgagctccgataactaaatagcacttgttgactaactgatgcgggtaactgattaatttcctagtgttttgttgtttatagaacaatcccacaacgtgaacatcgtatggccctgtctagatcctccaaaatggcaaaagttttgctattttgtagcactttttgccattttggatctaaacattagtagcaaaagttggcaatttggcatttggcatttgctagtccatagtagcaaattgtaccaaaaagtgctttgggaccactccctctctctttctctctctcactttagtgctagaatggcaaaactttaacatgcatctaaacaccaactagtacttttacaataccaaaacttttgacaccaaaacttttgccattttggatctaaacactagtagcaaaagttgacaatttggcatttgtcatttgctagtccatagtagcaaattgtgccaaaaagtgctttgggaccactccctctctctttctctctctcactttagtgctagaaatggcaaaactttaacatgcatctaaacaccaactaatacttttacaataccaaaacttttgccacaaaaaattttgccatttgtcattccaaatggatctaaacatgccctaaacaggcccttagatcctccatttgccactttgaagcaccttttgccattttgatctaaacactagtagcaaaacttagcaatttggcatttggcatttgctagttcatagtagcaaattgtgccaaaaagtgctttgggaccactccttctctctttctctctctcactttagtactagaatggcaaaagtttaggatgcatctaaacaccaactagtacttttgcaataccaaaacttttgtcatttgccatttgccattccaaatggatctaaacaagaagtaaagtgctcgtcgcgtattgctgtggaagttaagaagaataaagggaaaaagactaattcccctcatcgaatgaggggttggagagtgggccataatgactgttgctactggcattatcgtgtggattcatatgaggatgaaactcacatgtcggcagctataagcttataacggcaataccgttacaatagagactctcagcctatggaatggtggttgtggtagttgagtgagaagagcgtgacctgtggaacccaatttagcaagcatacgcaggaaatatggtgtgccacattttaccaataaatatttggcatcctgtgactttcttccaaacatgccctacgttgttggaacaacggggagcaactgttcagaagcaattgttatcagatcatcactgatcagcaggtcagggcgagcgaggatatctgactgtcatggctgtccgttgtgtgctggagtacaactgtacaaggcgcaaacgatgatcaggtcctggccttcctggctgtccaaagcctcaagctgtcatcagctagcttcactgctccaactccaagcatcacatgcccagtctcgctacacccacacgcacagattgggggaccagtgaggagccacacagacacttgtgcaacccctcacatgcccaaagccctcttgctttcctaccaactggtcagtgcaatccagcaatgcacagtgcatcacacgcttgaattgttattacaatcaggtcagcagcttaaaccaccgtgcaccgggtgggcagcagtgcagtgcggtgcactacaaacttgatgcaagaattggctcaagaggtttgtattgcatggtatattgggtcaagctatccatagtgttgtacattctgtgatcaatataatgaactcctgaagtgtgaaagaatggattgtagcccatggaagcaaagaacatgactttacaaaaggggaggaaacaatgaaggcaaaaaaaaaaaaaactgtggggggttaatactgcatcaaaccaaggggggggggggggggggcaccttgagcgtctagagcgagcgccaggaagcaatgcttgaatcagacagaaagaggagtaccccaaaggctatggcaaatctgagttggccaacccccccatggctgtcggaccttctctggatgcaaaatcctgtacattcaaacacatttgtcgcgattattcaggggaaagaactttgtgcgtcagtgagatattaaaaaatgttctatgcagacatgacccaagcatgaagataaacaaaatgcatgacgacatgacccaagcatgaagataaacaaagcacacaaaagcaaatagcagtataacatagctgacctgcaggcggtgcatcaagtacatcaagaataagtgcacaaacacctggaacagagatatatggattcaattatagatcaaccttcatatgctaaaaaagcaagaatacaggaagtaaaatctttgcagttcttaccagatagaatagaaggctgactcgagcaacggggtgacgccacaaaaatctagttgcacgtacagctcctgaatctagtaacttcgcagccttttgtaactggaaaacagaatatgcaaggaaagtaaggtaaaattcaatattcagggtgcagcccttcagatttccattggtcatgtatacctgctgatttgctgttgccatgtgtcgatgatgtagaggaagaggcctgcaaatagtacacttaattgtctaagacaacagcacttgaaaatataaggaccattttaaacattatgtgaatcatcaggtgtgattgagaacagaaggtttgctcctgtttccctggatgttcagaacaaaagagaaatggtgaacgtactccagtgccttgatatcagcatcttcttcccatgctgatgctgatctgcgagcaactctactcctttctgcttccatctatcacatggagaacataatggagtaagataagaacatatagatgaaattgattgcagcaagaacattatgacaaggaaagaaatttaggaacctgcacttcatgaaactgctttattgatttctccagttgaaactccagtgcagccttttcacttgccatggattctagttgtgtttgcttgtggtactggaagaatggatccatacataaataaacttggtcttattaatctagatgtcaaaggtaaaaaaagaacaatgatttgaatcatagcataccagcaagtcagtgagctcacgatatctcttctccagttcaacatgctcctaaaaataagacatgtttacataaataaatgcgacctgtgagaacaatctggtaataagctgaattactgcagaagttatattaaccaagctagatgttcgattatctaaacacaaacatgaaaaacccatataattgttagatgtattgtatagctagctgtgtatttactcccttcttgagggtgctttctgcatatttgtattgagctttgtgtatacctgtttggcccagttggcccattcaatctaaggtccaatatttgcaacatggtatcagagcatatggtttagggttccacatccgccgtcgtcgtgaagctctctctctcctctcacgcgactggatccctcttctctctcgcgcgagcgtcgccacctctgccctgtgacctcgcctgtggtcgccgccgcgccgccagtgtcgccgccgcgcctctgcctcttggggtcgccgccgcgccgcctggggtcgccgccacgccaactggagtcaccgcccctcttgcgggcgccgccttcctctgctcgcgggcgttgcctgcccctgctcgcgggcgccgccgttcctactcgcgggcgggtggccacgggcgggcgctgcctctgctgccgccgcctgcttctccctcatcttccaccgtctaaagctactgcctctactgtgatggcgccgccctcgggaaaaccgggtgccatttctcttccgaagcctccggtcatcttcaacggactcaacttccgggagtatgcattgcatatgcagatacacatgtgcagccagcggttgtggggctacctcatcagcgatcggccttgcccgccttgtccaaccttgcctgctgagcctgccatcccggcatatgctgatgagaacactaagcgtggtctccttgatgatcttgctgctgctatggaggcgtatcagatagatctctctctatatgagacttggttagagcaggaggcctatgccaaggctattttggttgggagcatggaggttgacatatcactcgacattgcgggccttgctagctctgagttgatgtggacccgtcttcgccagcagtacgagcctcgcaacgatgccatgtttcttgccattgtgaatgaggcacaatctcttcgtcagcttgatgccactgtggatgagttctttcgcaagatgtctgcggtgtggcgtcaaatggacctacagggcgctgatgtttgtcacacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctagtgctcctagtactccttcaggcattgtttgcgggtactgtagcaagacagggcacaccgcctctatgtgctacaagaagaagagagatcagagtcgtcgcacctctcagggctctcgacagggctcttctcagtcaagctctcagcagatcacatcgaccgagcaagagcttgtaaggctccttcgtcgtcttatgactacagcctctacctccacccatgggtctgctgctcaggcttctagtcttccaccaccacctccatcctcttcaggtatattgtcctcgtggtttcttgattctggtgcttccttccatatgacacccgattccacacatctttcttctatgagtcctcctgatacccctctcacagttcagacagctaatggcacctcacttcctgttgttggtcgtggcacactttctacttcttcctttcgagttcctactgtctctcatgttcctaagttaaccatgcagcttatgtccgctggtcagatcattgatcatggttgtcggattatacttgaggctgactcttgttgtgtccaggatcgtcgcatagggctcctggtgggaactggtcctaggcgccatgactctcagcgtctttgggagcttgattggctacatctcccttctgatgcttctaccagccagtcagtcggttccactgcttcagcgttagctacttcatccactactacttttgctcagtggcatcgtcgtttaggtcatctatccggtgctagattatccacacttattggtagtggggtcttaggtcctgtttctggagataccgctctacattgtacgggttgcaagcttggcaagcagctgcaactcccctattcttccagtgcctcagagtctcagcgtcctttcgatcttatacactctgatgtatggggacaagctccttttgtttcgaaaggtggccattcctattatgtgatctttattgatgactattcgagatttacttggatttacctcatgtcttctcgtagtcaatttctttctatttatcagaagtttgctactatggttcacacagtacgattcttccatacaggtttttcgtgctgactctgctggtgagtacatttcggcagcccatcgccgttttctagctgagcagggaacacttccccagttttcttgccctggtgctcatgctcaaaatggcactgctgagcgcaagcatcgtcacattcttgagactgctcgtgccctcatgatctcctcgcatctttcgcctcatttctgggctgaggctgtctccacggctgtttttcttatcaatcgacagccttcttctgttcttcatggttgtactccctatgagcgcctatttggtacacctcctaggtacagtcatcttcgatgctttggttgtgtttgttatgttcttctttctcctcgtgagcgtaccaagctgactgcccagtctgttgagtgtgttttccttgggtatagcactaagcataagggttattgttgctatgatcctgttgctcgtcgcatgaggatatctcgtgatgtcacatttgatgagtctcgtccttactatcctcgctcttccacttgtgatcagtcctccactgtcaagtctatctcctttttgactcttccggattggtcctttccttctctaccaccagttccgtctccatcaccacacctccctttggtttctacgccatctccatcactgtcaccacctccttcgccgatgccatcatcacccatactaccatcaccacctcctagtactcttttagatgctccacatgagctatcaccttttccgctgcactactctcgtcgttcacgaccccttgttgagttgtcctctccctctatccttggaccagctcctgctcctgcttctcggtatgatcttcgtgatcgccatgctattaggcctgcgcctaagtatggctttactgctgcggctattgttgagcccacgacttaccgagaggctattgcccaccaggagtggcaacaggcgatggcagaggagattgctgccttagagcgtaccaagacttgggatgttgttcctgcacctactcacgtcactcctatcacttgtaagtgggtctacaagataaagactcgctctgatggctctcttgagcggtacaaagctcgtcttgtagctcgtggttttcagcaagagcatagtcgtgactatggtgagacttttgctccagttgctcacatgaccaccattcggaccttgttagctgttgcctctattcgtcagtggtccatttctcagctcgatgtcaagaatgcctttctcaatggtgagctgcatgaggaggtctatatgcagccccctcctgggtattctgtccctgatggcatggttcttcgtctgtgtcgttctctttatggtctcaaacaggcccctcgtgcttggtttgagcgcttctcctcagttgtcactgatattggcttcaaagccagcgaccatgaccctgctctctttgttcacacttcttgtggtcggacccttcttcttctatatgttgatgacgtgatcatcactggtgatgactctcggttcattaatcttgtgaagaagcgtcttagtgaccaattcttgatgtctgatttgggtcctctcaggtactttcttgggattgagttctcttccatgtcttctggtttctacctctcccaagagaagtatattcaggatctccttgctcgttcgggcctcactgataagcgtgtggttgacactcctatggagcttgggatacatctacggcccaatgatggtgagcctcttcaagatcccacccgctatcgccaccttgttgggagtcttgtctatcttggcgtcactcgccctgacatctctcagttcacattctgagtcagtttgtttctgcccctactcagctccactacactcaccttcttcgtgtcctacgatatcttcgtggcactatctcccatcgccttttcttcccttgctccagttcattgcagcttcaggcgtactctgatgcgacttgggctagtgaccactctgatcgtcgctctctctctgcttattgtgtctttcttggttcctctctgattgcatggaagaccaaaaagcagactgcagtttctcgttcaagtgcagaagctttgttacgagctatggcagccttgaccgctgagatcacttggctgcgttggctcctggaggattttggagtttttgtctctcccccgactccactcttgtcagacagtactggtgcaatcagcattgctcgagacccagtgaagcatgagctaaccaaacacatcggcgttgatgcctcgtacatgagatcgcaggtgcaaaatgaggttgtggctcttcagtatgttccttcagagcttcagttagcagatttcttcacgaaggcgcaaactcgagctcagcatagttattttttgtccaaactcagtatggttgatccaccatgagtttgaggggggggtgttagatgtattgtatagctagctgtgtatttactcccttcttgagggtgctttctgcatatttgtattgagctttgtgtatacctgtttggcccagttggcccattcaatctaaggtccaatatttgcaacaataatttggctagtgttaacaaaataacatcaatgaccagcgagacaagttcacctgtctggaataatgctctgcatctcgtttcattccagccatttcaactctcatcttctgtaactcagcctacattacaaacataaattagtaaaatgaacaagtttcttaaggtaaagcattatatattactatgccatgtataataaatatattgtaatataatatcctccaatgtacttggtcagcatattaccagttctattaccttgacctggttgcaacttaacaaatttaagctatgcatatccaatggaacatcatgaattgatataattctctattattctttggcatcttatgaaataatagtacctccaaagatgatatcttggtttctgcctctctttggctttggcgtgcacgctcaacctcctcatgccatgcttgcatctgtttttcaaaccgcagtggtaagaaaagaacaaatacccagaatgttatatttcaggatataacttgactcaaaaaatgcagttagccatttgcagggtaagtaacaattatatttcccttgtgcaaagagcatttcaaattgaactagagtacgctaaaagcacagctcaatatcaagctgtggataacatgaggcgctttgattctaacctgaataacttgattagcttcttcagaaggctttttctgagcacggcgattacgagcttccatctcctgtagttcttgttgcagcgatgcacattcaacctatgacatatccagagtactgacaatgactagcacaaacaaaccagttcacatttcacacgaaatattaaaaataacttacctcaagcacagccaccttgtgttccaattccattgctctagatgagctttgatcagcagctctctggacggcaacaaaacagtagagatactaaatttgctatctttttataaacacgataaaaactgcaacagtttatccagagcaatgatagtgctggaaggttagagatcaatggaaatacaattttagtagaatataaacaaattagcttattataaagtataaggctgtgtgatttgatggaaatatatcaaaatgatagatgctgaatggcgcacatcatgggaaacatataagttgccaaactttctatctgaagtcctgaattactgtttcttacagtaactgttctgatcctcgctttaaggataaaactcttaaataaaaataagtaaataacgt

SEQ ID NO: 917 - DNA, 15125 bp, Oryza sativa
  unsure (1)..(15125): unsure at all n locations
ataacagaatctggctaaggtatatggtcctttaggctgtgttcttttgttcaagttctcaactcatctccctcgttttttcgcatgcatgctaaacggtgtgttttttgcaaaaagtttctatatgcaaactgctaatacttaattaattatggctaatacagtaattaattatttgagttgctctgttttgcgtgcgcggagattagttcccagacacaaggaatgaacgcagccttaatgtgtcaagcatgggagattaactagaacaaaacatctgctcaacaccattacgcaattttctggttagtgttgattttttttcggccatataacttgacatcctagcaaaatagattttgctcatgcctggtagttataccttgtaaaattacctggattctagcaagagcatttgatgcttcaacagctcgatgctctaattcgacttctctctcaacagctgcctgcattatagtagagactattaaaactaaacagaaaaaacaatgagtaaacaatgtagcaaatagaatataatttgacaaattaccatctttgtagcattatgtgcaatacgctcctcctcagccctgcgctctaccgtagcaagttcctctcgtaaagcctaaagagtaaccaacacatatgaaggtaatatacctgtatgaaaatgtggggacagaattttctactcgaagaaacctttgttactaacctggatgaccctagtttcagtaagttcacggttcctcttgagaccatccatatcttcctggtttcaacagacaatgagattaatatgtactgagagcatcaattgtgtgactgagctataaaacacaacaaatgttcaagaccactggacagccatttcgtttaaggtatgtttctagaaaataacatattattaagttaactgctgcagaaagaaactgcaagacttaaagtgatatctaacaacatttacatgcatattcttttttttaaaaaaaaacatgcattttagatttgatggctcgccactgcccacactggaacaaaaccagatgaacctcataactctcagacctaaaatacagctagggagcagattttccatgattttgttatgctaaattgcaatcatgacctagaagaatctaagatatgcaagagtggatgatatcaaagcaccaagaatccacatcttgaattcttggaatgactgtgaaatttccagattcatcttattccaaataattgagtatgccaatcttcagaccttattctcaagaaatttaaaagggtactcttttttttttagataatgggtaaatcaggcctttgcttcagtagaagctacagccaatgattacagtgtttgcagcaaccaagttgccaacaatgtcaaaacagaagacaagaacatataaaaaagaaaatcctggatgaaagaaagctcatgttacaaagcaataacaattagatcaagacagccacaacacaaaacatgtacttaacatagcaaacataagaaaatgtaagcactgcattagtttattttaagctattaaaacgacaaaagaaccaggaaagtgtgaaaagtgttgatggaacccatactacaaaatgaactatattatggatttatgataaatgatactaggacacaacatatagtttccttttggtcctagtagtagtaacatggctactatgaagaaatttctaagaagagcaataaaagatgaaacctgtaaagctgcaagcttttcttctgaagctgctgcctttttcttccaagagtccagtgacttaactagagactcaatctcagcgttttttgcagtcaaagcatcaaccatgttagattcagctcgtgaaccttctactctcgacattgacagttcttgctgtagttgcttcatatgagcttcatatgagctacatttctctctctgttaagtgttttacattaatacatagagaaaacaactatagaacatatcagcgtcaaaaactatagaacatatgagattaatgttaatagaaaatgtaatgaaaagaatgttggtaagatgatttgacctcctgaacaagaagttcctccagctgtgcattctcagatttatactcctggaggcgggatgaaagtccagcgcagacctattggtagtaacaaataaatctacaagtcagcatatgaactagccacaacatagataacaggcagggtcaaacttatactgctcttacccgagctaacctagcttcttttgattggccagttttcacaacattctttaacaaaccccgagcctgtcaaggaccagcgagacatggtatagtgtagctgtgcggaagagaacacataacatgcaggatatcttggattactacaattttccacaacctacctcctcaagttggtcttggtctttcacagaaccagaatcaagcttatgttcctgctgattttccgtactctccggtgagtcagacaaaccctctcgtttggaatcttgggattttccagaaacttgtgtgtctggtacttccttgatatttttctcatggataacttccatagctgagtctttctcctccaaattaacagctgaaacgatctcagcatcctggttactgatgcttggctcacatctttcatctggaacggaaggagcagagctttcagcagcaccctctgaatttccagaatctgcagcaccatccacaacaatggctgcatcctcagcacttctctctgttgattggacttcaacctcagtatcaacaacctctgcacctatatcattcttacgatcaacgacgaccttctcttctttctctgctccaccatcatcatccagtcccttaacatcacttgaggagacatcaggtttactggcactagcgtcgacgcttgatgaatcaacaggtggcgaaggcctgatcttctcaatcttaatccgttcccgcggtggttgcctactcttcctctctttctgagcagccgtcctgctaccagcatccccagttgcaagcttcaatggaccctgcgatgcaatttagcacaaaatgtaaaccattggttcccaagcacattttgtatgcacaaggaggatactcagtcacgaccttctccctcagctttcccttcttcgcttgaccttcttgactgcttgaaccttcaccaaacaaaaattagagattagttcgctctctaagcagcaaaccatgcactgactaaaccaaggagaaaactacctgaaggctgagggctagactgctcatctgacaactcggtagccacaatcttcgccctccggtcgacaacttcaagcaagtctgacacaaaaaaaaacaggtaagttgtactgctccccgttaccaacatccaatagcgtattcaagcaagcaacaagacggatacgggttcggattgggtgcaaatgcacgcggcgcgccaaaacgatcggacaaagcacagcgccaaggctagttcgctaggtttagcgactggcattatagctccaggagcaatcgagtaaacggctggcacgagagtagaggggggacaagcgccaagatctcagtcgcggagaagcggtggatctgggcggcgaatcgggaggaggggggaacgaggacaagaaggtgggcgtaccttcggcgaccttgagccaggaggccatggcgggatctgccggatcgccgccaggcgggaggaggggtgtgggccggcgcgagtgacgaggagcttggatggatggatgaattggctggtgagatctccggccgcggcaaggctgtggggttctaatggcggtactactacgggttggtggtggcgggggacggatccaaccggtcgctcggttcggtcgacgatgagaaaactagttcgtgtgtcatatacagaagcccgtctagctcagtcggtagagcgcaaggctcttaacctggtcgtgggttcgagccccacggtgggcgtgtggctctttttgcggggaatttttctttcgctccttttttttctacttcctctgttttgatgaaacggagggagtataatccttctttgagctcgtgtaacaaatatcgttgcacttttttgagcagtgattatttttgagcaataattcttttgctttcctttttctaatccttcaatgatacttcttgttttctctctttgggataatgcccacctgtattttcattcatataaacaaaaggatgagaaaagttttaagttactgtaggaaataaacgtgcttattggcgcgtctgttttacagcccgtgcattcgatttcaggttattaaaaagctatggctgtattttaaattttttatagatatatactttggaaaaacaattgtaaaatacgtgtaatggagcttttgttgattttcgaaatgacattattttaagtacaggggtagtacaaattttgcaaaattttataagaattgaactgaacttaagaaaaaaaaggtatattcaaataaattttattttaacttagtttaacataacaaagtcttgacattcgtctccaaccgttgagtagaggcgcataggggtgtcacttgtttaatttactctgttttatatcaagtttaagctaatgtgggtatctaaatttgtattgaggggtgtagacatggtttnnttnggttnnttatngcttcnnntttttnttntcngnnnnnnaggnnnnnnccctccccccccccccgcccccaatactctagctccgccctggaggcgcggccaaactgcacacgtgacaaagttcagcaccgaccacactgacgctaacatacccgacctcaacaccaagcaatttgacgctgagattggggacttagcccctcaccccctcgcggtgaaggtgtactagagccgaaggtcagcaccaaacgccttggcgctgaggtggcgaagctcaggccgatcaaattgggacccacgtgttctttaattgggacccacgtgaataaaaaaggaaatagagattggccactttatttctgggagcaatgatatctgacatgcgggtccaatatacttttttctacactagcactgatgcctgtcactatgcttaaattcaacagggagaatcttgcaatgcgtagaatcggccttatcaccttctctctctcctatagaaccctctctaaattcaacaatgcacatgctctaagattaatcaggcgccttaacagagaaggtgttcttgctatcatacagcgacattgatttgatagtttaacatatttccagacggtaggttgcagggttcattgcaaacttttctatgtagatgtctcttaaaactggcattgcccttagagggtcagtaagtaccaaggcgtgattaagatggttgttccaatagctgcccggccagaccgtcatacccttgaaacaaatggttacaagaacaatatacagtgccaatataatcaccatgacaattacctgcaaaacaaacaacagacaaaaaaaggttggtaactggaaataaggcacatcactgcaacaacaaaaatgcgaacagacgggaaaaggttcgaagggtgaaaaaacaggactaggatgatgcaggagttcaatagctagtggggtgatagtagtggagaaaaacaaaaagggggcatcaggaagggtttacaaaaccgtgtggttatcatgtatggtaaagtttttaaaattaggtatacctcgcgataaccatgcgattttcatgctaaccacgtgcactagtaaaaaaacaattttaacatacgggccaaaagtaattttcgcgtgcggaccttcatcccgtctgtctgaaaaggtctatgagaatcgttatttttccatacgggtggcgcacccacacatgaaaattgatttcacgtgtgggtatgaatgttgtccctatagaaaaataaaaccgggaaaaaaatcgcaaaacgcccgctgccgttccgggtgggggatggccgccaccaccgaatctgagcgagggagggccgtcgttgctgccatcgagctcctcccgcgttcgctgccagatccgggcgggggagggccaccgtcgcccctcgccgccttcgacgcgtggggcgcccgctggccgccgtgctcctgcccaccacccatcgtgcttctgactaccgccgcgcgcccgagagagagtagtgtgtgtgagagagaagagtatgaggaagagagggatgagaggagctgaggagataagaatagcttgaaaaaaaattgaaatgctaagagggacaagaggaggtaacttaaactttggagcggaccttaagaaaatatattttttcgtgcggctgcttaagagacccgtttaaaaaaatagctatatttttgcataccgcttagatttttcacatttgttaatcggatttgttaatttattaggtgggaggttcttttacgagtcggcccatcatatccctccgtctccagcgcacccttttgttatctcgggccccggccgtatttagcagcatctcttagggcaagtttaataagagagtaagcagccatctattagatgcttacatgtcatttctatatcattaaagataatataaaatttaactgagtcattaatttttctttcaatgtggccaaaccttggttctctctcctaggctatcgaccaatcacagatgctctttctatgtgggccaaccttaattatctctcacctattcttttcacctatcacagtatccatcgtatgcatgccgtgtctaggcgcccgtgcacaggcgtcgttaatttagtcgacggctgctctctctctctccactccctttttcttccagcaatgcaaaaagagcttatgtcagcggctaatagtaggtacattttccactattgcactagcccttagagcatcaccaatagattagcaataatctattccctaaatttgaattttgggtttcctaaactgaaaataggaagtgaaaaaactcattcctcaaagagatagcctaaattcaatcccaaaaattaaaagtggactattctgttaaactaccaacagaaatttcctttttttccttccatgcacacaaaaagatattaccatgacccgcatgctccctacagaaaaattcggcgctcgcgcgggaaggagagaagcgcggagaaggagagagaacgcgcagacaagagattgtgagtcgctctctcaccctcaaatccacataacgaaatatatggagatagaaactccaaaactagtgcaagacttttgggaatctgttggatctgatttttttttcactaaaaacccttaaaatcagttttgggaatgaaataggacgacggttggtgatactcttacgtggccgttgaatggtggccgttgaatggttgaagggctacgtgataccgttcaagatagcagtttcgaaccagacataccaaaataatcagcgaaatttctttaacctgattgaatacgtcatgtacaaagttacacatattctgttagtggaatactgtatttagatgcaacatcagtcaacagtaacctatacaattgagtacaacaatattggtgtaatggcgatcgaaccgtcaaacgtatggcatcgtgcagctctcgaccctgccgatctgcttggaggcgccaccggcggcgcaggcatccgctcgcgcggagcgatgccggctgaggcagttggtccttgcgatgtcgcgcatggagcgcacgagcgacagcgtggggttgagccgcacggtgcggttgaacctgtcgcagagcgacgcgtgcgactcgacggcctcgcccaccgtcagcgccggctcgcgccgccgccgctcgctcacggcctccgcgcacagcccgcagaccagcctcccctcgaagcgcgcccggacgcggcggacgtatcccggggtgcaatcctccgccatgccgcagcactcgcaccgcacgctccgcgcctcctcctgctgctgctgctcatccacctcctgtagatcacaaacgatgcacggcacgatcggtatccatgccaatggatcggaaaagcagtgggataattagaatggcatggttaccacttaccgtatgggcctcgagttcgacttcctcgtcaactaaacgcgccgtataccccttcatcgtctgatcggtcgtcgaatcttccgagctctgccaaccaatcactagtccgttccactatgagtctgatgcactttacggctttgcctgtgttgccaggaacatgtgtgcgcgcctcggctatttatagacccggttttcaggtgttaccgtcagggccctgcgtgtcgagtgcaggagcccctggccaatgcccatcctaggacgtcgagatcgcgccccgtgattggcaggtgaattcggttttgttgcggcagagagcctcttggttctgctattctatcagccacccggtacgtgtaacatgtgaagatcgtgcagcccgtgacagcatgctgccggaaacagaaacaggggacgaccggccggcagttttatctgccgtagattaattctgcgggcgcaccgcgtggatgcaatccatcgtataatccagccagcttaatcatcggtcatgtcacttaactcacttcacgtttcacttgttccggagcaaaggctaaaataggacagctacagctaggacctgcatggcgctgtagggaacgatgagagtgagatgactcggacagaggcacctgatgactgggcgggtgaagtggcatcacttgaatagatgcaaaatttgcactgaaagtctgaaagaaacagatcgatggatctttcatggttaccgtgcgccaaatttctgagtgagtactctcttgctgaagtagtactagtagtaaagcagagtaagattcataacgaactatcgcgagtgcagatgatcaagtgcttcatcatgttcttaaaagagaaaaaatctatgtcaagaacgccttatcatttgcatgacccacataagaaaaagcaccgtcacacatagaaacaacttgacaaaatcacgagattaacttgaaccaggccacaacagtaaaagttccgtgccatgatagcgaagcaaatacctgggtttctcctgatttcagtggcgaaattactgcgccactgtagagggccatcaaacgtaacgagcaggattatatgccactattgaggctgcggcatcgatcggtcgccgtcgcagcttgttgtgaccttaggtcacgaacaagatcggggataggccggaaagaagtgttttcccgcctatccttagaaactagctcgaacagcaaacacaacttttgaggattactcttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaattcgaattcccctttgccttctctttcatccttggaaaacacctgtgaaattgtaacttgtccaaaatatgtgtagttgtattagcgattatgggatgtccctaaaaaggtgttcttcacccgaagaggtattttctattcgaatgagtgttcttcctctgggaaggtattttccctttggaaaggtgttcttcctcttggaaaggtagttcccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggccgaaaccgtgcctgagtttatggaaaaagggggaaaaccgccgtcctcctattcggtcgaaacacactattcaaatatgcatatacgccacgtttactattcatttatttttattcttattatttttcatttttatttatttttatttatttatttatttatttatttattttttgaatgccacgtgccggtatttcgttggtgcgctcaaggggtcgcgtcgcttcgggtttcgcgtccgctcgtaaacccgcgacccttaccaccctgcgctatataaggccaggaggggtcgctatcacgtgacccacgccaccactcgtttgctctgccatcaactcgaaatcacaaaatactcgaactaaaactctttcttccttcttccatttgagttttggtgctttgcttgatttcttcctttctcactacacagcatggggaaaaacaagaaaactgcggaaaagtcgaagtccaagaaatcaaaaagccacgaagatactacttgtggtattggtgcctcttcgattaaggaaaaaaacttaaacgatcttgttgatgttggttggatatctggtcgaaacgttgtaattcgaccagtgggagaatcaaggccttctcctaagctgggatacactcttgtgtttgaggatttcttctacgccgggtttaaattcccatgcagcactttcttggttgaggtcctgaaattgttcaaacttgagtttcctcaattgactccgaatgctttagttcgaattgggctttttgaatggatgattcgaagctgcggtgggacccctcgagctgaagactttgcatacttccattgtactcggcattacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctcttagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatataactctcggagaaatccccgaaagttgcccttccagtcttcctccatttgtggtttcgtctgatcgtaagtttccttttcgaactgcaaaccttgtttgtcttgaagaagtgatttagttaagaagatttattttctccctttgttatcttcttccttgtagttgtgattccagaggatatggtccgcccagttcggaaatttcttggcccttataccaaggacgagcatttgaaatttttgacacttcaaaacgggaaaaggcaaaatcgggtcttcgcttctctaggctccgatatccctgtccgcgttcatcccgaaattgtccccaaactaaagaaaaagaaatctgtgaagccctcttcctctgatgatgatgatgatgttgaagtggaagatgttgacgaagaaattggggaagaaaatgctgaagaagaagaagaaggcgaggaaggagctgatgaagaagagaacgactcgggtgatgatagcgactcgagtagcagttcgagcgacaactcgagcgactcgtctgattctgatgatagcaaaacagttcctcctcctactgttttagctgatctgaaaaggaagaaaactgccagcagtcctcctcctggaccgagttctaaacgagtgcaacttgttattgataatgatgaagatttggatgaggatgatatccgtattgatctttctgccatccatgtcaccccaattcgagctgatgctagttttgccctttcggcaaaagaagtggcttcactgcaagttgttgccccagccaccacggttgtcgaggaagattgttcgacccaagtggttgatactgttgagacaacaaaccctcttcgagctgatagagacttggttgcaaaaaaggcaaaaacgcccgtcaatgcagccgaaaaaaccgaagcagggaagagtgctgctggtggaggtgttcgaactacatgtagttggaacccaactccacctccgtcaccgccgttcatcgcaaccccttccccagagctgatacaaaacgttcttggtggttttagcgaacgatgcgcaaaagatggacattggcttatgggtcttcctaatttcaatgaactcggggaaagtagccatcatggcccaaacttgtgtttgaatgacctaaagtatcgccaccccctgagttcgattggtgatgaactcgagaagattctgattactcctgatcttgaaaaggagtttttggaagaaaatgatcttatgtcctcttggacagcacttgatgtatctgctgcacaggtatttctatttatttattattattattatttatttacttattattattttatttattttttttgacttaaaaacctattttctaatgcgcagactgcaagccttgctcgtcttcaacgtggtgttgctcggaaagctcttcgagcgctttgcacgcgacggaagaaatcacttgatcgcatcactaaacttgaaaaagatcgggattatcttcgctgcaaacttgatcgaatggccgacgagaagaaaatcaccaccgatctcatgcgcgagttaagcggcgtaaagagagagctttccgaatgaaaagaagttgctgattgagcaaaagaaggtattactcgctcgcgaaaaagcattcgaccgaaagctcattgagtatcaagaggtcgcacgacaacgcgctgaatcagaagacaagatgaaagagcaagttgaggtcttggagaagaagaataaagaactcgaacttgcctgcaaaaatcaaaacgagaagatatctgctttagagctcgagagcgaaaattgccgccaacttcttctgaaaagttgcgagaccgttcgaatcgcgttgcgaagtctaggggctgacatcagcttgctatcggaagaaaataccttagcagctgtgggaaaatggttcgaggaattttccattgggctaaaagatagtgttactccctttgcatctcgctgctcgaagactgctgtggagagcctttcggcctgtctgctttcaaatgggtgtgaacactttaccacccttaaagctgatatccaaggtatgcttaatgatgaagccaaatttgcacagcttcgagatgcagctcaacccgtcgtaaaggctttccaagttctttactggaagaagaaaggatatgaagataccctgaggtctcttcgagcatctcttgcctcaagatcaaaatcacagctggccagttcgagccaacaagataaagacagtagtactccgagctcgagcgcacaggtgtgacgttcgtaaaaagaatagttaaggatgcttcgcatactcgaaaacaatgctattttgctgcttcaaagccgttatggttgagagcctttattgtaaaaatttatagtgtagctgactataatgcttttctcttattgcatgcttttcacggaaattccctttctttggggggctgcaggttaactcgaatcgaaaacttgtgattcgacgcaacaacactttgcctactcgaaatgtgaagcacttaagcatttagagaccctgcaaagctttcttctaccaggaccaccatttccgatgacgaactcgaagcctgttatgataacacttgtatatttgcttttaagtttttccgatggcaacgaagccatcgacatgacagtttacgtgactttgtactcgagtttagggaacggcgttcgaacaataagcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacatgcattttccgccttccgagctcaagcgaggggaaaatagagttcgagcattctttagttggttttttggactaaggcaaaaaagttcgaaaaccgccgtcctcctcacctttcgaaggagtgacgaggtcgaaacgtattttacctcgtcacgcggattttccgctttttgagctcgaacgagaatagagttcgagcattcctgagctggttttaggactagggcaaaatagttcgaaaaccgccgtcctcctcacccttcggaggagtgacgaggtcgaaacgtattttacctcgtcacgcggattttccgctttttgagctcgaacgagaatagagttcgagcattcctgagctggttttaggactagggcaaaatagttcgaaaaccgccatcctcctcacctttcggaggagtgacgaggtcgaaacgtattttatctcgtcacgcggattttccgctttttgagctcgaacgagaatagagttcgagcattcctgagctggttttaggactaaggcaaaatagttcgaagaccgccgtcctcctgtcgaaatttgctagtcgaatgtatttgactccgagcgtgcggagttctattttgtcgactttgctagtcgaatgtatttgactccgagcgtgcggagttctattttgtcgactttgctagtcgaatgtatttgactccgagcatgcggagttctattttgtcgactttgctagtcgaatgtatttgactccgagcgtgcggagttttattttgtcgactttgttagtcgaatgtatttgactcctagcgtgaggagttatattttgtcgactttcttagtcgaatgtatttgactccgagcgtgcggaggtctattttgtcgactttgctaatcgaatgtatttgactccgagcgtgcggag

SEQ ID NO: 918 - DNA, 3270 bp, Oryza sativa
  unsure (1)..(3270): unsure at all n locations
ttgactccgagcgtgcgnagttctattttgtcgactntgctagtcgaatgtatttgactccgagcgtgcggagttctattttgtcgactttgctagtcgaatgtatttgactccgagcatgggagttctattttgtcgactttgctagtcgaatgtatttgactccgagcgtgcggagttttattttgtcgactttgttagtcgaatgtatttgactcctagcgtgaggagttatattttgtcgactttcttagtcgaatgtatttgactccgagcgtgcggagttctattttgtcgactttgttaatcgaatgtatttgactccgagcgtgcggagttctattttgtcgactttgttagtcgaatgtatttgactccgagcgtgaggagttatattttgtcgactttgctagtcgaatgtatttgactccgagcgtgcggagttttattttgtcgactttgttagtcgaatgtatttgactcctagcgtgaggagttatattttgtcgactttgctagtcgaatgtatttgactccgagcgtgcggagttttattttgtcgactttgttagtcgaatgtatttgactcctagcgtgaggagttatattttgtcgactttgttagtcgaatgtatttgactccgagcgtgcggagttctattttgtcgactttgttagtcgaatgtatttgactccgagcgtgcggagttctattttgtcgactttgttagtcgaatgtatttgactccgagcgtgaggagttatattttgtcgactttgctagtcgaatgtatttgactccgagcgtgcggagttctattttgtcgactttgttagtcgaatgtatttgactccgagcgtgcggagttctattttgtcgactttgctagtggaatgtatttgactccgagcgtgcggagttctattgcagtcatacacagaggcatgttttttatacaggttcgggcctccattatggataaaaaccctacgtcatgtttatatacattaacttggatatcattcgtatttacatctgagtgagtatactacaaactcgagctcccgtgttctcctttttctctttctctctctcctctttttttttttaggcataaaatttcttcaaagaaatagcattccaagtatgctttaactcttcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcgacccttatttcatctagcatttcaagagttatctctcttccttcttcatctttttggtcaaatatcattcttggagaatgtgcccctacttcgcttggagtcattgcttcatcgccataaaccaatctaaaaggggtcatgccagtcgaccttactaccgtggttcttagtgcccaaagcactgatagcaagtcctccggccatttcccttttgctgatccttctaacctcttcttgatagcttccgtgattttaccatttgccctttccacagctccatttgtctgaggatggcctacagaggcaaagttgatttgcaaattaaggcctttacacatgtcttgaaattttccagattcgaattgctttccattgtcacatactatttcctttgggattccaaatcgacatattatgttcttccaaacaaacttttgtactgctgcagaagttattcttgccactgcttctgcctcaatccatcttgaaaagtattcaattgcaacaatgacaaagcgcagatctcccttcgctcttggaagaggacctactatatctattccccatctgtaaaaaggccagactggcggaattggttgcagttctttgggtggtgcttttgtcattggaccgaacttctggcatgctttgcacgtcttgatgtacttctctgtatctttcataattgttggccaatagattccttgtcttatgacttttgaagccactgaccgtggtgcttgatgagctccacacaagccttcatgtatttctaccaccatcttcatgccctcttcccttgttacacactttaacaaaggagcagtaactccacttttatacaactgtccctctaccactttgtatttcttggacgttagttgtattctctttgcttcttcttccttttctggaagttgtgcactgacaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaacaaaacgccttcatactctgctgtgttgtttgttgaaggaaaagctaattgaacagaatacttcaacgtttgcttcattggtgttttcacaactgcagcggctcctgctccggcggcattgcatgctccatcggagaatgctatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttacgtcatgcgatagaaaataatgcctcaactttcttgaagccatcacaattgcataaatcaacttttctacttctgagtatcgtgtttttggtccttgtaatgcttctgagacaaagtataccggcacttgcctattttcttcttcttgtaccaaaactgcgctaactgtcgctggagttgctgccacatacattaacagaggttgaccttttggtggacttgctaatgttggcatttcatgcaagtatttcttcaagtcatcgaaag

SEQ ID NO: 919 - DNA, 1120 bp, Oryza sativa
atatcgaccacatcaaatactatctcttcttttctcacattagtgcctttttcaaagaccacttgtaaagatatttttccaattgcatgtacttgttgtccaccaaacccttgtaaaggtactcctgcgtttgttaacctatcttctggtatttgcattttcttgaaagcatcgtaaaacagcacatccgctgaacttcctccatcaattaacaccctttgcacttcgcattgtgctatttccactgagaccactaaaggatcttgatgagggaaaagtattccttctgcatcttcaggcccaaaggaaattaccgtttttgagtatactggtgattttgactgatagcttgtcccgacatgatttacctgtctgacatatgcttttctttgcctttttgactcaactcccaatgaagagcccccagttatggcatttatcactctctttggcacttcttcaattgcctctatcttcataacttgcggtgcttctatggcattttgtcctcgttgatcacgagctccttcatacttgttctcatatcgatttacgtgtttttccaacaagtgggtcatttgcctgcattcttctgtggaatggcctcccggaccatgtatatgacaaaacttactgtaacattcttctgtggaatgacctcccggtccatgtgtttgacaaaatttggtttggtcaggtttattttctcttccttttcctctttcattgttccaccatcgtcctctacctctgcctgaattccaccattgtcctcgaccttttccagactgcccccaattgtttctccctctgcgagtgttgtcccattgatgttttcctttttctctttcattgttggatccatctccgataaaatttacctgttttttctgatcttgtttatagtcatacttgaactttttccagggctttccggtattctctcccttttgttcttccccttgggaaatttgcttgttctttgactgcttttttcccaacaagacggcttcttcctcttgcactctcaactcatcttcttctcctcttgcaaaactttccattctttcaaacaagtcttttgctgtttttggtctatttctagcaagatcaaaacgaa

SEQ ID NO: 920 - DNA, 23229 bp, Oryza sativa
  unsure (1)..(23229): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttaacccactttaaaaagagaggatggatgaagttaaatgttgacgggtttttgatgcaacctcaggaactggaggtctaggtgctgttctcaggaatagtttaggctctgtcattttgtcatttttttcagcctgcggttctatggagagatgtagcagccctcttgaagctgaacttttggcttgcaaagaaggcatcaatctagctctacaatgggctctgctgccgctcattatggagtcggattgtttggtcgctatcaatatgatccagtcaccagggagggagatgtcccagcttgcttaccttgtcagggacatagaagagctgctggcaggcgatagagtggtcagcattcagaaagttcagcgatgccagaataacataagccactttttagctaatagaggccgcactaattttctttctgagttctggccagatggctcttgtaatctcatttcacagtttgtgaatgaggaagctttaaatgagtaatatatctggtcttcctcgcaaaaaaaaactcactgaatatcaaaagctcatcatataaacatagcaactacatctataagttattacattttaaacctcaacatatgagcatcatttttcgcaatagtgatttacagtctctaacataaaaatttaactagatgaagtaccaaatttcaccggtacttgaaggtaccaaatttgcactaaaaattttggtatctcttcttatctttcgagaaacagtaaatttctcttttcacaatattttaacataaatctgctcattatttatataacatttaacgtgtattcaatcatatattttacagtaaaacttggaagaccgtctaatataatactatttcagggaacgtttgctttgaattactgtcgattcatcccagaattctcattaattttccacgcaatctacactagacaacaatagtttatttatgtcaacatcgaatggttcaaatcgagagtacctgactgactggggtgcgatcgtttgtgcagtggcggtggacagtttagtcgcacgcaaaatgagaaatacgattaacatattattaattaagtattaatatataatttttttatgaataaatttattgaatttttttaacaacttctttatagaaagtttttgcacgaaatataccgtttagcggtttgaaaacgtgctaacagaaaacgaggagaatctaatcctataaactgaaaagagcgcaccctaaagaaactatcagatcggatgatccattcagcaaggctcgattaacctctgaatgcacgcaaaaccctcttcacccgtacacacctgcatccccccgtcccgggccactggttttccaccgccctgacccgccaagtcgcgatcgcaactcacacatgctactgatgatgtacgtacggacgttacgtagcgcgcgggcctgacccggggcgacgactcctgcaggctgcagcgtgcgacgcgacaacgacgtgcgtagtggcccacgccccacgtaacgtagcgtacagtgtacacctgatttcgctcggtcgagaggtggagccgtggaggagtcgatgccgtggtgtgcgcgcgcgtcgcgccccaccaaccggataccagcaagctagcgagaggagagagggccgggggggccctaacggctgggcgcaacgtgacagcggaatccggacaagagcgcgaggccttttgcgccaaggaatttcgaccgggcgagattccaaccacattacgtacgtccgctgtcacccgggctgggcttagctatcttgtggcctatatatactcgcccttgacccgattacgttctcgtcccaaaccaaaatttctcatccttgccaccacagtgaccactccgcccgtctctcctcctgatcgctcgttgttgtctcttctcgcgcgtagagctctctgcactacgcaaagcagaggctaagattgatcgagtgccattttatatacaccgttgtgcatttccctcgcgtaggtgtggccatgtctcccgctatgctgcaggcgtcgtcgctgtgcgtatccgcggtgctgtcaggcgccgcgagctggccgggccgcctggccagccaggggcaccagggcaagcgggccgtggcgcagcctctcgcggctagcgccgtgacggaggcagcgccgcccgcgccggtcgtcgcgccgccggcccgccccgtcgacgccccgcggcgccgtggcggacgtggcggcggcggaggcggcggcgagctcgtggcgtggaagagtgtacggcaggagaggtgggagggtgcgctcgaggtggacggagagctgcctctctggctggtgggttaagcctcctactgattgcaaatctccctaaatatgacttgatttggcttttgccttctctccaccctaattaagtattcatgaacacaccataacctcagcattttataagatctgccggtggtcaagctaaggctagccgtgcatttttcattcaagaatgcgaatcttttctgttattttgattcaaaggtttcccagtactccatatcgctttcttgagatcatctataaactaaagatccttttgaacatcttagtaaaaaagcatgcacaacatcttcccacacattgagaaatacgaaaggcactttctggaccacatcactgtgcaacaaatcctttataattaacctaaccattttcatcttgtagcatctccttgattagtgcaggctaaccgctgacctagagcacatatatgcatatagccccagaagggtcctaaaaaggtaccagctttggccacgtacctagcatatttttaccagcagtatctaacacgccagggtatattacttgccgactgtcatttttaatttccactgtgccagcagttgctgaagcactcacccaaatcttcagtaatttgatcgacaaagaggagggcgacactaacttaccctatgctggcctagcgaaaaggagatggcatcttggcactcacgatgcttgcggggaacacaacatatatacccagattctctgctcacccctagcttcgatcggcgacaacaatggcatcactgtcttgtggttgcagttttgttgcaccccgcaactctctgaaaacaaaagtcaaaaaccttggtctcccctaactccaagtgatcttatcactgttcttgccaattttgatagtgacttgatttgaggaattaatacaggtgtacatgtagtataatattgttgtaactttgtagttacactcactaagctatggataatacaatcgtttcagctaattaaaaatgcaatcttctgaggtaagctcgtggatagattaatttgtcggtcgttaattagaggtggacggatttgtcgacgtgctgcaaatgattgatcggatcgatgcatacttgctgcaggatggcacgtacctgaggaacggcccgggactatggaacctcggcgactacggcttccggcacctgttcgacggctacgcgacgctggtgcgcgtctcgttccgcggcggccgcgccgtgggcgcgcaccggcagatcgagtcggaggcgtacaaggcggcgcgcgcgcacggcaaggtgtgctaccgcgagttctcggaggtgcccaagccggacaacttcctgtcctacgtcggccagctggcgaccctcttctcgggctcgtcgctcaccgacaactccaacaccggcgtcgtcatgctcggcgacggccgcgtgctctgcctcacggagaccatcaagggctccatccaggtcgacccggacacgctcgacacggtcggcaagttccagtacacggacaagctgggcgggctgatccactcggcgcacccgatcgtgaccgacaccgagttctggacgctgatccccgacctgatccggcccggctacgtggtggcgaggatggacgccggtagcaacgagaggcagttcgtcggcagggtggactgccgcggcgggccggcgccagggtgggtgcactcgttccccgtcaccgagcactacgtcgtcgtgccggagatgccgctccgctactgcgccaagaacctcctccgcgccgagcccacgccgctgtacaagttcgagtggcacctcgagtccggcagctacatgcacgtcatgtgcaaggccagcggcaagattgtaagccatcatcaatcgctgccgcccgtagtgcgttcccgttttgcctatttaattggttgggtgatctaatgatgatatttgtcgggacgatggccaaccgaaggtggcgagcgtggaggtgccgccgttcgtgacgttccacttcatcaacgcgtacgaggagacggacgaggaggggcgcgtgacggcgatcatcgccgactgctgcgagcacaacgccaacaccgccatcctcgacaagctccgcctccacaacctccgctcctccagcggccaggacgtcctccccgacgccaggtacgtacacacacgagccacacgacgacgtcccgccgtcaatttgctacgctacgcatgcacgtatgcacgatggatgacggggaacaccatgtgtagggtggggcggttcaggatccccctggacgggagccagttcggcgagctggagacggcgctggacccggaggagcacgggcggggcatggacatgtgcagcatcaacccggcgcacgtcggcagggagtaccggtacgcctacgcctgcggcgcccgccggccgtgcaacttccccaacacgctcaccaaggtcgacctggtggagaggacggccaagaactggcacgaggagggctccgtgccgtccgagcccttcttcgtgccacgccccggcgccaccgaggaagacgacggttagtgtcaccatctctcctcgttggctgcgtatacgtacgtcttggctttgcctcgtttcgtttgtaataacttgaccaactctgttattgatggcaggcgtggcgatatcgatggtgagcgccaaggacgggtcgggctatgcgctggtgctggacggcaagacgttcgaggaggtcgcgcgggccaagttcccgtacgggctgccctacggcttgcactgctgctgggtgcccaggaaaaggaacagcaagtaacacacacgccggtccatcccaacatgtcaccgccagtactgattcgtctctgctgcttgcgtcttgggtctgcgcatcgaatcacagtacaagtggaggcttggatttgtagctacgaaaatggcagcatgaatgcagtcaccgtttggtaggtggtctcagaaggaaagaaagacatacatacgctgcacgtggtgaactgttagtacgtgatgtatgaggtaccggaagatgtaatatacgtggaaatgaaactatagcgatctgtacgtgttaggctgtagtaattcacatgatgtgtaaaatgtgtacataaaccctccgttgcgattgttcgtactcctgctgtttaatttgtagtacagtgaatatatcttgtgctctttaaatcgaagatatctcgtgcacgtactagtacgtttttgcatgtactggggtcactgggccattgcatcagacatgtttgccaatttcagattgattatgtccgttcactgttgtacagaagcagtggcagctgaactttgaaattgattatttgctccacatctcaaataatatgttttattaaaaatatttcttctattgtaatatttagattacttacataagctatttgcttagtttatttcttaaaatattttatttatcactataatgaagttgataatctacgataatgtcggagatatgggtctgggggtatgtgaagcgtgggaaatctaccttcctgtcctgccgcgtgtccctacagcctggtcttgcccacgcaacccgcggatcgctggagcgaccggagggaggtcggggcctcggggtgccacgtcatgcccctcgggcctttgcaccgcttcgccccgaggccctcgcccagccgccatgtggcggagggatcgagcgaggagggggcccaggctgagcctccattaatgcacacaacgccccaactgccccatgccgcatttaatgcagtaaggcagacgtgcggtgtgcgaatctgacatgccataatcaaagaatgaccggtttgtgaccggtcatgattctggtcacgtctgactagaccgacaaccgagctcccacgtcacgtctgctcccaatgaagtgggggtaggtatgacccgtcccatcggagggtcattcggacggcggccaccacaagtcttcatccattaatgggggaatgacagggctatcccccatgtcaggcgagggacggcgctgggccccactcaaggacaagctgtggctttgcttccaagcgaagacacgggtcgagtcccggtcaagatagggtgggttcccacccgaaagaagagtaggtagaggcggtgcatgtggtatccccttgagatataaaaggaggaccttgcccaccgaaaaaggggacgactctcagaaaacctaaactctaggagaagaagagcgagagtgctctccggagttaaggaacccttgtaacagtactctatcttcaacctccaaacagtgaccgagccgtcccaagcctgtgcagccgtgccgcctcctcccaccaatccggccacctcgttgctcctttttccaaattagttgcgggaatggaatcctctcaatctcctcttccttttccccaagaaatccccaaaagtttctatggaaatcctttccaatttcggggttcaatctttccttactccggcgagaaccctagactttcccgagttttatagtcgatttgggctcggacccgagctcccgtgcctatataaaggaccccctagtcgtcctctacctatcccctcatgtctcatcttccaccgtcgtcggaatcgccctccccgcgagctccttctctctccgccgccggtagccgttccagccgccgtgcgccgtcgcctcggccgtcgccgatcagctccaccacctccctcggctccgcaaagtcgagctctatcccggccgctggttcttttgcgccaaatccaaccggagattggccgtcatcgtgaaccggagcgccgccgtgcctccaaccgcgtcgtccgtcatcgccttcggtcgccgtcgtctccattggatttgcagctgcgaggagaagcccatccgccatttgtcatccgccgaagatcaccggaaagtcatcgccggccatctccttcgccgttcatcgctgcgtaagtgttggtaagcatcgccgttgcctcctctttctcccggtgccctccgtttgcattattgtgccgtggttcgccggcaaccgccgctcctatgtcattcaccggtgtactttatccttagggtcttaattcaatctaatccgttatttgtctagcatcgtcgtcgtctccatgtgttgtcgtcgggtcaccgtcgtcatctctctctctgatcgctttggttcggtgagacttctatccgtgttccctcggtttagtttttaatctctcgtttttgtcgtcgagtagccgccgccgtgccacgcttagctactgccctagcgtcgccgctgcgctagccgcctagccgtcgctgtgccactccctgctacagccatgctgctactgctcgtgcgtgccaagtcgctgccgttccactaccatagccaccgtcgccatctgtcgccgccaccgggttcgcacggcggaggagcaccctgtccaccccttcgcagccgccgaagaccaccggagcgccgtcgccgtcggggacccgagccgagccgagccgccgtcgaacctcgtcgccggtcgtcgttcgtcgttatccgtcgttgttctttgtaccggtgagttcgcgtcgtcatcctcttcgcgttggtgtcctcggtgagcccggtcgagctctctatcgccggtggccgcgtcgtccagtgctaggccggcgatgacgtcatcgtgacgtcataaatcttttatttaattcgtaataattttctggattagatgaaaatcgattaaacttcggaaattcataactaaatcatcgtaactcggattcgagtggttcaagtcgctaaattcatctaaaatcgagatctacatgttaaaaatatccacatgtactgtttatgcttgtttttgtactgttttgttgattttgttcttttgctttagtttccgacgttccggaggagagcgtttttgttgaggaaggttcggaagcgtttgcggaagctcaaggcaagtcacacagatcccaaacaaccctttgagcatgttgaacctatttaaagctaatgttttatttcaactcatgcattattttcgaatgtcatcgggtggtgagcctttcccaattaattatggccgaagatgactttattttcctatgggtaataaatttattagcttggaccttatatattggattggttcagctaaatgctatatatataattgcttagccgtgcttagaaacattagttcattaatgggatgaatcatactacattattatttatggttatatttaatggtagctcacgatggtcaatcgtgttatgataattaattgataattaaaatatgattaatggtgagttgtgagcacatggttttgatggtcgtgctcatgacaattaaggactggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgttttataagggagtgattatgatccaggaacggtgcgctgtggtggattgtgttatgcgaggggtactgtcacagctcctttccgaggtaccgtggtggtattgaggcgcatggtgacatgtcgtggagctgtgtcttgtgggtacagtggtacacctctggccagagtaaaactattcgaatagccgtgcccgcagttatgggcaggtctaacaatgtctttcgtgattagtttcacacttttcaccataataaatgatgctataactggtaataatttgattagctcctggtttggaatggtacatttctggtttggagatagatctatacagccgggtatggttgttcaggatggttgggcctgtgcagcatgggtgtgctgttcagtgttgattaatattgatgattaattactctactgttttacaaatctcaaatgtttgctaaatgctgcttttgcaaataagccctatattatgccattctttggtatccttgtgcacttgcatatttgttgtgtggcttgttgagtatgtcatatgctcaccttgcaataatcaatcaaacctcagtggaagacaagttgcgaaggagaagacgtttggcttataccccagttgagctgcctgtgggagtggagccggagcttcgctagaccgtaattccgctgttgttttcttttcttttataagtatgtaacgttattattatgatgaatatgtatattaaattgtcagtttgtgtacctcggctgattcctggacgaggatttcatgcacaaattagttcggaaattactagtgaatttctgggcgtgacattatccatccggagtggctggcgaacccggtggtcgtcccgaaggccaacggcaagctccggatgtgcatcgactacacggacctcaacaaggcatgccctaaagatcccttccctctaccacgcatagatcagatagtcgactccactacggggtgcgaccttttgtgttttctagatgcctactctgggtatcaccagatctgcatggctagggaagatgaggaaaaaactgccttcattactcctgtgggcactttttgttatacaactatgccttttgggttaaagaatgcaggccctacctttcagcgcatgactcgtattactttgagtaatcagatagggtgtaatatagaggcgtatgtcgatgacctggtggtaaagacgcgccaccaggacacgttgctgcaggatttggccgagactttcgacagtattaggtccacgcgcgtgaaactgaaccctgataagtgtgtgttcggtgtgccggcggacaaacttctcggttttctagtctcctcccgaggcatagaagctaatcccgagaaaatatgcgcgatagagaggatgcgcccccagcaagcttagggatgtgcagtgcgtcactggatgcatggccgccctaagtcgattcatatcgaggttgggagagagggcactacccctattcaagctcctcaagcgctctggcccgttcgtgtggacggaggaagctgagcaagctttcaaccaagcttgcctcaccttcccccccccatcttggtagccccggggccggaggaacagttgctgctctacttggccgcgaccccccatgtggtgagtgccgccctagtggtcgagtgcgaagaaagcggaccggaggtccctttaactcgcgatggcccttcgtcccccgaaggtccggtgcccgaagcccctagccaccaggaggaccccgaggcccccgtgggaggaggggaggcttttggcgagtggtcccgaggcctatgatcccgacatggctcgagaccccctcggggcccctgagtaagggagccccagatcatctgcccctgacaatacggaccggccccgccgaaaggtatagcggcccgtctactttgtcagcgaggcactccgagatgcgaagacccgatacccacaggcccagaaaatgctttatgcggttttaatggcctcaaggaaattgcgccactatttccaagcgcatcgggtttctatagtgacatcctaccccctcggccaaatcttgcacaaccgagagggcactggtcaggttgtaaagtgggccatcgagctggctgagttcgatttgcacttcgaaccacgacacgcgatcaaaagccaggtcctggctgacttcatcgcggagtggaccccagtggacgaacctgttccaccaaacgtcccatctcttctcggagatggggaggacccaaacgccgacattcgttgcgggcattgggttacgcatttcgatggttccctcaaccttcaaggtgcaggcgctggagtcacgctgacttcgccaagcggggacgtcctcaagtacgtcgttcggctcgacttctgagccacgaacaacatggcggaatacgaaggactccttgcgggattgagggcggcggccagaatgggcatccgccgtctcctggtcctaggcgactcccagctagtcatgaatcaagtatccaaagagtactagtgcaccgacccacaaatggacgcatatgtccgcgaagtgcggcgcatggaacgtcactttgacggactcgagctccggcacgtgccccgacgcgacaacacttttgctgatgagttgtcgcgtgttgcgtcggcacgagccccactccccccgaggaccttcgaggaaagactcgcgcagccatcggcgcaaccgaacccctcgagggaccccgacgacacgccctccgccccgacccttggcgacccgcggcccgagggggtcgaccccgacccccctcgtcaggtcggttggatgactgacatcctggcgtatctcgacagcaatactcttcctgaggatcgcgcagaagctgagaagctcgcgcgcatatccaagcggtacgtcctcgcagaagggaccctctaccagcgtgccaccaatgggatactcttgaagtgtgtttctcgagagcaaggcatcgagctcatagctgaaacccattagggtgagtgtggggcccattcggcctcacgaactttggtcggtaaagccttccgacaaggtttttactggccgactgtattgcaagatgcccaagaatgggtccggcggtgcaaggcatgccagttccacgccaagcaaacccactagctggcccaagccttgcaggtcatcccactatcttggccttttgcggtctgggggctagacatcctcggaccattcaaggcggcttgaggcgggtatcagcacatgtacgtcgccatcgactagttcaccaagtggcccgaagcttacctggtcgtcaagatcgacaagcattccgccctcaagttcatcaggggcatcacgtccctattcggagtgcccaaccgcaccattacagataacggcacccagttcaccagtgagctgttcggcgattattgcgacgacatgggcatcaaattgtgctttgcctcgcccgcccactccaagagcaacggccaagttgagcgagccaacgccaaaatcctcaaaggcctcaagaccaagacgtacaacgtcctgaaaaaacacggggatttgtggctcgaggaattacccgccgtgttgtgggcaaatcggaccactccaagccgcgccacgggggaaacgccctttttcctggtgtatggcgccgaggcggtcctaccttcggagctttccctaggatcgcctcgcgtcgcgctgtacaatgagaccaaccaggatggtcttcgccgcgatgacctcgactatcttcaagaacagaggaggcgtgcggccctgcgtaccgcgtgctaccagcaaagcctgcggcgctaccatcagcgccacgtccgggcccggtcactacaagttggcaacctcgtcctacgccgcgtgcaatcgcgcctggggctgagcaagctctcgccaatgtgggaagagccatacaaagtgatcggcgttccctggccaggctccattcgactaaccacggaggacggcacggagttgcctaacccctggaatatcgaacacctctgtcgcttctatccatagcgtcgagattttttgctttccaagagctcgggccaacccccgcacaacccctcggcttgtgcgggcttggccaggggctaccattgtgtatccttttccctttccaagcaataaatttttccatttaatgtggaggctgttacgcgccctttcttcttactctttcctctagcttgtcctggttcaaaggacagttcgggtttactccagaccctaagtgccgtggggcgacctaaaaaccgtcgaaagagagcccaaacacgggccgctccccgggttgcgccgaaccccgggggctcggaagggcctacacacggccgtccttgacccctggtcgttgtagcctcggtctggccagtcccgctgggcggctccctcggggcgatgatcttgcccctcaccacttaggtaccacggaccgagcacggatttgccttttcgctagaacgagcccgagggggggaggatggggtaagagcggcatttcgttcacagggaggttaattatatgcttttgctcttgtttcttcgtctttctgtgccgcaggcattcaatggggagcaaaggcgtacaaagtgtgaaaaggaagctttaattacagacaagataagacggcacgatggcctaaatacaagaagtgtccgttgcaggcacacaacaaaaggaaataaaaagcgcgaatgatcacggagtgcccgggcccccgaggccggcgccgctaacgacgtcgtcccagtcctcgccgccgacgtcgtcatcatcgtctccgctcctgctctcctcattcgaggcaagcccgaaggtgaaccggggggccgacccctcgaagttagagacaatcgcgtcggccgtctcccggacttgctcccgagcctttgcctcggtccccggggggaaatcctcgagtgcgcgccacgggacgaagtcggggttgcgcgcttggtggctcgcgaggaccagttccaccgcggcccatgccaaggaagctgacgacgatttcacggtctcgccaatctcctcctccagcctctccagatccactgccagcccgtccagccggagcgcgagtgctggctgtgtactcggcgccccgcgcgctccagctgatcgacggcatcggagagctgcccaggtccgatctcgttggtgaggcggagggccgcaatctccccagcctgatcttgcaccaagcgctctaggtcggcgagagtgctctgagccgtggtaggctggctcaccaactccgcgctgccgggctgcccgcccgccgctaggtccttttcccgggcctccagctcagaagccctcgccgctatcgccgcgcgtccggcaacggcctcctcgcgtttcgcgagttgctcgcccagccggtgtgaggccacctcatcgcggttcacatcggcttcacgctcggcgagtgcgacgtcccgttcccggcacgcctcttcccgaagccgtagctcctctgcgaggcggtccgctgaagctttcgcgacgagggtgacccggtcacgcttggctgcggcctcttcacgaaggcgaagggaggcctccacctccgccgccattctctcgtgggcggccaaggtggactcccgctgatccagcagacgcgctcgctcctccagcgcctgagcccgcctctccagctcctgggctcgctacgcctgctcctggctgcgcgcgttctgctcgcgctggctccggtcgaggacctcgattcgccgatgaatcgtggtctcgaactcctgcgcggagcgggaacgctcatccaaggccctgtgttcagcctcgagcgccgccgtccgggcccgcagcgacgtgtcggcctccgatacccgccgttcttgggcagcagctgcgtcgaggatactgcgggcatccttgaccctcttcaccaggtcctcggcatgggactcgtactgtaggcggatgtcgcccaacgcttcgtccaggacgcttgaggcgatcagtgccgcctgccgctcttcctccgtctcccgcatgacggagtccagcgtctcctcgcgcgcctgaatttcagccaattgggcttggcgcattttgcgtcccaccttcaccatgtcgtccacggcgcggcgcccctcgtcaacccgcgcgcggtccgcagcaagctgtgcccactctgcctccagggctgctcgctcttccgccagggcttgaacttgggcgttgagcccctcccggacggtggaatcggcggcggcgagcacctgcaggagcggttccatatttgccggagttggagaagaaaaggtcgtggtctgcccctgggacgacggagtgctgctggatcccccgcgagactgggggctgctctcggcccctcttctgcgcaaccagccccgagggcgccccaagtgcaagggggagcggccgtccctctcgccccccgtctcgggtcctcaggtagattcagcctcggcctcgggctcgggcccgcccccagtttcggtctcgacctcgagctcagggccgcctctggccgcggcttccgagccacgacctccctcgccccccggtcccgggtggcgctccgcatggaccctggtctcggagctgcccccgggaggggcatcaccaccgctatcgcccgctgcgagtcgagtcctggctggggttaactcggggtcggacccggtatgtggtctgtgggccccgccgagaggctgtgaaggccccgcggccttggatcggccaagcccgggccgctccgatcattcggatttggtcccctgcgaagggtcggaccctgagaccccctaggaaggaatctcgctacaagagaacccagatcgcgttaacgaagaaaaagaaaaggagggaacaacagaccgagctgggtaaaagcaccgaagtgggtgccggcaatcgtacctgcggggagggcgattgaaagtccacttcgggggctcaatgaagctcccccgacacggctccatttgtccttcttccggagccgcttctttttccgtccggcctcaggcccggcagggcgcttgtggcccgctggcggacggtctgccacgcgctcggcgccccctccacgtgggggagagggcagtcgagattcgggcatcttccgtttccctttcgggtcgctggtcgagtcgtccccgggtccgcggctcgggccgggtgccctggagctgccacccccgccgggtccgctcgtccgactcccgcctgtggtcgcgccactgccacccacgccggcagcgctaccatttgtgccgccccggctggaccggctcctgccggcgccgacgaccgacatcacggccaggatgctctcccgatcgcggtcgcaacagaggggaaggatcccgtctggaatcagtgtttgctcggcggagtctaggcccagcacccgccgaatcaccatcttcgcgtcctccttcccccagtcccagcgctcacccacatgcgtgcgtatggggtcgttgggacctgtgtactcccacgcgccacgggatcgatcctggagaggtgcgatgcggcggcggaaatagtcaccaaagaccattgcccctgtgaggcccaggcttcgcaggcccctaaggcgatcccacaccgcgtcgtactcctcgcccagctccgaaaccgccagccatgcggcggatctttcgagaggactagcgggaatccgaagtcgcgggtggtccggcagcgcggtgtagaaccagtcctcccatttcttgcggagatgactctcgatgtattgccccgccgtgcctggccggggctggaagtaacatccccccaccaccgcaccttgcagcagctgcgggatgaagaaagactggaacagccgcatcgtcagccgcaccccgatgaacatctcgcacagatgtgcgaagatagccagcgtcatcacggcgttgggtgcgagatgcaaggtgtggatttcatagaaatccaaaacctcatggaagaatccggagaacggtggaatcaaccccgccatagcgaaggacaagaggtgcacagatcgctccggataccgcggccgcggccgcaactccctcgccctcacgacggcgccgtccggcatgatcttgcgggggaggttaaggtgcctatccaccgtaatgcgtgctgccgggagcactgtgtcgccagcgtcttgagccatgatggccggcggagaaacggcgaagggcttggtgcgcggaatagtgcgaagtggcgagaatgttaggacttaaggagcgagaagacgagtgggcagttggcgaaaggaagggggcaaagttcctgcctccgtatccttttatcctcgcctcacccacgctcacctcctcgtttcacgccctcacgattgcccccacgattctcgcgcccgcggttgtctcttcgtttcctgcgtccactcatcacgtcgcccactgaatccgcgccccgcatttagtgcgcctatcagcggcacactcggagcagggcgcgcaacggtcacgggcgcaacctgagcgaaccgtcgccactaccgccgcatgagtagcgagcgagggaattgaggcgtagtctaaccgaccccccaattttcgcgccttagacatcctcatcgacagcgcggtcagtgacagccaaaccgctgctgtggttgatacgccagtctggccactcggcagttttcccttagattacctgccgagcctgcaaccctagcttgggaaatcgtgaggcaccacatcagaccgacctcaggaggccaatgtccgatatggtgccgggggctactgtcggagatatgggtctgggggtatgtgaagcgtggggaatctaccttcctgtcctgtcgcgtgtccctacagcctggtcttgcccccgcaacccgcggatcgctggagcgaccggagaggggtcggggcctcggggtgccacgtcatgcccctcgggcctttgcaccgcttcgccccgaggccctcgcccagccgccatgtggcagagggagctagcgaggagggggcccaggctgagcctccattaatgcacacaatgccccaactgccccctgccgcatttaatgcagtaaggcagacgtgcggcgtgcgaatctgacgcgccataatcaaagaatgaccggtttgtgaccggtcatgattctggtcacgtctgactagaccgacaaccgagctcccacgtcgcgtctgctcccggcgaagtgggggtaggtatgacccgtcccatcggagggtcattcggacggcggccaccacaagtcttcatccattaatgggggaatgacagggttgtcccccatgtcaagcgagggacggcgttgggccccactcaaggacaagctgtggctttgcttccaaacgaaggcacgggtcgagtcccggtcaagatagggtgggtccccacccgaaagaagagtaggtagaggcggtgtatgtggtatccacttgagatataaaaggaggaccttgcccaccgaaaaaggggacgactctcagaaaacctgaactctaggagaagaagagcgagagtgctctccggagttaaggaacccttgtaacactcaaccataatcccaaacacaggagtaaggtattacgctccacagcggcccgaacctgtataattcgattgtgtacaagctagctagcagccttaggggcggatacgtgatttctaagaggcgagcttcttcccccggccgaactcacaaaaggaggctctcacgacctcccgctatcgagggacttccctcgacagataacaatcctctaaataatataaatcaaacaggccttggtttgaaatatattattcaccaaattattgccacaaataatctagtttattctagagataaatattctaagacaaactgagcaaacaacataaaacaagtggtctatacaatacaaatagaagaaagttttttgagaaactacattttaggtgtacagtaaataatctgcggcaattagtagagtagatgaaaagaacagggcgacaattgttttatatataagctcaactagtgtgtttttttccccataattctacaaagaacgtgatttgcaaagagaatcaattaacgtgacacaaatattttatatacaactatatcacttaaactatataccgatatagtttggacctagcacaatcaaatgcaacaaatatattttcagtattgacatgttaatattttaagcttcacgatccaacgcctggctcccttttgctctactccgcatctcaataacaaaatagaacagaaaacagctttggacttgccctttctattcttgttcaacattttgtgcagctcccagaaacggttcccaactactgaacttacaggatcactcttcagtttctctatgatctacaattgcttattagtccagaacgtctaggattagtcaccataaagagttattcaccccaaaagaaatagaggaagaaacaaggaatacaatattgtgcccattctaaaatacatttactagcatttctttgtacataagtaacatctaaggtatcactaaagctaaaaatacaatgtccggtacatatacatgcatgacacaattgctcattcatgaaggaacacaagttcaacctttgctcattcagagtgaacacaagttcaacctcttcccaaggaacatacagttactggtaatcaactgacgattaacgccgtcaaacttccagcaaagtggatgtggcactcataccccaaatagaactattacttaaggttcttcaagaattgcacgcgcaaggtttgatgctagagctaatctgacggagttcaatgcatggcttggtaggtgaatgttggaaaagtcaggccgaagtttggccaatgacagttcttgtagcttgttgagcaacaaagtcgtttcagcaacatttaacaatgggcagggtttgcaattgagaagcctcacctgcagaaacaaccggggatagaaacagaatcaaaagcctgatacagattaaattattgaacaggggcaaaaagaagatttagctagctgctttgctgaacaccccaagtaaacatatgactagcttaccgagtcatgtaaaagtggtagccagaaacgttgaggtgtagaaggatttctcatcagctgcacagaaatagatattaagtttgatttatcaagagtcattcaaggtgcataagctattgacaggctgacagcactgtctgtgcggtgttaaattgaattgcaggacgacagcccagccaaggtgtaaatattttcacctgtataagaaactccacggtttgccgaacagactcgccagtccttccttcttgtgccatctgaagggaccttttgaaatctcggtacctgtgtgcaagcatatgttgaaacgaaatttagtactcatgaagagaagagatacagaaattgatggaaaggggactaatacctgtgaaggaactcaagaccacctgcactaccgatgtcagaacctagtaactcaagcagcccctcccattgctgaccatacaaaattataattagcaaatgtcataaacaaaaacattgtcgatatatctgcttgatgaaaaagatctcccttttgatcagatttcttggttactagtacactcagaactaactgcaggtgtacaaaagataggtcataaggaggagcagaaatcggcaccttaaaactatcatctgtgaccgacttgccaatatgttcgaataattgttgagcaattctgtcaagacgaactttatcattagcttgctggaaccagtaaactccagttcctttcctaccatgtttccaatgataaatgccagcaatctagaagaaaaaatagataggactcgtgagtcaaaacgacaggtgggtacaataaaatatgcatgctggtaagtttgaatatatagataataactaagccaggttaaaactccaagaaatcttcgttttgaaatcttggaaaagtacaggtgtacatgcattgggaagaacatcttaccttcatgatatttgtactaacattctccagctcatacaagcggcaaatttccaaagtctgctcacaacaacaatattaggtaacaaaaagcaaaggtgcagaaaaaattcaagggcatatcaatacaaagtaccttcaatacaacacgattatcttgtatgggttgcttcagaagcagaatctccaacagccctaggccttggtttagacatgaggacagataagttggtgcaatctgagaatcaaataggcaagccagccattaataacaattatcaaattataaaaatttgctatcattaacagataacagcacctgttcaaaagtagaggttctgcaacaaaaagctagacaatggataataacaaacagcatggtagtcatacgcaaaagaacgtcacagttatgcgtagcaagcaattcatacaggccaagtgtcatctcaagaaaatatctgcctagtacaatccacaaagctacaaaaaaatacctgccatgttaaagcatgagagcacaaaacttgagcataaacaagcctgtgcagctcctctatgcttataccaccgaagttaggcctctcttcatgcaacatcatatccgcatagtcattgtcagcagtcagcagctccatagcatgtgtgaccatcctgcatttacaaatggcaaaacacattaagatgcaatgtttcaaagttggcagcataaatcaaatggccaacaatacatcttaccaaggaccaaaattttttgtgcattcagccaagacaacctaatgttagaaaagaaaaaaaaatgtcacacaaacaagaaaagtggaaaggataagaaatttgggggcctatgtaatggatgatcacattgtgttccaacctctctattttctgaaaggataccagtaaggaggcctgtcaatccgctattgtcagcagacggtttaagctgtatgcacttttgtgctaactgatgcatcccttcaaaaccctggcaaacatatagattttagcagaacataacaagaggttttgattgttcaaatatatactccccttcaaaaaaattgttgccacatatatatattgactaactgtttacatcacacaagaaataagtgggtacgggtcagtaaggcaaacatctgccaacataaaaacatgttctattgtacaagacaactcaagatgaataaccataattactggataccttttacaggagataggagatggtaaaaatatctagcattctcttctatataatgggtaatttcatcatgtcacagattaaagaataacaaactaaaaatgaactctctagcgaggggattgctctaatagcagctgcaaaatgcaaaattgcggtgacaaataaatgaatcgacaagaaagcattataatgaagaacatattagcaaacacaataatatgggactaaccactgtgaatggccttatataaagtaaatgagaagcaaagagctccagccaatgtgaagtagaagcagtgaggttctttatgttccccaacataatatgaagcaaactcttcagaccatcacgagttttttggtgaccgcactgaatccagaatgcactgcactccagtttacttacttgacctcgccatttttccaatgcctgtaaaaaatacaatttggcaaatgcttttagctgacgtcaatggaggcaatacaatttctgtgtacctccaaacacttgggcaggaaactatacaagtttttacacaaattttcactgccctttccttcctttttttttttgaagtaaccattatgctactgagcttgagaggatataaacatataattattaatcacaaaagaacatattgtgcaaaattcaaagttcagccaacatagtcagtaactctcagcatagatgagcagtggaacaatggtggtgggtgcaaagccagcagcagcccgaggatgcagcagcaatcagtgacaaaagagcacagtagagcagct

SEQ ID NO: 921 - DNA, 37278 bp, Oryza sativa
tgtctgatggaccaaaatgggggaaaagggtgatgttaaaaaagcaagtgtatataaatcaactggtgacataaaaatagcatatttgtcaaagctacaacgaaatataattgtatacaatcaggtacactataggaagatatagcacattttctttatttcaaaagattagtgcaacactgtaaatactactagaaaacataacaaattaagcccttgaagcaaataaaatgatttttatgtgaatgatagatgcaagtcatgaagaaataaagaatggtctcaaagcaacctaactacctcacggctgtccatctgatccaattggtatgatccatgaaaacgtagcatattcacctaaaagaaaaaaaaaacaacttctgattgtaggattcaatcaaaactgacatgtctataaaatagcgtgcaagaaaatagcttaccacaatatcaagccatccaaccgatagagctgctgataatccactccaataatcaggatcatcttcaacaacctatagagcatcactcattattcatttatactcattactgctattgaatcaatggttggaagtagcacaaatgaacattagtaaaatagactacaaaacaatcaactcaaagcatggagttgtagaagttttatagagaaaagaacaaataaaatgattgagaggtacaaatttgacgtctaatgctatatgctacaacaaatataatgagtcaaacctgcaggttgatgagctttttctggaaattgatcagcgtgcgatatatcgtgttctctgtcttggtcaagaggctgtcatagtcctaaaaccacaggaagcctgataagagacgcccctaggtattgtaacagcaaagtccgctcacaattgaaacaaagcaatagatcaaagaaagagcattacggctaaccaatcaacaagacgctctggaagccaagtttgcaactgtttatcaacaaagaatatctctagcaactcccacgcagcctttaaactagtaggcttctccttgacctgcaagataaaatataccaattactttctataggcaaaaaagtaaatttaacttcaaacaaaggcaaagcaagaaaacaggaaacaatgtgacacatagatatggtcaccttaaggatcatctttgggtcatcaatcatgtaagcagaaagagaatctgggttcccaaggagactaccgatggttttactgtattcaagcacatattgccacctgacaaaacatagtagaatcagaagcaagcacatggaaaaaatggatagcttatactaggcagaggtttgatctagattaactgtataaacagtgattataataccactttggcacagatgtttaaaatttaaccatatgtgtacttcagatatgtcgatttatccatttaggcggaagcctaagagctacaaattcagcttctacaatatgaaaaagggtatctgaatagttggatagctatcgaacacaaacaatataacaaagcattgctaaaacttaaaattctgagcgatatgtgacatgcctatcccagtacaagcatagcttgggcagtaatcctttctttctatatagttggaacccacttagtgcaattactactacaaagcagccaccaggttaagccacatcatcacaattatctcagccattagatataatcaagacgctaaacgattatcctcggaccagtccccttatctctgaatcctacaaattcttaattagtggatccaatccccttcacacctagcctgccgcatctacttctcccattacgatggaagcaattgtgcagcagaaactgcctctgataattatagcagcgagaccaaatgtcatggttaatcagatttattctcttccaaagcatctttgaaatcctcttgcagtcctgcagccacgcataccagcgctatctcttttgtagaccaaccggatatttgatcatcagctcttgcatggtgagtgatatatttgctatcatttttttctcattagatcttcatattaatttacagtattatctttttccccccaagggctattgctttttctatccaccaggtgataagtgaataagtgataacatatttgatttgatgatttgatcggttcatttgactcttacttttgattcgatgctgatcttaaaagcaattttgtacaacctgcagattattttgccttccgctgttctctcaaccgcaagatagctttttgatgatttgattggtttaagtcctttttttatttcactctgatttaaatattaatggttcttgggcaggtatagaaatatgttatggctgtgctccaagaaggatgagtcaatgatgtatgtgctaattcaaggacaaatttgtagcagataatagaacatcgaaggatgcttatatacaatgattaaaatgatatgttgtcaatggtctacagttttctttccggaaaagctatgcatgccctccttccaataaagttcccagtgtaagcatacaattagctatactgcttagttgttcgtcagttttgcttgtgaaattttcatagtttcgaattggaattcataagtatcctagcagttgtttatatttgtagtgatgtgtatttattcgtaaactacaattgttgtcatctttttcggactattccctcgcacaatgtagacattgttgctataagagctgactgttaaataagaacagttcctttcttttttttttctcaaccagtcaatgaatcgtaagtttacggtctgtcctgtgattggtgcgatgggtgattctacccatacaacgagaatagccatacttcttggatttatattctacctggacaagtttatctccaatatataggcattgccctgaaacaaagtcatcaccaatttgaattaatgctattatctacactccccatgattcatgaacaaaaccaaaagttgtctggtcttattgacttctatctcaatctttcacccatgcttcaaagttgtattcttcatttcccacagcagcgcgcagggtatcacctagttaacagtttatagacctctaaagtcttatacagcagccaaaatgccatattaatcatcagtccagactaaaaatactagcatttagcaaagtaggcggtccaaattccaatgtcttaccattctgcgtgctccgagactgagggcaagcgcgacataccggagccatctacgagcgcgttcttcctgctctgaagcagcgcaaacgccggtaccgacccgtactcgatcctccgcatttccgcctcatcgatctcctccgcatccgcgccgccaggcccgctaccgccacctccgaggtttacctccaccactctccccccggagacctcctccgccccacggtctccgccaccctccggattcggtgggcggaggcaggcgacctgcaggaggttgccgctagaaaaggaaacgtagacgcgggagatgggcggggccacgccgtggcggatgttccgcacgggcggggccgccgccaccgcgtggcctggttctcccgagaacggcacgatggcgccgccgccgtccatcagcatccctggcatccccgccgccggacgacgatgagctagggttttggaagcgggagacggcgggggtttgggggttcgggggcccgggtaactgaggtactgtacaagtctacaggttagccttcagactagaagcaaagccggcaggtctctcgagtctcgacttctcaagcttcagggcatgtttggcacagctccagctccagctccagctccacccttcctagagctgttgctcagctaaacaattttaactccactaaaactgggagtggagctgggtggagctctctcacaaaataaactagagttgtagagctgggtttaggcagctccacaactccactccagacccaactcctagagctaaatttaggagttgaagctgtatcaaacataccctcaattacagttctctggattcgtagtactagctttgaagcgttgaaattttgaatgatgcaaacatctgaaattaggcttttttaaataaattatattggtggtacacaattttatcaagtgatcagtgtaatctgatgcataaatttataaaaagcatgttttgatacacaagcttgtctacttcgaagaaattgctaaaaaccctatcgtaagttctaatttgataagtagtctaatatattgacgtgcaatttttttacgtgttcgagagaaaaaaatctaataataagtagtactaaaataccaaattatattgagtatgtattgtgaaaaggaatttttatctattttcatttcaaataccctatctcaaatcctgaacccaccctgttgtttggtgcgtgtaaaccaagaccaaaagaacacaataagactaatctcgctgatttaagctatgattaggatgcgacgcaaacacgaaaaaaaaaagatgccacacaaacatatatatacgctcaaccaaatggtaaaataaggcacacttattgtacagataaaagacataaaatactaaataatgatgcaagggtggaaatgaaaataagcgtaatgtagaaaccgagtttataaatatagcattctcactcccatctcttatatgcacatcacgtcctaatcaattttcaacttagtgaaattagtcttgttatgtcattttggccttggttcacaaacaccagacaaattcattaatcaaaacgaatgttttataagtttgtacgctatattatatccccctaacaagttcgtataccaccagtaatttacttttttttattaggctatgtctggtacaacatactactacttgaaatcaccgtggtattctggaacgaacaatctctggagaaatttagatgcgaaattttctgcatttttccatgtgtacctttttcaaattaagaaaaataagaactcttagaaatacattgaaattacgatacaagtgtctaatatgtggtgaatttggagaaaaatccagtatgagctctaggtttcttgcccctaaaattgtgaattttctaccagtaatgcgtgcttcaaaaatccagcttacccaattatctctgcattatatatctattgaaatcgtgaaacttatagttatagaatcttgaattcaactagtataggaccaacacaacgtatgtgtggatagaaatcaatccattctaattcaactaaatttcagtccgcagtgttaaaaataaaatgtagtccattttatttaactaaaaattggtcagttattacccacgtgtcgctccgtacttattcttagttaaagttttagctagaagccgagttatcatattcttgttttgtttcttagaatattccaattcctaaccatgtacattacctttttgggaaaatcaattttgttgttctctccaaatccaaacgactcaatcgagccaaaggtgacggtggtggtcggtatgatggacgagcaagtcctctctcaccacctccctctacaatccaaagccatgatgttagctgggaaccgttaacgtcaaaatttggtaaaattctttagtggattcggttaagaaaatagcacaatcgtccgatataaacttatccagaagagaccgagttcaagaaaaaatcgtgaatactatggcatggtggcataattatatctattaattaggcaggatttagtagtttgctttaatctttaggatagtatgtttagtgtctataaggactttatgttttccttttatcttcaggaaagtttctttcttgttcaacaaggactgatatctaaccatgggtacaaatatgttctatcaagaggtatgacttgatctcagcggtttgcgttggcggattagggcgtcgctttagatgttctaatctatcttctacaccgatcgatggttatcatatatcttagttaatctagcttaacatcttaatttgatcatatcgaccgagatttgttttagggtttatacaggtatcgactaaattatcttgctagattagattaactaaggtatacaccacccttaaaatcaatcatcaaaggcttgattgtctagacaccatgttttcttttatactttccgctgcattagccctagtcgtgtttagaactataatctctaccctactgtttgattttcaataaaggtttcatcggggtatcagccgatgagttatctgatgttgcatcggtttataaggattgcatacaggttgtttttagccaattgcaacaaagattttactgtttatctaatcatttggatttaatgatatcggacctctagtcgatgtatgctttaaccatcggatcacttattctatcatgacattgttagcagattggtttctattagattatattattgttttattatcatcaggcgattgtccttatatcactatctgcattggatatatagttgattgctcaaaacctatcgacatcggctggaatcgctctatcggcttgtcagccgatcgactctttggtgatcaacatatttgtctatcttgtcagtcgcaggatcaaactgactggcgcgccggcaccttatcaatattctggacttgcattggagttaagcagatctcccatgccgttgtgttcgtcgacttagttcgcgccaacacagttccagcaccatcggccgagcgcgattttttcgttaacaggagcctatgtgttcttgcggtggttggctttgtcagagcgggcgatgtggctctattgtagacctaaaggcaatcagtatcgcatgtggtggccaactcggcgctaggttcctttctcggactgagttcaggaggtggagttcctaactttaccttcccgcacggaaaacggtgttgcccataaacgcgtgattatttatgtatattagccttaaaaaacttgaaaaaacttgaaagattgattaatatgattttttaaagcaactatcctatataaaatttttgcataaaacaacatttagcagtttgaaatgcgtgtacggaaaaagagggaggtgagttattaggaaagaagggaggagaacacaacctcagtgatgtgttgtggtgttgtcagggcatggtcgcctcgtggttgagctggcacatggtggagttattttaatgttttttcttgattatagttctcagggctttagtcttttgcatttttttctattatgctgataaaaacttcgcactgtctagcaatgtttgggaaaaaaatcgaacattaaaatcaggtcactggacacacagaaattcacatttttacaggaacaatataaattatattactagaaagtaaaacattctaaaggactagcagcccacatatattctggaggccattcaatttggaaataagtccattttgcctccctcatctcttgcgcttaacatcccccaactggaaaaccggatataacgcctccttcgtctcttaaaaccagagcaaatcacctccctcggtggttttgctggtggtttcatccgacttggcatcgttgaccaggttgacagatgactcagcgtggtgggacccacctgtcagtgtgtaggcattacaaactcaccggcgctgagtcagcgtggaaatggggatagagaaagagaggtgcttggcgatggcgacgaggagaagggccggcgacgagcgacgggggaggggcacggccggcgacgggcggggagaaccagaggcgtgcggcggctagcggtggccctcgttggcggcagcggcgctcgcttgcgatggacgggaagggggtggcggctggcggggagaggcgcgcggtggcagggtccccacggtgaagacggcggccggtcgtcggggcggagaagggcgcggatacgagaaggagacgctgcagcggcacattccgccgctattcgatggggcgctcatcggcgtcgacgccgacaacggtagcaaggcgcatggctttcccgcggtggaggaggcacaagtgtcggcctcccttggaacccctttcgctggttctcgctgctcaacccctcggtgtctcggagcctgccgctgcaatgtacatccaatgtgaaataatgctacatgcaaggtttcttttttattttgagggaaaattgaacaagaaaaaactccggtgattagttcagacggaaatatagttgcaagaaatattagtttgcagaggagaggagggaagaggagtcagccggtgttgcgtatgccggcggcgatgccgttgatggtgatgagcagcgcgtcgcggagcttgcggttgtcgtggtggcgcaggacctcgacctgcagcatgttcatggggttgaggtacgtcagcctgctctcgatcagcttccgcaggctgtggtgttggcggacagcttcttgtggccgctcaccgccagcacgcagttctccgttcgcgccagctcctgccggagctccgcccccagcgcccgccgcccggcgtcgtgcaccagcacgtcgtcgtagtgcttcgccatgggcgcgtccgccttggccacaccatctcgatcaggtccaccgtggactggaagaagggccactccttgtacatggcgcggagctcgtcggtgtgccccttgtcgcaggcgtcctgcaggccgcgcccgacgccgagccacgccgggagcaccagtcgcgtctgcgtccacgcgaacacccacgagatggcggcggccggcggtggcccttgttggcggcagcggctatcgcccctcacctcctccgccgtcgccgccatcatcattgccgtaatggctgccgccgtcgtcctggcttcgctctccatcggcaggtggtcaacaaggccagctactgcaccatctacaaggccaagctggcggagggccgcggcagcatcgagctgcgcctcctccgtgagggctgctgcaaggacgccgagtcgtgcgcgccggcggtgcgctgcatcggccgtgcgcgccacgagaacctggttccgctgcgcgccttctaccatggtaccagaacagtagccgaccgccgcgatctacagccccgccgagcctaggaacgacgccggcacgcccaccgccgccgtcttctaattccattctcacaatctcattactctgttcgtccgaatctgaccaggggagagagagagctacacactgacatgtgagtcccaccacgctgagtcagcttattaccgggccaacaacaccacgtcggacgaaattgtcagcaaaaccaccgagggaggtgatttgctctggttttaagagatgaaggaggcgttatacccggttttccggatgggggatgttattcacagaaacgtaagagatgagggaggcaaaatagacttattccttcaatttgcacccacatcttttgggccgctctggtcgctgcacgctggttttgtgcaaacctggataggcgggtaacgggaaaaccatgtccgggggtagcggtctagcaaacctgtttgagaaaccaacacaaagcccggccatccgcaagcgcagaccgcgacatgacatgccttacatgaatcagcaacaacgactctcccaggagaaaaacagaaggactgcaagactgcaaggttcaacagatcaacaaaccgagatcagctctgaccaaacaaatttacttgaaggggaaatacgtagctctgatcaactgatgcccagatacatttcgatcgatatctacagacagcacaaccgcgagacataaggtcggcgttcataaagaagaaaatgtaaaggtcgaaatgtaacgtcgatcacttcgcaagttgctggtgtgttgttctaattttggtcagtgtgtgtagcatgtggatctcttgtcctacgaaatagtagtatctaatttactttcaacttggattagggtggcgagaagatgacctcgtgcgccttttatcatccaaaccacaaccgtgcgtcgcctgcgacaccacaggcaagcgaccacgaccacccgtgcattgattttgaccacgaaacaagtaacttagcctctattattgcacgcttatgcggatgtgcgtgtgtgcgcttaagcaattaattgctaattagacatgatgcatgtagcattataattcttctaaacaaatacatgtggcattagaaaaaacgagaagaattgctactgtgtatccaacggcccacacatacggtttcaacaaaaaaaaaaaaaacggcccacgcatatgtgagcagcgagagcacatatcgctttgcccgtcaaacgacgacggccgcgcgccatgtgcactcgtgcatgcagcactaacacatacgtggcctggtggcattttaattctcaacacgtactcctctctttcaaaatgtttaacaccgttgactttttagtatgtgtttaaccattcatcttattcaaaaaaatttaagtaattatttattttttttatatcatttgattcgtcgttaaatatactttcatgtacacatatagttttacttatttcaaaaataattaaataagacgaacggtcaaatatgtaattaaaaaaatcaacggtgtcaaacattttaaaacggagagaatactacatacgcttgcctgccgcgatatttatcgacaacacatgcaattattctagctagctctcgtagggtcttcctcttccacgtctaggggcaggtattctagcttgacgatgacgacaaagtgtgtcgtagtccggtgtgataaacatgaacatgacgacgcaccgcaccttgcttttcagtcatctcaaccgtacgagctagctggccggttacagtgcaaggtcgcatgcacacgagatcaatcatgcatataaaccatatcgatctccactagtactgctctaatgcaatattgtttactgctgtttgaaaagggatactcctatatcggttagtttccgacactgcaccatacctcttccctcccttaactatgcacgaacatcactttcaagctaatcacagttaaaccttctgcattggcacgtagctctaactcgctattcttttcctctggtatatttatataccactcgtatctgtgttagttctcaagccaaatctctgaagtctaaactaagattaagatcaagtgtatcagtcccgcacggctacagctacactacacgcacgcaaagcgtacgttagcacgatcgtttcacttcacgtgacccgcgcgactaccatgcacacgttagctcgctcccttccgacccgcacccatcggcacatgcggcgcgcgaaggcgaagcaacccggaacggaaagctagcctagcccagcgaggctcgccgaggagcgaggggtcaaaagacggggggaggaatctcgccacgtggcgttgaccaccgctcccacgcccgtgcggccccacctcacatgacgttcctggcgcgaccacgacggtcctactcctacgccttcgccgtcacgtgcctggtgggccccacgccgcttcgtattaaactgggccgagggctcgggggcgtggatcgcacataaaatattttggcccatcctggcactatccaaccggaatagtactaagaattttttttatttttaattttttttattaaaaattttacaaaaataatttttcattttgaaaattgacagaagtggtcgcctaccgccctctgggagggcgatttttaaaaatcgccatcccagagggcggcgaaagtgacgtggcagacggccgttcgctctcaggcgacggccgtcaacgaaatttgcaggcggcccccttgccgctctgggggaggacgattttatactgtgctttatattttttataaatatcaatagttatcaaatttttttatattgaaaactatacaagattaaaatctccaagactggtaaaatacaattttattattttttagggcctatttggaatgttaccgtataaatattttgttagtgccaaaatataagcaagttttggcactaccaaatatttggtaaggtaaaattgcatttgatcatatttggtttgctgccaaaatataaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacagtacaaatttgtcaatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagtttggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccacttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaactaccgtgtgggcgagggatcgacactccatgagaggaagagctggcgaacgcgcccgaagaggtggcgaacgcccctgcggagctcgcggaagcgccgatcgtgcctgcgaacgcgctcgaaggcatacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacaaggtgatgttttcgtacaaaaacataaacaaaacttaagaaacctctgggctgagcagtaccgtgcgaaacaggtgccgtaggtcgaggtcttgctccgacggtaggcgcgcgaggccgtggttgtaccggaccagctggaggtacgacgtccacgacgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaatgtactgctgtacacgtggagcccaaagtgtgcctgctagctgtccccgtcgagtcaacctgtgaagagaggtaaattatatggctcgatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgacgttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctctcgcgtcagtcttcgtgcacgcctcacagagggcacggtacgtggctgctagcacggcagaaccccagctccactgcggcacgtcttgtggctgagcatccgcgatggaccgtgcgtagtggaccagccggaagtccacagcgtgcccgtgggtgctagtgaacatcacccacccgaacaaccacaacaggtacgccttaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttactaggcccgactgtagagtacggaggaagggtgttggccggtcctaggtgtggaaggcgcatcacctgctcgaagcgcgcagtgatatcctccttccacccaacaacactgtccacgggaccaactggtgctcccgccagcggtagcccgagcaggtacgacacgtcctgcagtgtcggagccatctccccacagggaaggtggaacgtgtgcgtctcaggtctccagcggtctaccaaagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcaacacgcaaccactcgcgcgacgtgcatggacggaaggtgccgagctgtgcaccctcgactgctgacaggaacgagcggtggttcctgtcaatcccacggttcaacagcgccggtgtgtcgtacgccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacacacatcacatcacaacagcgttttatttcctaaatcgatagtattgttacaccatggaatcgcctgctgcgcgacgacgccttggccttgcgcgcctgcttgttgttccttcaccatgtggtcgcctaccatcacttgcctgtccagatggactagcatctgcgccgcttggaacttctgcattcttcgggcatttcttgtaagtatggccgcgcagattacacttgctgcagcgtaaagtcctcccacctgcttctgactcatccatatcatttctgatgagtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggaagatatgccacaatcaccggcagcagcaagaacgtgtgagcaaggaaggtgatgaagcttcggcttcatacaactgcaggtacatccaccatccgcctttaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatttgtttgcttcgttgtcaactcatccaacttgtcccacaactcattaaatttcttctcttggttctgtacacagagcctcttaaagagcttcataagatgcttgttcttgaattgcttgtagaaatttgcacccatgtgacgcatgcaccaccgactccgaacatcatgccacttagctggaagtcccttctcatcccaaccgttctgcaagtagtcaatagcccgcaacatacccgcgtgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagcaaatgttaccaacaacactgctgtacatctcacttgccacaaaagctgaagtgatgtttcggtgatacttctccatcccttgtaagtagcacttgtgctcggtcacaatgctaactttccaataatcatttcatttacccttatatgcatggacacgtcacggacaatcttccttcatgcacctcacttcatacacataatttgttgacttgaccaccctaaactctctctgcaaggaaactgtccaatgcttcactgcctccttcatctcatccttatgagcatatcttgcactctcaattacctcgttctccttatactcccagggtacatgatcaccctctgatataacaagtccagagaagtcctcatttgcccaatcagtggccattacatcaccttcctcatcggatgatgcgtcatcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgtttttttttggatttttagtgaatataatgaaatttcagagaggggggactgggctttatagggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcattgacggccgtcgcccgagagcgaacggccgtctgccacgtcattttcgccgccctctgggatgacgatttttaaaaatcgccctcccagagggcggtaggcgactacttccgtcaattttcaaaatggaaaattattttttaaaacttttaataaaaaaaattaaaaataaaaaaaattcataatactaaccaggggcaaaagaataaaaaaaaaagctaaagagagaaaaaatatcataggcaaaagggaagaagattggtacagactacagagataaaaatacgtgacgtaaacctcctatccaagcaatcaatggtctccccggccttgggcgccctggctcagtggctcctgctctgttccccacagcacaggcctttcctttgaatccaagcaaaatttgacaaaagttgcaaagttgagctgccgccataatttttttgggaaggcaaatgtggtgccttgatgttcgtgtctagatatatatcgcggctgttccttttttcgaaaggtgtggtgcggccaccgtgcaagccgttgcagcttgactgagttttattgatgcgaatgccaccttttctgatgacatgggaacgacttgctcatttcgaaggatttctgagctagacctaggcatatatactgcacttccagttgatccatccagaagaaacacctaaaaattatactcttgcgaaaatacgagtactctctccgtttcacaatataaatcattttagcatttttcacattcattatgatgttaatgaatctatacatatatatctatgtaaattcattaacatcaatatgaatgtgagaatgctaaaatgacttacactgtgaaactgaggaagtaattcagattgcctgggtaaagtacagtatcaccaacttgagctcgagaacaaattacggtagaagtgctcactccgtgcccttctgcgagagcaatgaaccggaacaaaagcgttgcgatttatttacagaaagaaaagaaagctgcagaagaagaatcccattccccgaggccaatctacatcgggatcgtagtacatcgtagagctcgcgacgtcctcccggccggcggccggggccaccctctgacgcacgcagtcacccctgccgctctgatgccaaggtgccggtcgacgagtccacgtccgaacgatcgggatccgacggcgcaggatgccctcgcgtcggtgccccccacgtggtacgtacgtggacgcgcggcagggtgcccgtgacgtgggcgccctcctccgcgaaggctactcaccgtgtgaccgggctacgtgtcaagatcgcatacgtcactgctgtccccgtcgagccgtgacgacggcacgacgcgccggatcgatggccggcccggcgtgacatgaacacccttcagttgcgtggaccaagcctgtcccgagagaacgacaaatctatagtataggagtacaaactaaaccgagattttcgttatgtagctagtgacctatggttttagatcagatagctaggccggtttaagtcaccggaatgttttttacatggacgaaacaaaattcactgtgagcataggaaatgatggcgaaaacgacttgcatgttgctagtctcgtggtagaaagtgattttgccaccaagagtaattgcaccgaatgatgaacaacatatagcaatgcaaacataacgtcgtcatcgggctcaacatggtatgtctagctgcttgtcatgcgatatcatcccagatctctacagcaatagaccggctagtgcgagtgaccgtgacacccgatcatctcgcgacgattatcataccgtacgtcgtccgttcacatgttaatcgtaattaaactagcgcctgtccatgcctcctatatacttgtaaagacatggcaagacacttcgtagaatggactgcactttctctccgtccgtgtttacatgtatgttctttgaggtggatatgcttcaatgcatttacctgaaaatctgtaatttatttatctttaaaggaatatcgtaaaagatttgtcatgtatatattaatagagatgaaaacattatgaaaaaaaatatttacaagacaactttaaaataaacatgtctgcaaaaggttttaaaaaaatctgctacaagacgaccgccaaactaacgaattcctagagccttacagctcccgttttcacccaggtcattgcttctctttgattttggctatggttgtagccggggttacggcgacatggtatagaatatttgcatcgcgttcgtgaaaataaaatatttgcattgcgctccaactagagtgcacacaagaagacgatgatcatcaacctaagcggttttttaggccatatagaatcaatagcatctgttgcccaccagtctagcttcttaagcggtttcttcaggccatgtagaatcgatagcatctactgcaaatagccttccagtgagtcagagtctttccacctcttgtatgtggaggtctaggcctacccacttctagattgagtgtctagattctctgtcagcctacgcttgaccagaaggtggagtgttgttttccacgctgcgcagtacaacagacatatctgttggtttgatcagcctattctcttaagtatgtctactaaccagactgttttgtttgataggacatgaagatttacattccagtggcgcccgaagcttctaggttgtttgtttgctagttgagctgattatactcgcaaagtacggtctatatgtcaagttcaccatatactccctgttggccgtgagcttccaggtcatgatgtcataaactatgaacctagtggcgcctatagctgttttaaccacattcaaatatcaacgaaatgccatatatgattagcttttgtgatttgacgaatatttgaatccaggtgtcttcctctaggctgtcccacactaaacattctttcgttttgaggccataaagattgcagaggccaagagcctcggtgttttgttgtctaggcaatgtgagtcctagaacctcaccgtgtttccgttctcaagagtgatgatggtcgcaaacgcaaaatgatctgtgtatccagctggttaccagatccggcatgcctacccaaggtatctccaatgccttccaatattcaaaccaaagccatcgcaaacttaaaaaacgctcttgtgaagcgacgcgacgcatatttaggactcatcaaccacaaagttctttcggtttgcacacttttttttccaattcaactgcaagttttattctcgcatatttttaaacttagttataaaaagacatggtacgaaatataggtcaagattcattggcatacagtcactagcaagaattttagttctctctctagtctctactggtaaaaataagtatatagctcgctggccgctgcttgagctaaaaaagaatagttggcaactgctgctaatgttcaccatttctgaaatcttttgacctccaacatttgagatgccacctgtaaaaatgcgagttaaattttgatcttcggaacatgcagtggactatcccaattaaggacccagcaagtgttatcctctccgtttgaataatcggcggtgaaaaaaaaaattgaagcttcgtggcagcctcgactctgaacagaaacggccaacatggacaacgtgcggtgccactgcgatccctcgtgcaggcgtgcacggtgcagcaagctagctagcgatcccgtgggtctcgtacttacctcttcacgacgaacggtaatccagaacaaccgcggcccgggatagcattcgagacttgcgcctcgcggaatttaccagctgcttccacgtgacagagcctcacaaaatccacctgcctcgtcagactggtttgttgtcacgcgtacgtacgtaaatttgttctcacgcgcacgtaaaagacaacaggaatccaccgtgacttgcttcaccaccaccctgcatgcatattccattttccagagggaaaaaaggtgttcactgatctccagctgttcgcatggttggtgcccctctccttcccgggtagttggggaatgaaatgacgctgggattgcacggttagtaaagtgtttaaactggagttcttactgcttgcttggtttaaccacaacccggtccctctggtgtgcgggctgggctagctggtggccggctcagtggccctcgctttatttactccttaagaatcgttcgcttcagctgacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacgatggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccggtaaattctttggccaccttttgtcttgttaattaccttggattttgcagtagaggtgccaatcatttctggcagctcctgcatatcacttcttctgaaattgtcgtccctttcatttgctgaactgatctaaactagagctatgtattttatcatcttgttttacgcctcgagagaatttgaatgcattattagaaaaagaaaaattcgcagctgtttgttggctcggctgttacgctgtcccataataactcccgttaaaccacacaaaatttgtcgcctataattatgcagctccaattcgaacttttctcccagataacaaaaatggaagaaaaaacccgttaatgtacttgaactaacgataccaaaacggtagccttttaaactgaagcagttgactgccatgtactctggaacaaacgagaattccattatcaaaattgtttagcttacgaaagcatatagcacaataataggacgctgaatttactgtcggattttctgcagtacgatcaactcgcggagctggaatggctatccaactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgtcccgcctgctcgtgctgccgccgcctccggcctccccgccgtccccggcatccatggccatctcgccggcggagtctggcgtgtcggcgcatgcgttccctattaagaagccgtcgaagccggctaagaagaaagacgcgccggcgccaccggcgcaggcgcagctctcgagcgtgccggtgcactcgggcggctcggcgccagcggccgcggccggggaagggaggcggtgcctgcactgcgagactgacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcaggtggccgccgccggtggagtggggagcctaatgcacatgcagagctccatgctgttcgacggagtgtcgcccgtcgtgagcggcgacgacttcttgatccaccaccacctaaggacagacttccggccgcccatctagagatgagtcgtgtgctagaattgatcaattagcccatgaataatctaaaagaaacccttgaaccaaaaaaaaaacagaagaactgatattttcttaggagtttccccagtttttgtctcttttcccttcgtttagtttgtgcgcttttgctcagctcgtcgaatttttcgtgtcaattttgtttatgatgctctttaagtttaccaccttttctagccgggagttgatttctctagcttctacttatcttcctctctatcttgccatttaatttgtaacgcatttcaaggtacttaaatctcttcttccatttcttcctcccttctaccagaagatgaaaacaaacctgtttttctttttcttttttttttttggctcattgctttggcctaaaactaatcatcatgccatgccgttgcaagaccacttcacgatggttgtgtgggcaaccgaacatacaatacaagcaggcatgcaggatgcaaaggccaaaggaggcgagggcgccattgcccacctgtcgtgcgtcgcagctctagcacgtgaccatttgcacacctcgcgtgagaaagatgccctccttatggcagcacagaataaatggtggctggggctgggcgggcgggcggatgggcggaggcatggagcccctctcctcgctgtaaaacttttggccccgccctgctgctgccggccggcaagccttttgctgctgctgtgttagtgtggttgcgtttcatcattgctgtacctcgcgccggtaccacctggggcttggcttggccgcaattccggataagcaatcagtgacatgccctgcccggctggctgctggcgaagtgaaagctccgttttactcctacctttggcgtacgtacgtactcctcgaactggctgtcagaaagtcagcagctcagaacaatataaatggcaggcaggcagcctaccgtacgataggccacttaacctgccggccgcatctgacatacctgccagcacccgctaaaaatatgtacagtactcctaactgtggaccttgggtggttattggttactccgatcctacccagctgtgaagctagtcctgttaaacttgatcatttggttgcaggtcagtcatttggtaacagtagtagccagcaagtagaaaattaaccatgagctacgtagtagcttgtggggggcactgtgaactgagcgcatgtgggctctcactaccccgaggggggggggggacaagtggaggagtataaaaaccggcgtcgtgctcggtcagggcggcagctacccccggccggtgacgggcggaggcgcgcgcccgagccgcatgctcacatgggaggtggcaatagataaacccgagatagaggagagagagggaggatactagtagtactacgattacagtactagaggccggacggagctctggattctgacgacggactacgtgctgggtcgggatagaatagtattcctaccagcatattgcgagcggtaagtcgccttggcccctgcgccccctcgtgatcccagacacgcagggtcgcaggcgttggtgatccagatggaacgatgaattaacggccaatatactagtaccccctccgggtacggtgcttacgttactgcatgcgtttaattatgctcgatgtgatagcaggagtgtaaaaacaatttttggcaccgaatatgctcctggtcatggtggcatttctcgctggttctacgtgctccggcctcggtagcacaagcttgtgcgccttgaccaccggcaggaggtgcacgggcgcggcctgggaaccgtcgcttgctgctgcgagcacgtacacacccgtgtacatgccagcatctgcgtggtaaatttgccaccgtagtaccagcattgcagcgcgtacaccatgtttaataatttcagcgtggctcgatcgctgttaattgtatatatagtatctgctagctgcacgtactggttgttagtccttcctgggtacatgatcatatcacatagtcaaagccacgggctctctgataactaatcaaacagaggtactgctgattagttagctgtactctggaaaagggagatcggttgatcagggatcacatcggcttactagatttgttacgggttaagtaaagtgggggcgggcatgcgagccgggaaaggcctagtgggctgtgggcggtgtcacatgcatgaatcctgatgcgtcgtaaccgagcgagcgcgcggtgctgggaggtaacatgatggagtacgtagctagggaggccggtcgatcggcgcactcaccgtttgcggttagctcgagtgctcgatgggtcgggacggtggctgtgggcgaacccgaatcggggtggtgatgaacagtgtggctcacgtctccgggcacgtgaaagcacgtgcgcgtgtgtgcgtgagagagcacccgcgccaccgccgggtccggcttttggtggacatggagggtgacgagacggcgatgcgcggccttgccccgcccggcaggcaagaaccccggccgcgcgcggccatctgcgctaggcacgcacgcatgcatcaccacctgcagcttcttgatttactcgcgtcggtcgatctgcttcgaggcgctgctgcctaacctgccgcagcaatatattgcaatgcatgcatgcatgcctgccctgcctgatcgatcggagatattttcttcagcgctttcgtgccatcaaggccatgcatgattgcatgttgtgctgttaggttaggtaccggtactgatgtgtagtagtagggcacttttcattcgtccgtttagtttcaggacccgtgtcgtgaaacatatagcccgtgtggtttctgaattcaattctgacgctgactgtgtgtgggacatgtcatttgtgtgcaagtccttcagtttgtactttgtacgtggtagtctctaaaagaatgagttggtcttcatcaggtgctgctcccgagtgtagaggaaaaaaaaaaggtcgtctctcttctcccttttctgggacttactatgcaacacgtacgtacgcttatcagtccacatgcttcatttttatcatgaccactggccagtggcttgcttgtgtcctttcgttccgacttcagattcgtcaggacgtataaatgaaaggaaactaattcatgtcattcagacttacgaatattttcgtcagacttaagatctagtatccggccggggtccttcaacatgaagaaactgagtttttgtgttcgcaatatcagaccgcaaggggacaaactaaaggaagttgatcctaattaatcttgcaaagcgaaagggcctgtagcctaatgattacaagaaccttgtcacgccccgaactagtcccgaccggaactagcccgtgacgctccaaattaacctgttaatcgataccagtcccagaaaacagtgctggtatcacaggaagacagaatatcacagcaacagaggtctctttattatagagtaggagtacagtcttgttgggctgcggacagaccccgagctcacaactgcattacaaaaggaaagcggaagccaagacttggaccaaacatcacaggcgcgacttgggaactaggccgaaaccctaaaactcatcgtaaccggcttgctcctggaagaactcctcatcagcaggatccgcttcatcttcttcagcagctggggaaataagtgtttaatgcaggcttcaaggaaagactattgcttttgcagttgattttatttgaactcttttctaaaaacgactaagtgagtgcttctcaaacgacacggatgagacagtgcgtctcgtccggtcggagtatgtgcaatgtatcagtctttagaaatgattcaaggttggcacccagccaatagcttttcaaacggccacccgggcctagctgatcccgtcagctacagatttttcaaacatcgaaccccttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcctgtgggaatcagccacgtcgggagacctccaagctttcatgacaaggcatttccaaagccgacacaggtttaccatatgccgacgagaggggtcacagaccaacaacaggttaggtcccagaccatactgcgccaggaagcccaggggtcctccccgacaccaccccggcgaatccacatgtctctcggcatcaaggctcccttgataagctagttactcagccaggggtgtcccattccacccatgtggtcgtacttgtcttatgtttggatgaaattccaaggaaacggtccttaagtgcgagagcgggaaaccgtacacccggtacgttccccggtccgcggttttggaaattcatttagttcgcaagcaccgacccaggtgtcgggttttccaagtcttttataaaacccaagttttacccaagaagtttttcagattttaagtttgaaggcgtccgtcgatactcgcacagggtgcatgaatatcgagacgcaactagatggttacaaggggacacgatataacaattatcaaatgaaggatcaaatgcaacaatttaggtaggtccgccaatctgccttgcagacgggacaacagattaagtgcgatcctatcaatgcataatattttgcaagcaatataattaagttcaaatataggctcaagatgttcaaaggtggcttgccttgctcgagatctggagcttgatcctcgaaatccacgcactgcgggtctttgggctccgaaactacacgcgaaacgggacaactcaacaaacggcaaaaaataaagccctattaatgacctctaagcgtgccattagatagatctcgagatttggggaattttggaagttgaacggagtcaaatggatttacggttgggaagatattgaatttctaagattattggatttttggtctaaaggaaaaaggatttaattaaatcctttttgaaaaagaaaagaaaagaaaaggaaagagggagggaaaatagacttccctcgggcggctagggcgcggcccgagagaaagggcagctcggccgagcttaatgggccggccggaccaagaaggcggcccagagcggcccaaggcacgcgcgcgcgggagggaaggagagagagagccggtggaccgggctcaccacgcgtggtcccgggtgggacccacttgtcggtgacacggttcaccgtgcggagcgagcacgcggcgcacgcgcgcgggcggggaagggatgcggtgcacgcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggcgccaggttgctgccacgcgggctggcgggaggtagacgacgacgccggccggaacggacggcggacgacagcgacgagcggcggagcgaaccacggcgatacaggcgagagcgagcataccgggtggttgctcaggacgaggggagacgagctaacggctcggattcgccggagggagtccgtcggcggtggattgcggcggcggcaaccggcggagagaaaaggggaaaacggcgacgaggtcacgaggggccaattcccggcggcgagagcatctacgcggctacgggaatccgttgctagcgtcggattgggcggagctacgccgagcgaggccggcgacgagcggcgcttcggagctcgggcggcggcgagcacacggcgagcggcggcaatggacggggcggcgccggctagctacggggaggctactcgtgctaccaccgaaaactaagggggggagatggagcgaggaggaggaacggagggaggcactaccgagatgaggagcggagggggagggagagagggagagagagagagagagagagagcgccgggagggagggggagatgggccaagagagattcggcccatcgaacccgggggaggcaaaatagacttttgcggagggaacgatttggaaggatttggattcgggattgaactcgacgatagatcggggatttgagatctgagatggcacggacactagacaacaagcgaagaaacaaatttcgcaattagggtttttaagagataattttcccgctaggcgccacgacggaacgggcgctacaaacctcaatagcaccttaggtccggggttcgactcctcgtgagagcgaattttccaggatttaacggtattatatatagattaataactttagggttcaactcttcttgggagcgaattttctacccatgggatgtttttcgcccctaacggaaaggggccggggaaaatgcggaaaatgcgttcgcccctaacggaaagaggccggggaaatgcagagcaaattttccaggatttaactgtattatatatagattaataactttagggttcgactgggctggggaaaatgcggagcgaattttccaggatttaacgatattatatatagattaataactttagggttcgattcttcatgggagcgaattttctaccatgggatgtggaaaatgcggagcgaatttttcaggatttaacggtattatatatagattaataactttagggttcgactcttcatgggagcgaattttctacccatgggatgtttttcgcccctgacggaaaggggccggggaaaatgcgttgttggttggcattatatatagattgataacttttcgactccttttgggagcgaattttctaggatttaacggcattatatatagattgataacttctaatgatgatatgtataacataccagacccatgggatgtttttcgcccctaacggaaaggggtcgggggtcgggggatgaaaatgccgagggaaaatgcgttgttggttggcattatatatagattgataacttctgatgatatgtataacataccaaacccatgggacgtttttcgcccctgacggcgttatatatagattgataacttttgatgatatgtatagaataccagacccatgggacgtttttcgcccctgatggaaaagggcggcgcaaaatgtgttgttggtttcactgtgcgttagttaatcttcttaaattaaaactgttactccctccgtttcataatatatatctacattcataacatcttgttaacgaccaaatttggtaatctaagtatcggagatgaagaaggaatcgaagcgaagttcgagagggagatcgcttcggaaacagagtaagaatcggctggggtctgagttggctgcgatcaggatcgacagagtccgagttggacagggttagccgattgagccgaatccgacaatgtgtcacagcgtacgttgtcgggttgggttgatgtgcttcatgaggattgccgcgtatggatagagtcctgagaaggcaattgtatctattacttaggatattttatgtaattttcttagagatatgttcgggcaaaagtttgctgtaaagacttgtggtattttagagtttgttagagataagagtcatgtcctaaatggacatattttgtaatctcgggtataaaatagaccccgagccccatgtaataaaactaacacacgctcaatacaatctcggcgcatcgccacccttttactttcgttttgttttcgacgaattcttgcttttgggttgagttgcatcggtttcgatcttcaacaagaggtaaaacttattatggcggcttgcgttctcaggattagtgcttacatctttatgatactctaatcctatttatgtaattcgtcgagttatcatatatcttacataatctccggcaatatcgctatctattcatcaatcggctaacgtctgccactagagggcagccgattaagttaaataccgatgttgacctagattatataagatatctaccaccctatgaaacatccagcgacttgattgtctagatattatcattcttttcatacttatagctgcatcagttgagtttgatcttatgagtcgtgattagaatctcaatctctagcctacctttggttggcgattagagtagcatcggggtttcagccgatcttacctgatttaactatatttatcttatatgcttgattgacatgttaaatctgccctttatgctaagatcttgtcgcatttaagttattaggattttgtttggtatattttacttgctttgatatcttaatatagagtggtatcggagtattagccgatacatgctagatctatctgatcggctatgctatgaacatatataatctcattgttagtatatatttcgatctaggtgatttatactgtctcggcatggcgaccgatctatcccaatcacttgatttaagcatatatcaacataaggattatatattgttaatatctacagccgatcgagtagatttagtcctttcttacttattcatgattaccgatcgattcacatatgacatcggcttgaagataaatgatatgtcatcggcaactagccgatcggctatcgtttatggatttaaccgcggtttcttcgtctttgtttcttgttgattgcaggatcaaatcaactgacacgctcatacatctaaaggcaagcttttggacctgcactggagttaagcagatctcctagacctcgtgttttcacgtcaacacatctatacgaatgtggataatactaaaaagtcggacgtttttcgcctctgacggaaaggggccgggggataatgcgttgttggtttcactgtgcgttagttaatcttcttgaattaaaactgttactccctccgtttcataatatatgtctaggttcattaacatctatatgaatgtggataattaaaaaaagtcttacataatgaaacggaggaagtattattgcggttatcagattatgagatatcccattagcctatagtcttcggtgtctaaacgcctatcatgaagacatgaagcccactcaaactgccccaagtatcgggcctctttttggggctacaggtgatgtgtggatactctcatggaataagttcatctaaggtccctaaattttacactgaatctaattttcgtccttaaaccccaaaaccagatacaaccagtccccgaattgtcaaaactggtacaaatgaggtcctttggcggtttggaaggcggttttggctgacgtggcgtctacgtggctggtttgactaggtctccatcccacgtggcattgacgtggcgcttacgtggcaataatagctctgaaaaataataaaaaactgtgggcccacatgtcagctacacataaaaaataatttaaaaatggtaggacccatgtggccccacatgttagccacacaaagcccatgtgggacccacatgtcattccctctcccccactcggctcttattcttcttcctcatcccgtcgcggcgccgccccacagccttaaagccgcggccggagcggcggggcccgccgcgccaatcaaccgccgtcggccaccggaaagccggccgccaccgccgccgctcttcccacttagcccgcatcgcaacgccacaaggggacgcgaccgccgcctccccacacctccggcaacgccgcccggagtcgcggccgcatcagccgctcgctgccgggggcgccaatggcgacgatttcggagacactgcccaactcggaggccgtctcccacgcctacaagttcgcctccacctgggagaaggtcggtttcctcgcttcgctgcgtggtcgggtgggtgtgtggtccagtggtagcactggtggatctggtggatctgatctgatctaatggtgatccagtgtgtttgatccatagtccctgttgcttgcgatgactaaatgttgtgaactgatgctaccatggtttggtttagtttagtttgtcgtgctatgctcgggatagactaacccgtcaatcgtatttgaaggatttgagatatttcattagttgcaacacagcatacatactccatttggtagttccttattcctcctcttgtttcttcctgtgctctgcttcctctgcctgcgccatggccgcaccaggaagtagcctcgcgccgactacctaatcgtcggcacgctgccacacttggtcaagaatcaacaccatctcgtcgagtggtcggccggcattgtatgttctcgacaccggatttggcacaacccccgctgctcgaagcgcagggggcctggagctcggggagctgagggctgaggcacctctccgtgatttcaacagcgcagctcaccgggagagggaatgacatgtagggccatgtgggttccacaatttttctttaactgacatgtgggctcatggtttttattatttttctgaaatatgattgccacgtaagcgccacgtcaatgccatgtgggacgaatacctagtcaaaccagccacgtaggtgccacgtcaaccaaaactgcctcccaaaccg

SEQ ID NO: 922 - DNA, 5777 bp, Oryza sativa
  unsure (1)..(5777): unsure at all n locations
gtttgcactggttttgacaatagttgaactagccaactaggcctttatgcgcaagcatttacagtatatgcctatgggctttcagtttcagcgaagagtaagcattaacggggttcggttggtgggcatatatcaggactgcatgtctgtatatacagccatacatgtcaattgaatacctggattcctatctctcccaaaaaaaaattgtattggttaaaattttggtacgccaaccgtgtttgaattggttataagttgttcgtatctaattcgacgtgaatgtaaaacaacaattatacacccctcccaacctaacccaatcgactcacgccatcccgatgccccgtctcgcacacccctccctcgaccggcgtatttttttctttccctttttttcattttctttttcccctaatcatccttatcttctcccgatccttccaatctcctctcttctctcttttttttcttccaaatttctttccgcaaattataattatttaaggtgtgtatgcgatatgtttgctactttccaaatgctttccatctatagtaaaagaaaatttcactaattgataaaatttcaatctttgatagatgaggtgtagctaaatacacatgcatcaacttatggaatagccacctatcactactggagagggagagactcccgagtgtcaaaaacactcggcaatgcatgaaaaacactctgtaacagtgttacctagcgcaacactccgtaatcttcgcctgggagtgatttctccttcccgtgcatagttggcgtgtgtcctaggtggatacaccccgtaacagtgtgataattgccgtgtgctctaggcactcggtaacattttcaccccaccgtccaacagaattccacgtgcaacggcgacagagacggaacggtcacggcacagttgcgtagtggagagaaagttaccgtgtgtttttcaatcggacacacccggtaaaccttctcttgttatcgggtgttgacatcgcatgacacacgttaactttccaagaaacacacaccaacagtgccctcgttaccgtgtgttcagtttaggacactgtaatgtgacacacaggaactctacttgagggcaaactaaaatgggtttgctgattcatttatattatttacttccatcagaatagtaggatcctaataacacatcacagatgatcacaaatacaatggtagaatggatttcaatgcattgacatccacgtacaattaatcagtttggcaacaatctaatatgaaacaatagcaatgtcaatctcatcagctacatctgagatgtaatttgaatattaattcttaagcttagataaccaaagaggtagtgcaactagaaaagagttgacgaatggcattgcaggcagtccgacaacaccttaaataatatgcagatgagccagttgactagcagatcctgagatttcaaataaagaggtaagattaattaggtaggtcagctttactttaaaacaacattttatgtacatgtatctaaaacagtgatagcacatttatatgaaatagcattagcagaaagtttatataaatgatctatgcaaataaaaaaactacctgaacttattcatgctttcttcaagaattgtttaggtttattacaaaattcaggtatagcaaaagtaattgatattggaaacttttattgatatggcacatgccaagaagcgctatgcacccaagtgactggtcaagtgctcatagaagttctttctttatactagccaagtgcccatgtattgcactgaaatccaaataaatgattgcacatgttcaaaatagggggaaatgcaaaattgaaatcaaacctctcttatagaacttcatgattcctggtatataatgttatttaggataaaaatgattatgatcctaactcaaacaattcttgctcatctatcaaaaagtttatcttactatcaacaatttatgggatttgtacaaacaaactcatcaatttgctagcaccaaaattgtaaatcatgtaatcagatgacatgagttaattagggttacccctactaatttttctgtgttattttctcatattcagaaatccaatggtatgagaagaatcaattaagagaatatacaatagtaaattcaatattcagacattgtagtaaacggaactttgcttgtagtacctgctttggtgttggtcatttacattctttatttgtcactcttcacctagtagacagagcaccaattgattgagaatctactgccttggctatcccaatgcttgtcattgtcctgaaatgaatacacagagtgaccttaggtgggtaaaattgttgtggcttatgtcagcaaatcccctgttttactcacgcgagactgtggctatcctataactctgaccttttcagacgagaaacagtttactgaaaaacagagcaaaacgagataacagagtttttgtgctgcgcaatacttgcagttttttcgtcactcctctttatctatttattatcctccttataaactggagtttgttacatgcatatgaccacgtaaacactcgatccatacattgcgccatcccacaacagaatcaagataggtcaccgatctgaaaatgcagctaactgaaaaaaaaaactaactgaaaactaactatgcaggaactagtctaagcaacaacttaaaatacgaatcacaagattacaaatttagtcaacagcttattccatgataattaagttgggcctgttaatttatgatttaactaagaaaaaggaaacatgccaacctgagagagagaaatggctccctggctttgcagcgagtagaatgtctgaggtggtgcctatgatggcttgaaatggagccgagctagattggttcagtactggaacaaacattgcaatgacttcttggaacatgcctccaatcttctgaaaaaagggaataataatttcacacaagtaaattttaggcatctctaaatcaaactacagatatatgtacagttggttcatactccatatgattttagttgtgttgtactggctggctcatggaagcaatcctcaagaaaaggaattgcatcatatagataaaacaagaattttatctccacttaattccagtaacttgcacaaaagcacaattgtttcttctcactaacactaataaaatgaaaaaaaattgataattgtaaatagctacactttgtcattatgaaagatgaaaaaaatagtttcattatcagaaatatgtttaaaccctgaaaacaaatgagcactgaagaaaggtgctataaaaaagtactcctacacgacaaattgaatataagtatatcttacaagtagttactagctacacgagaaatcaaatctgagctccaagttctccaccagaaaccaaaatgcgtagttctatatttagagggaaaaaataatattctagaaaaaagccctttgcagctgtccaggtgaaaagtaaaatgcttctcttcacaaatcaaatccacaagggcccttctccatgcgtgcaggagggaagaaagagacatggggtgggaagagagagatcataccatggagaggtagcttgcctgtaagtcttgcccgggtccttcttcacctaacttctgtattaacctataaaaaatccccaattagaaaaatcttgaataaaccagataacttagggaatagcccagatattatagatctgggacaaaggagcttgtgggaaggaattgacctgaggagggcagcgcggcccctggccatcgtcgcgccggagcaactgccatgggtgaggtggcnnnnnnnnnnnnnnnnnnnnnnnnnnnnccggcagtctggtatccccattgctccggcgagtagggcaaaggagaggatgttgcggagggagggctagagctggagcagcaggaagagggggagagccgcaagtacggcggcagcaccgaagtggggaacatgacctccagacgtggcggcagggctcgtaagtggaatattcgggggagtatggagcaggtggcgctggatctagctgacccgcgtttgtcggcgtcagagccggtggatccgttgctccggcgaggagttcaaggggaggaggagcgggaggatttggacgcgccgacgcggagaaagggaaaagggatgtgtgaaaggtgttactctgggaggaggataaggttggagaggcgccctagtaagataaagatggggaaattgcattcccgcgcgcgccactagaaattgtaaattttgggagagattttcttttcgtttgtacattaagcaaataattttctatttgttataactggtttctttctacatcaaaaatattcattgataaccatcaaattgaagaaacatctccgttttttaattgaaactaccatgatttttctgaaattgaaatttgaatgctacctagttttttaagctaactgaacacgaatttggaccggtttatgtcaaactctgatggagtttcattaaaagcaccgagacaagcatcccccatgagttttgagaaaataaaatagttttacgaaaaaataaatttcagtttaaatgtgatgaaatttgaaaataaataaaggaaaattgtaggaatgtgtggaaatgtttggggaaatggtgggccggcggagtggagcggggtagcagcggcggtggacgagcgcgcggcaggcggcagctagcggcggcgagcgagcgcgcaataggagcagccgcggcgggcggctagcgagagtggcgtgcaccccacggcgacgacgatggcgacgcaagctcccatgtcagctgatctctccggcggcggcggtagcggcgtcgggctagcggctgggctcgccgggcaagtggcggctgtgccgtcctgagagtgagaagacgaggtgggcgggcgcttccgacgcttcttctcgtaggcgatgccgcgcaccttggcctggctgtcacagacctcgcggaggtagaggcggacaacgcgggcgccgaacgggttggcctcggggtggcctccgtgctcgtcgaaggcggtgcggaggcggccgacgagcacgtcgaggctgccccacgcctggcggagcgggcacggccatggcgccggcgatgaggggtggctccggcggccacacgctcgtccaccgcggccaccgccacgctcaactctgccggccgctgtcctcgccatctaagagagaaaagagagagagagaaaagagagagatgaggagagagacaggagatagagctgacatgtgggcccaagggcatttttgacatttcacgcgatttctctctcctccctaaccggaaaatattattttaattggcgcggtgtccactggcaaattatcacgtttatggagtgttttccccaaaagtgagtttggccaatgtcctagggctaaaaccacacataacaagtgtcctgtagcaaaatttgccattaatataatgtataaaatatatttaatataggatttaataaaattaatttggtagatgttatttttttataaacttgatcaaacttaaaaaaaatgagttcaaaaaatcaaaacaacttacgttctactccctctatcccaaataagtgcagccacgagtttctgtgtccaattttaatcgtccatcttatttaattttttttttaaaaaaactaaaaaaacataagtcacgcataatgtactagtaatgttttataatctaataacaatagaaatattaatcataaa

SEQ ID NO: 923 - DNA, 11625 bp, Oryza sativa
ttttttttacttacagaactgccagggtaatagagggagtagtcaccgaaatataaatgcttattttaagaatgacgactattttatttagcaaaaaaaaccccaagagaaacgggatgttcagatttaaaaagtcacgtagcaaattaaacaaatcaatttttttataactctccaactaacggaaatatttctcaatgttcattgacatgtggcccccaccaggccaccaacatctcctccgttacatttgttatggttgccgagtgatgtacaatagctctttgtaaatatcagacgccgtcacgttttccgctacttttctgtttccgccgcatgggattcgctcctgcgccgtcccctccacagcaaatgcacggacgccaaaagaaacagccgttccccaccaatgaaacgtgctgtactgagggacgggggactcacattcgctagtgtaatactccaatatcctggtgttccccagtgttctaaatgaacactccgtaacagaagttgttgcagagtgttcccctgaaacacccggtaatttacggagtgatagaagcacactacataaactttctgctcatacccgggagtgtctcccatcctggtagtgtatgtaaggctatgaaaagatgtacatgaagcattcttcatgtgatgatgcatgaagcgagcgtaatcgggctcaaatgatataaatgatttccgagtatgttttgccattgttttatttgtcttatttcagtttgtcgtttaaattggcagggtttttttttatcaatcgtaaaaattgtcttcacctgttgcaatcactaaatagaagcagggtgacaaaggagtaaggggtagcgactgacgtgacttttgaaaaacacagggatgataaggttaagtccttcaaagtcctaagacatgcaatgaaataactatttaacaaattttaatcaaaagtatatgtaaaaaaaaggtacatgccttacatcatgggacgaagggagtatagttttgtatgggtgcttgcctcgcagttgcgggagccaccagctagtttaatgaatatattaaaacgaataaaacagcctgttataatggcttctctaagttcatgtctttaaaccaacagttgagcataaataattactgtatggcctacattagattgtgagcagaataaaatgaaaaagggtattaactgcttttttttagacatataacatcgtttactctccgatacaaagattaccacttgacttatcagaaaagactttccaagtgttatttgtttaatttacttgttttattattaacgttattttaatatagccttttcatttacactatattttaatacacatgaaacattatgtaccacgaagaaagtataagtgctactccctccgagctgataatacttgtcgttttagataaagatgaggtcaaactttagaatctttgattataaattatttttaaaatatttatctttcaaatatggtgattacgtgcatagattagtcttaaaaagtattttaataaaattatatatttgttaatatttttatacatattataatagaaaataacggtcaaagttgtttttggagaccgtgctcttgtccaaacgacaagtgttatcaacctcagagagaacatttggattaaaagtcacggaatattcagtttgaaaaaggttggccagcaaaagtacggcacggctacaccaaaattttttgtgatcaaccccggaaacatcgattgtggctatcattgcgtaatcacggccgcaatagcggaataaccccggagtacagacgtgtcaggccttgaatgctgtcaagtgtgatcgaaaagttttttttgtcgccatgcataaagagatacaggtggtgaggcaacatccgtctacaatgcaacgataaacacccaaaggctcaaaacttattataaaccataacggttaatagctataaaaagttctgtatatagaatttatatatttttcttaggaacttaaaatgtaaggctgaaaaaaagcaacgttaaaaatatattaaaattaaaaattaaattttataatataaggttagactttggcttattccttttagaacaaaggatgaggctcccatctgccatctgccatttagccaaagtattttttttcactcgagtgtatatccacatgttccatacatgccacttaaaagttatcaaaaaatttaaaacaaattaatataataggtcaatatatgatatattattccacaaacatataaatttattaagttcgatttaaataattaaaaaaaactggctataaaatgttaaatttgaacttacatgcatgtggaatgatatattcatatatacatgttaatctatcgtacactactacaaactcgatttttcatagtatcaccctatttttttctctagtggttatacgtggaaaccaccagcgaaaatgaatcttcacttgcggccgggttaagagagccgctagcaaaaattatagatattttcgctggcggatcacttaaataaccgccagcaattttcgctagcgaatgcttaggagcactgcctaagaatttattttcgagatataaatcctacccacctctcttcgcctctcccacccaaccaactttctctgcctctcccacctccagcctccctcctctctctccgtctttctcgatattcctccggcctccctcctctctccaccgctgtcggctactgtcgctttcgtcgtcgccgctgcatctgtcctcgggaaggcgagagtgaggaggacggatccgcagccgtcggagggcggggagcgtggatcagctgccgccgggccgcggggcctcgtcgtcagtagcgtcgcagatctcgtcgtcacaaccgtcaccgctgggccacggggagcgcggagccgccgccgccgggccgcggggagcgcagagctgatgcagccaggccacggacagtggtgctcggctggtggtcggtcgacgacggcgacaatgagcggtagcggcttaaaatttctatggatttgtgtttggattttctgtcgatttgtgcaactatccaatccggttaatgtgtttaaagatgggaatggaaattgctgtgattttgaatggaaagtttttactgtaaattgttgatgtaaatttctgtggatctgtggattaaggagtggatttgggaataatttgaacgccacgttgatggagcggtgtcgctccgtcatttttttttagccttgtccagtattaagactggcggctgatatagtgtaccgcccgtgaaaattcagctaccgccaatcactggcctttagtcgctgacggcgctgttggacgccagcaaaaattcattttggccgccggcaaaaaacgatttttctagtagcgctaccaaatctttctacaaaattgatgaatttttagaactagctgggtagcacgcgcaattgcgcggctagcacccaaacaaaatcattttttttatgattttacttcaaatttattgaatagttatctcgttgtctttaaaactttgaaagattaaacattttcatccccgtgtttctaattatatagtttttaaaagtcacaccagttgctaccccttacttctgtcatctccttttttatttgcttgctcgatctaccattatttctattcattctccttggaacctttaaaaattggagcttatagtttttatagtttattgtcaaacgatgctactatgctcctctacggctcgtccgccgcctactcttcattgtcattgggattctaaaaatcaaacataactatcattggaattcattttttattttctagaagtctcgccaaccgtcggcggctctacaactttacacctatacaccccgctcgttgcttctcctttttattatcattgagattttaaaaaacgaatatatcaatggggtttatttctttactttctagaagtcccggcaaccgtcttacccatttgcttcacggcctgtctgtcgtcccctcttttaattgttattaggattatatttggtgttttattaacagcttttatatgttgtatcaaccgccacctttctactcctttctatgccttttacataatttatctcgtcatgtgttttagatgatcttttcttccaatattctttattttttatcaccaattttagctatttataaattgtattcctaattaaaatcttttttctttttctaatttcagaatttattttattgtttcaaattttaattaatatcgtattgtgttctttaaatatttttattttttattttcaattttatttgtttcaaaattgtattcctacttaaactctcttttactttttctaatttttaatattattttattttttattctaaattttaattaatctcgtattgggttcttaaatgtattcttctttcaatattacttattaatttcagttacttttaaattgtattcctacttgaactcttcttttgttttcttttttgctaatttcggattttatttttatttttattccggatattaattaatcttgtattgggctcttatatggactcttctttcattattccttatttttaattcctaatttcggttatttttaaattgtatgcttacttggactctccttttattttataatgtcagattttattttatttttaattctaaattttgattaatctcgtattgagttcttatatggactcttcttttccttttctccgattaatgtgggaatttctagccccacagcgaacgtggtgcctcctttcaaggctgttttaatagataatagatagatagatagatatgcatggaacaagtatatacccacgcgagtgaaaaaaaaaacacttccaactctttatttctgttcttgctcacagttttcatgctctcactgtcatagtgtcatgattccctcaagataataatacacttaagaaaatgatatcagtgccaatattaatttgaactagttagcaatatatttattttttctgcaccactcgagagcaatatgctgcagacgtgacctgccaagtaggcatcctcaaccacgaacactgtaatgatgataagaccatgcaatctgccgatacgcatcccgtgagtccgctcgcaactggcgaccgagcggagggatgtatcacgacgctggtcggatgtgcctgtgcgcgcaactgacaacgcaaatggaccggggtgaaaacctcggactactgatcggtgcattgcatctcgttcgacgttttattaataacctcagtcaacagtgcgcactctgcagtctcagaaactgaggagatgctttgtagtctgtagtctgtacacttggccgccttttgtctctggcaggggcgtgatccgaacacaagttgcattgcacctgtgtgcatcattacatcggtccatcccccttgcagcaacccaaccctgccggccggttctagggacggtatctggtaggcttgcccgcttcctcattctgcctatatatacgcgtccgcccgcgccggataagcaacaaaaacttcattttagttcagggtatcacggtatcattacctaaacttcattttagtccatggcgttcatgagttcagctagcgaagaggaatccgctggtctcaaggcccccacggtaatctcccctcctgagtcctccaatatacacgctacgtgcaatcgtgcacagcacagtgcagaccacacacgtacgcctgaaatggaattaactgtttaattatcgactaatctttgaaactcacgcacgcctgaaatggcatgtactaacgaatgggccaacaatctactagtcttgcaactcattctttgaaactcactcacgtacgtcgtcatttcttcgtctaatctttgaaactcactcacgtcgtcatttcttcgtctatggattgtcaggatgcgcgcgtgattcgtcagcgctatgaaggcgacgggccgatactctcggacgacgcgctactgccagctgatccaggcgcggccgccggcgcagcggcggaacaacagcagcagcaggatgaggcacggagcgtgcggtgcgagtgctgcggggtggcggaggactgcaccccgacgtacatcggccgcgtgcgggagcggttcgacggcaggtgggtgtgcggcatatgcgcggaggcggtgagcgagctgcggaggcgcgacccggcgctggcggtgcgcgaggccgtggcgtcccacgcggcgctgtgcgccgagttcaacgccaccgtgcgcgtcaacccggcgctctgcctcgtgcgcggcatgcgcgacatcgtcaggatcagctgccgcggccggagcggtgactccgcctcgccgtctgcagctcccggcggcggcgccggcgccaggatcggcaggacacgaagttgcgcgctgccgtacgtttgatcgcgtcgcaggttgccacgtaagcgatacgtgcgtgacagaccgacgacagccagtatcgcgccagatgttctctgatgaatgatgctactaacagtctaattaacacgaagtacagtctactgatcgacgtgaacttaagttgtgaattgtgatagcctatatatatatcgggattagaccattgaaccgctttcaggttaactcaaaagtatctctaattaatattgtaaggttactggcggtctggcggatcgtgaaatcgtgatatatatcgacaaaagacatcttgatagctcaagtgcgtgtcaccaatgtaataattagtttgtcaacatctcgatcgatcggtatgtcagataacaataattttgtagattctcgttaaccatagaatgatgtttagtctttgaggacgtactaggtattaaaagataccaaacatgatccattaatctctgaaaatcggatgagctaaggaaagtcggtaccagtaagcatcccttcccacctgtaccactatctttttttgttcaagggggaaaagactactttctttagtctcttgaccgatcgatagcagctccggttgcgtgcaacaaccaccccacaatgagatctgacagccggctagctgtcgccgtcggggcaatagattcgggcgagggcagcagtggaaggcctcctcgagcctgtagacgaattggaaacaagcacgacgaggaggaggccacgatgataagctcaacgcgtcggatgccacggccttatggacggcggcgaactcggaggaggtgggctgatgggggccggaatccattcctaatacttcccgacctcctcgaagactgtgggaacaggcggcgactgcgttcgggtcatgatggcgcccttcctagttccctcctgatggcgcccttcctagttccctcctgatggtgccattgcttcctccctcttttccagtctattcttggcaatgtcgctcctcgttcatcctcttcgatccgctctcgctgccaccgcctcctccctactcccaacgacgttgtctcccctttgctctctcactcgggcgcgctgcctccccttcacccccaccaccaaggccatcatgcagtagcaaccgcggattcaggacctacctagacacttccaatggcggccggggttgtggcagctgtcgaagaggagaaagggatgcatcctggcatccattagatattttttgcagctgtctatgacagacaggtccactttttgtttacttcccatgacagacagggcccacttgtcggatccatcttcctcgtttcctcttcttcgtcagctgatctaccaagctacccagggccaggcctaggccaatgccataggtgggaaatcctttcatctcttgcaccacgcacatccttatccaactattttttattctctttccactcttcctaatctcatcatctatcaatcccaaagccataatctcgagcgttcggcgagttccatagtgccactgtctgtgtctcttctctaaccctataacccacctgcacaggatagcactctagtgcaccgcctcaccctacatatatccatgcatgattggaagtagagtatgcaaaaaagtataaaagcatggcaacttcgcttggttgagcaattggactacaggccggagaaacgaaacgaactgcaaggaagagcggcggcatggtgacctcatatctgtctccaccacaatgagaggagggaggagacaagacaacaaatggtgacgcctacgacgaatggaatcaaccgagaaaggagcgttgtgacctcgatgcaacggacgaatggatgatacttcgatttccaatcacactcctaacagattgacggccatatgtgaatggtatttggtagtacctcctcaagaatgataaaaatgttcttattaatacatgctatatctataatagtattctaggtagttttttttcctaatcaaactagtatgattttgtaagaagatactacctagctgtttattaagattttggagtctatatatatcacacagtttttttaagtttcaacctttgaacaaggatccaatgtatatgagcaactactactacttttgggcctcaatttgaccggaccaacccaatagtgctcacatgggctgcaaagaaaaaaatcataacggaccatatttagttttttttttatcatcttgtagttacgaccataactatagcgtaattgcactaaggttacaaccgtaactagtaactagaatgcagtattttggctatgtaagcctgtaaccaacgttgttggcttgctcagttggtgaagtaatatgtacagtattattgtagctcgatctcaatgcaatcctacaatcaagaaatcgaaaatttcgtagcacgaatctcaacacaatcctatgataagaaatcgatatgtttctaataaataatcttgcggcaggtttatagcgaaaccgtttggagaaagttgtagcatgaactcaacacaatcctacaataaggaaatctacaaatttctaacaaaaagaaatttgcaatagatttatagcaaaactgttttgtaattggcagtcatttgacatgcaacctctaaaatatttgcctataacattttttaaggaaaggtcgtcgaaataaatttcattatctattatatactaaaagttcattaaacttcgtacaaacactcttaagctgccatgtggcatcctataatcaatcgctcttgagccaccacatgccactctaataaaacagaaaaaaatttgaccatcaattttcatttaaattggtggacccactaattttgatcggtagatttatctttgcatgaaaacataatctccgtccgtccaacgtaccaatgtacgtatgatccctccgcggcttacgtactgacccccgtttccttttttttcttttttttcatccccataaaaattgaaataaaaaaaattatgggcctaaaaagcccatcaatctactagatatagctagctcttcctctatcctctcctaataaatagtccattaaacatcatatataaatttctaaccatccatatagcactcttaaattagagaaaatctaaaaagaaataaaacatttgaccatcaatttactttattttaggttattagatatatctttttcttaagaaaagcatcccaaacctccctcgtgctcataaatgtttctaaaccactccgtgacacttctaaattagaaaaaaccataaaagtttaagaacaaaccatccaatcattgatttcaccttaaatcgacgaacatatcatataggttgttattagacttatattttaagaaaaactaccaaacctcctatattttaagaaaaactaccaaacctcctttcctccctccacgcccctacaatgttaaagacttaaagtatattaaacatcctataaatatttctaagccactacgggtttttcttaagttaaaaaaatcatacaaaattataagaaaaaacaaaacatccgattgttggtttcgacttaaacatccaacacattattttagatcattaaataaaatatttttttaaaagaaaaaagcattccaccctccctgtccccatgcggtgtgcgtcgttcgaatttctcttatttttctatttatgacaagagaaaagataattgaaattaaaattatctttatgggaaaaaccacaaatggacctccacatatcaggtctagccagttgtcccactgccccttttcttctctttctcctcttgctagcacttataggaacaatataaataaaataataataaccttttaagtcatacaacttatgatatgtttaaactattatatttttttagtgaaatcaatacttcaatatctatattgactatatttaaatgctaacaaaaaaatatatattctggacccacatccattctgaggcctccactaaataaaaaaatattaaaattcgttactaaaaatcaaaatatcccatcttaatttttaataaagccggtagacccattacttatatcccattagacaactaacaactttctatcaacttaattaatttctctcaacatgtatatgggactatttaccaatacaatttcatttggatgcttttatcaataaatgatcgttttaggagaccacattatatatatgatttatgaagtcactaataaattagagaaaaatctttgaatgatatcaatttttatgtcataatgcgtaccccatctagtgttaatttgttatagacaacattttaaagattaaaacgtgctcagttgaacatcataatggaatcttagcagtgaaacaaccataatgtgtccttaccaatatagtgagtcaattccatatggaaattaaagaccatgttcatttatttctttttggtaaaacttgctatgctacatcgtaaattcttaacttttagcgtagaatagtctagcaatgtgtatttattattgttaacagcggaatttgaattatatgacctctattttaatatttcttactcatttgaagagagataatttagaatatatgacttttacccatgttaggttgtaggctcaacccacatatatttttaacccaaattgaagagatcaaatcatttcaaagatgcttcatagagtggaattctccaaaattttaaaaaatggctagaaaaaagaattcaaaatttatgtagttttttaaaaataatcgttgggtttaaaacccattctaaatataaatattcaaatattttagtaggactaatagaatgaccatatctaaaatttcaaatagaatgtaacagaaaaattggactttttggcagggataagatatccccgtggggagtcgaaatactcaaaattttctcatagaaactacatctattgtttcgacataatattttcttataaattgaaaactatacagtttcaagtaattttactttagaatttatgtgctgcaagggtaattagaagaaaaccataaccaatgtttctagcacattaaataagttcaattataatttggatatggtaaaagaatattttaatataaagtcacccatacatgaacattcgtaattatattaaaga

SEQ ID NO: 924 - DNA, 1616 bp, Oryza sativa
tatgcacgcagccgcagcagcatcggtgagacggtgatccacgctccactatatgatctgcacagaaagtccgcacgccgcacgcaccaggtgcacttgcgcgaccggccttgacgggaacagccaacgagtgcactgtgcagcgtagtcatgtctactgaaaccgaggtcacgtgtaaagcggcaagctgtgttgtagcatggtgcaaacaccttttcctccaattcagtcaaaacactacgaggttttgcaagacctaagtatccagaagggaaaacactcattttgagtgggaactacctttccaagaggaagaacaccttcccaaagggaaaataccttcccagaggaagaacactcattcgaatagaaaatacctcttcgggtgaagaacacctttttagggacatcccataatcgctaatacaactacacatattttggacaagttacaatttcacaggtgttttccaaggatgaaagagaaggcaaaggggaattcgaattcccaggaggaagaagacggtccaggacggaaaaggcatttttcccaagagttcgaggaagagcactactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaagagtaatcctcaaaagttgtgtttgctgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggccgtggaagaaagtgacttggcaagagcaacggaaacacttgataagcagtgggcagagatggccaagacatccacagcagcaggaggtaatgaaacaactcaagaagaaggaattgctggcgcggtggtggaagaaacagggaaaacacccatgagtgatgtagagcttgctgaattggtccaagcgcaaggggctgtcatggtgagtaaaggacaatatgaggaattgcaaaaagagttacaaagattgcaaaccctacacaatcagacagtaggagcaggagggtcaagtgaccagtgtgcaataccaggggctagggaaaagcaatcagatcaggcaaaaggagatgcccagggggagaacaaagaaggagaaagtatcaaagccacccaagctcaagatctaccacgaacccaagctcccagtcaagtacaaaacccaccccaagctcaaattaccatccctactcagaacctagctcaaaccttgatcccttagccaaaaccaaattcctattcaaacgcacattt

SEQ ID NO: 925 - DNA, 472 bp, Oryza sativa
ccagaaaagaactgatctaacacaaagcgattttgaggtaaattaactattacgaaatctgctttttttaacaacctctttgatgaattactccgagtacccgaatgtgcgtcaatccatacaatgtcataggcactttcagcaacctttaacagtatttctaaaagatgaggtgtttctaatgattggttttgagttccaccaagtaaatccaaacgatttttataaactgtttcagtataatctcgaactgcgtcaggctttaataaactactttgtgctagtcgttctaaagcttcgataccactgtcaaaccctctagaatctgtcatctcttttttaaataaagattccaaagatgaataggttaactgagtgtgtgtaattaacgattgatgattgtaaattaatgcaaagtgagaagctaatgcagccacatttgatgtagtggcggcttgcccatgtactggcg

SEQ ID NO: 926 - DNA, 694 bp, Oryza sativa
  unsure (1)..(694): unsure at all n locations
aagaaagagacatggggtggaagagagagatcataccatggagaggtagcttgcctgtaagtcttgcccgggtccttcttcacctaacttctgtattaacctataaaaaatccccaattagaaaaatcttgaataaaccagataacttagggaatagcccagatattatagatctgggacaaaggagcttgtgggaaggaattgacctgaggagggcagcgcggcccctggccatcgtcgcgccggagcaactgccatgggtgaggtggcnnnnnnnnnnnnnnnnnnnnnnnnnnnnccggcagtctggtatccccattgctccggcgagtagggcaaaggagaggatgttgcggagggagggctagagctggagcagcaggaagagggggagagccgcaagtacggcggcagcaccgaagtggggaacatgacctccagacgtggcggcagggctcgtaagtggaatattcgggggagtatggagcaggtggcgctggatctagctgacccgcgtttgtcggcgtcagagccggtggatccgttgctccggcgaggagttcaaggggaggaggagcgggaggatttggacgcgccgacgcggagaaagggaaaagggatgtgtgaaaggtgttactctgggaggaggataaggttggagaggcgccctagtaagataaagatggggaaattg

SEQ ID NO: 927 - DNA, 345 bp, Oryza sativa
attcctctattttagagtcatttaaaccagaaccaatagtgtaggtagaaagttccaatgaatttgttacaattctaaaattatacaaaatatgtccaaaatcataaaaaattactttatacgttttaggttcacgatacctacaccaatttctttcaaaaattgaggtatgtaaaaaaactacttttgggtcttctttataatcaactaatccataacagttcttattacaaaattccctaaaatcacctttttttaaatatattaaagaatgatttttgactgaataatggtataatcctgcctctaacccttcaatattaaaaataactagatagcattcag

SEQ ID NO: 928 - DNA, 330 bp, Oryza sativa
agataaacaaaatgcatgacgacatgacccaagcatgaagataaacaaagcacacaaaagcaaatagcagtataacatagctgacctgcaggcggtgcatcaagtacatcaagaataagtgcacaaacacctggaacagagatatatggattcaattatagatcaaccttcatatgctaaaaaagcaagaatacaggaagtaaaatctttgcagttcttaccagatagaatagaaggctgactcgagcaacggggtgacgccacaaaaatctagttgcacgtacagctcctgaatctagtaacttcgcagccttttgtaactggaaaaca

SEQ ID NO: 929 - DNA, 629 bp, Oryza sativa
gaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtact

SEQ ID NO: 930 - DNA, 739 bp, Oryza sativa
gttagcaacgcagggtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcgtgggtacc

SEQ ID NO: 931 - DNA, 841 bp, Oryza sativa
tgtggcgtccgcgggtagaagccgccgctgccggatccgcccgcgatcgccgccaccgctgggagccgccgcctcttttctccctccggcagcggtggtcggcggtggtgatgtcagcggccgtcgatatttttttttttgcaattttttctatccctattgctaaccaaatcggattgtgtacggacgaaaattagatgtgatgacccgaaaaatacgaatatttatattagttatagattagttaaaaaaatatcgagtttgatttttctaaaatggattaggtgacggtatgctaattccgtggacggagctcctctaacgtaccgtcagagggacctgacctgggtcgctgacgggtgatacccatcttcatatgcccacacgatagtaaggatgtccatctgactttacgtcagatgagcctcttccaatttttggcggtttgccaccgcaatacaacatcggtcggatcggagacgttcgcgacaggcgaatgctcgtgattcgattcgtgaacgactcaccgcccaaaactagtgggtcccacctgtcatccgttccgctttctaaaacccttcgaccccaatcccgagttcacgaggcacacgctttggtttcgccgcggcggcggcgcccttccccgaatctcctcgtcgtcgtcggcggcggcgccgccacattcccgcagcgttgcgccaaggaagtgatccctactcaacccgccatcggcgagaccgattaaccctagccctagctaggtaggccgcctgggccgattcccgatggagaagaagaagacgaccagggcggaggatgcgggtgccgatgtggatgcaca

SEQ ID NO: 932 - DNA, 17457 bp, Oryza sativa
cggatgtggatgcacagttgccggcgcgtcgggtggcggcgacggcgtatccaaagcgagcccccggcgccgacgcctacgccgccgccaggtacaggctgttcaggaacaacttcgtggcggccgccgtcgcggtggccctgtgcctcggcgcgctggtccacaccatcctctgccgcgacgacccgacggtcgtccctaggtacgtcttgcctctgctcgtcatgtgctgtgcaaccgcggaagtcgttcgcaactatgtccagatgtacgggtggtctgtccccatgggagttgccaggttcaggatgaagtgatgagttcattggccgcaaatcgtaatcgtagtggagatcctagttgggtgaacagctttttttagaattaggttatcgaggtgatgagggattgagtgctctaattgtgcaaatttaatcgcggtttacgtttatctgggatgtctgatgtaagtatgtgccgtcgctgttgacctactctatatgtaaggtactagtcggcaagcataatcagattcagaaatgctttgtggttaattagtttgttttgtgggatgtcaactatatatgaatcaagcctgttccatttactctttttctttctttcttatcgagttacttattgctgagctgagatatgcagtttatggttgtaattatatattaatactcagctgatataatgttactgtgtacagctattcttgctcccataggggttgcaatcaaattcttctctatcaatgaaataagcacattcttgtgctggttcattcagaaaaagaaatatatatatatactggatatagaggtagacgtgtgttgaactgtgaactctgaaactgagattcacatgttcagagttcaccagctatgttggagtgacagttttcataaattggtatgttggacaattggggacttgctgttaactttcatgtagcactagtacccaaatttggtagaccaataaattactgaaattgtgaagcaagagctgaaattctgtttagttgaatgctctgagtctggctcgtaacttgggaacgtgttcttcaaatgtagatatgacaatcatacagttgtcataggttgataatctttttttgccgggcaaccactgaccaatttcattaagatttggggggcataggttgataatccttacaatttacccagaagtgatttgatctagaaggctagaatctgaatctgcttcagtgaacaacttttaccatcaagttcttgaaacgtgattgtgctttcttatacaaattaactgtgtcttacatttactcactgaagtaagtatgccaacttgctgtttatatgctctatatattaggattatcaacctatgacaactgtatgattgtggttagttgatggagtatgaagcattattgttctgtcattgtttttgtcgagttattattattacttattgcatatctatgtgctttgtggttgtaaacttgtaactataggttaatccagttgatatactggtacagacatagtgcatctgttttcttatcataatagacaggttggtgtgcctggcctgaccatcaaattgtgaactgtgatgcttggattcgcatgttcaccatcgaagtagtcttgacagttttcataaatttatctgttggactattgttgtcttattgtgaattttgatgcaatcactagtacccatttccctgattccgtcaaccaataaattattactgaacttgatgaaactgtagttaaaatacttgagttgaatgctctgagtttctgactgatattttgggcatatgattgcccttgtactaaaaatgtagatcttacaatggaaaacgactgcccctatactaaaaatgtagatcttacaatggaaagggacttcccttattctaaaaatgaaaagaacatggtgtatctcatgcagtttgtcatatgcagatagatcttacaggtcgccaagaagtgacttgatcttagaaggctgaaatctgaatctggtccagtaaacaaccttaattatcaagttttggaggcgatgaatgtgctttctgatacacatttttattatcaagttttggaggcgatgaatgtgctatctgatacaaattaaatgcggttacatttacttaggatgtctgatgtaagtttgtctcattgctgttgatatgctcctctgtaaaggtagccaacaaatatagttatctccagaactgcgcgtgttcagtttgttttctggagtatgaagcaattttgttctattaatctttctgtcgagttatgattacttattgcatagctgagctatgtggtttggtttatgcttatatttgtatgttaactcagttgatataccagcacagtgcacattcatcttttttgtaatagatgagtgtgttgaactgtccaagtgtgaactgtaaaggtaggattcacatcttcaccatcaaagtaggagtgaccgtttacaaaaaaaaaaaatttctgttgaactattgaggttttagtgtgaactttcatgctttcatgtaatcactagttcccaaatttcagtaaccaataaattactgaactttatgaaaccatagctgaatttcagttgagttgaatgctccttagaggcgtgtgagttatgaaaccttctatgagagttccttgtgagttcttagaggcgtcacttgatagtgaccgcctcctttctgtttctttttctttctcctttgaggggttagctgcggctagcacctcgctcgactgtctaaagtcaatctttgtaaactcttgtttcgctctctttcttcttaatacaatttgggcgacctcctttggctgtcccggctaaaaaaaaaagttgagttgaatgctccgagtttctgactgataatttaagcatgtgttccttcaaatgtattcttacaatggagtaggattgcccttatactaaaacgaaaagaaaagtgtggatattatgccttttgtcataggcagataagcattgcagtttgccatgaagcgactctacgaattggaatttagttaggtcaatatgccaatagctacatattggtcctgtgttgtgtgagagtgcttcttttgattactggaacaagctagaacaacttaaaattgttcattgaattagaatagttttcttctgaaatggcaactagtgaggtcaatgatgtttacatttacatgctttataatactatctagcaagtagcaaataacttttgttagctgcacttactgaatgcaatttactactccctccatttcatattataagacttcctagcattgtccatattcatatagatgttaatgaatctaaacacatatatatgtctagattcattaacatatatatgaatgtgggcaatgctagaaaatcttttaatatgaaacagatgaagtagtatccactgaattgacatattgccatctcaatctacttgtgagagttctatgtatggcgagctacccaacaattttgagttgtagggatatcgttttatcctgacgaactcagcaaaatcatcagctcagcaaaaagcttaaatggagggataactgatggaaatggataagcatgtattgaaggatctggttctattctcacatggtaaaggtaagaattaattcctatttttagatgctccaaagtcatcctttttcagacttccgagtaggagctagagcattattttgttgggcacaattccacaaacattatttgctgcatcagtggtcaaaattccggaccgaaatttcatatcggaccccctccccccgatatgatattatttcggctgattttttttttcattttttatgaatttggcaatattttgttcaaatttgacgaaaaattgttcaaaatttcggaccgaaatttcagaaatttcgatatatcagcaccctccgatagaaacgttcaaaccaaaagattaaaccctggttatactgtcatagagagaagtttcactttggagttggaaatactgcctgtaataagcagaaaaatacttgtcataatcatgtttgttttcttgcaagttggctattgtaaaaaggtaagatgaaatattgccacccttttaataagcatcaagctaacttatcctgtcctatctacagtccaaaatattcctccaatgcatacctttcctaaaagagctacttttccaaaccgtgggacaagagctcacagtatatatagggtgtgtaccattagcaagcaagcttccctctactgaaagatgtactggttttgagagcactgaatctacacattatctgaaaaatactttgcaatcttggcaaactagagttatagttgttctcaacttgctttcttattggtaaaaaagttgacttttgccatcttttgtgttctaattcactttttgtatctgtatttaatttcttggacagcaatgatggagttcatagagctggagctcttcttcatccatggcttctgccgttgctcctgacatctggcactggaccagaagcctccccaaccccaagcactggaggggaaaatcctactatcttcaaatctgcaactctccatcaacaaaccagtctctgaacctcatcatcagctggcactctgaaacccaatccttcaatctgtcttactccatctgtgctgaacaccatgatccagtctcactctggagctcccattattccagattgaaatctgttaatggctcagattttgccatccatttcttccacgatatcatctgcggggtcctcaggtatggcccttactccaacaagatgtcacccttcaggctgccaaatgttcaggtatctgaagatacaggcaaaatcttcaacctggcagcactcactcttgcactcatggtctgcatctacgaagctccgtccaccctccgacgagacctcatcggcacggtcagtgcgcagctgatacgcggcgacatgtggggtgctgcgaagaagctgatgcttgccatggggtcagacatggaggagcagtggatgcggtcactgaacctcgccgtcaccaactggatcatagagactcgccggtcaggtggcacgccggtgtcgcctttcacggtcttctcctacgctgtctcggcgatcaggctgtggaaggtggagctgtactgcccagtggtcgccatgatcatggagcacccggctcatcagacgaaagatgagaagctgcagttctcgctgaactaccagcatctggaggccgtgatccagttcatctacagagtcaccttcagggagaactggatcgacgtcaccgtcaacgtcgacaacataaggttcatctctaatccatttcgccattgattcttggacaccaacagtgttcacccaagaactggtggttttgcaggtgcgacctgatccagctggtgtcggagacgctgatggcgaagcagggctacggctccgacgagaagcacttcccgtcgcggatatcactgcagctgacgccgctggtgcagacggacatcctctccctgacagtgagccggtcgacggacaaccccgcccaggaggtcgacacagagatgggcctcgacgcgacgctcagcgcagcaccggcgaccatcggcatcaccatgtcggcgcacgagacggtgacgaggacactccggccatggaagttcgagcactcggtgcacggcaacacggcggcgctgaactggttcctgcacggcggcgcggagggcagggaggtgttctccagcgagccgcacaagcgggagctgctccagccgcggtcatggttcaggaaccggtacaccaacccgggcaggccgttcaccaggggcggcggcgtgatcttcgccggcgatgagtacggcgagagcgtttgctggaggatgcccgccgcggcggcgggcaagacggtggagtgggagatgaaggggaggatatgggtgacgtactggccaaacaagaagaggacgctgcatgttgagaccaggagggtcgagttcagagagctactgcgtctcaccatcagagagtagaccaatttgtcatcatctggtttcatatttgaaaattgttttaattttttttaatgattacttaatcaagactctgagaatgtctgcttctgttatggaattcaaaattatgttgggcattacccgtaacccttgtgcaggcgcaaacatatggagagactgaagattggtcacttgtagttgtagtacctatttttttttttcgttctttttttttttgggtcgaaaaccaggagttgttttacctgttatgaagatttcagagttttagaattcaaaagttcctgacgtgtaagtatttgtcatgccatttgaaaatctctagtttgaagtttaactctttcccttggaaagcttctgtaacttttgaaccagagtttggagctgtatattgggagctcttgaggtatgaaccagacatttacatgatattccaatgttataaaaccttgcagataacaaattgtgctatacaggcctaaatgttcaaggtcaaatttgaaaatgtatgactgcaagcattggaagaggttgaatatgcgatccttttgtctccgatgttgagtcttgtggaaggaccaaggagatattgtgacagcattcatccgtcggccgtctcgtgcgagcgtgtggcgtgcgcgggctagcacaaactcagcgcgggattggcacaagcacggctcgacctggcaaggaggggagagagcggaaacagagggaaaggatggaagaatgatagaaaagatggaaaaagaaagaaataagaatgcgagagggaaaaattattcaaggagataaagaaaaagatggagaaaaataaaatggatggaattggaattggtgtaaaatttaagtggtgtgatattcgggatagaattaaattcggatcaaatgaattatttgaagggtgagctgcacttgtggtaaaattaaacgagaaaataaacgactaactctgccgtcattcgcactcaggaaccaaggataaaaatactggtctgctaaaaatatttagaaaaaaaaaagaattcagaaccccattttacattaaagctactgtgtaaccaaattatatcgcttgatggatagaccaaaggacaaatctacaacaatctccccaccttgcaactagtatcagcagcatgacagaacacaagcaaaacatccagactgctctgcaattaaatgatgagaaaaatcattattgatcgatgcaatatgaataactattgcaattaaactattaaggggagaaaaacctggaaataagagtgggagaaaaagttaccagaagccatggcactacgaggtgtcatctgagcccatcctatcctatcagtcttcatcatgacggaaacgtaatttcttgtgtgccagaaaaaagaatactattttagaaaaaatgtccctttttgtggaagtgaaatatagtattctcaaaacctaaaaatgttcctttttgtggaagtgaaatatagtattctcaaaaccacagcattaggttaaggacttaccctctcagatttatcatagaatctaacaggcagtgtgacatctatttccacaccactcttgagatcacaaactctaagctgataaaaaagaataagcgttagtatttttgtccttattttcaattactaataccaaactttgacttataagtattttagtgtttaaagacagtaatgaatcccaaaagcgttgtcctatactctaatccacacgacattttgggattgtcctatactctaatccacaatactctaatccacaatacctctaatccatccacaatactctaatccacaatacctctaatccataatacagtaatgaatcccaaaagggttgtactatacactaatccacctcctgagcataccttgatatctttaatgcaatttagtttgtcctccaaataaccccagccaagtaatagaagataatcttccagctgcacataaatttttaacatttagcgacggcatttgcatcaagattgactgatgtttctcttcacctcaggtaacgttagagcacccttcccatttatagaagtaattacattaccacgctttatcccaagatcctcggcgacaggattatacacctaaagacaaaaaaaaaaaattacaatagcatccacaatgcatacagatactgaacagccttaattaccctatctacaaggaaaccacccttgatgccaaagtcactgatatcctcctgaagctgcacatccaacagcgctattgttctgacaccaataccaaaaagggggcgagcaacctgactgagaaaagttgacaagttgatagtaaaaaaaattgaactgcaaacattttcatgccaggacaatggtagaaccacccttataataccattttattatcctaaatggcacattgactagatacattaggttatcctaaaattctagcagcattccaagagatggcgtaagaatacgatttagttctagtacataatcgttccacatgttagatttgattacaagaaacatcagccccaagagaacttaaatcttaagtacttaatcttacactgaactcgacgtttaccagaagttagcatttcataccaggtttatacatctaatactgaaacttatccacactagcatgcaagggatggcagcaaagccaccagccagtacacacattcaattctgagattcagtaagcataacaccatttatttcagtatatagagatcaattaagttctaatgtgaggatcatagattggatgactgaaaaaagccaacttgaactgcataaacatgccaatgcatagttagcatttcataccaggtttatacatctaatactgaaacttatccacactagcatgcaagcgatggcagcaatgccaccagccagtacacacattcaattctgggattcactaagcataattccatttatttcagtagatagagatcaattaagttctaatgtgaggatcatagattggatgactgaaaaagccaacttacttgaactgcataaacatgtcaatgcattttacaatagtagaaattgaagtaacagcaggataggggctacaatagattgccatccctctaactacaccatcattgtcaatcaccattccttcattcccaccctgcatcaaagaaatactacagaattaaataagcaattaagcaataataataaaatacaaagaaagaaaattattacctcagggatgtcacagctcagaaacatgtagtggtcacgccctaaaatatctgattcttctaaccattggatatctcctcgcctagccctcaaggatgcctctccatccctagccaacacaaaaacttcttgaccatactctgggccacgtccaaaagatgggagctccatggtaacttctagattgatatgtaatagggcaatgtcataatgatcattgaagtagataagctccgcatccaagacagtcttcttgttcggtaagcaaacagatagctgaaaattaagatggatgttgatcagatatagttaaatagcaaagccgcatgcaacgttcaagattaaataacagttggtcataaaagcaccacaaaaacaaggactccagaatggacaaaccctagctatggtcaagctgagctgatgatgttgtaatgtggcaaaggcaacaagacctgatactgttgaaatatcacaacaaggccatggaacaagtttaagagcactataggatgaaaactgaggtacaaatattcgcttaatgtaaaaggaaaaagagaatctgcaagcagttgcaggcagaatcaaaaggacagcacaacctctgtgaggatatggccctatcgtttcatttatgctcatgcttttaatccaaattttgaatttttagaacttaattttggagatgattttaaagttttttcatcatagtttattttacaacatatactttcaaatcgctaacgacatgtatgtaaaaaaattacctacaaattatttttgggttgctaataagccgtacaaataaggccctctttgtttaggcttataagccaacttataagccaaaaagtctaagcctaaacaaacaagcagctttttcgtttggcttttttgaagccataagccactattaagccaaaagctaggttggagaagcttttttggcttatatgagatatccgtatgactccaccactaaacttaggacattaaattcactagcttataaatcatataagccaataagctgacttaaaagtctaagccaataagcctaagcctaaacaaagagggcctaagcatagccataagcaaaacaatggggctaggaagaaaaattcagaaatgaacaggtagggcaagtgtaccgaaatactactaaaacatgaaggtaaaaagaaacatctagggctactaaaaacaatagtgaaacattaatataattggatgttaagccatcattgaaacacacacttgcacaatgaatatgcaccattcaaggaaaatttttcgcctaaaatgcagcatgctctaggtagctaaaccaagctaccccatacatgtggaggggctactcatcataagaagaacagaatgaaaagctacatagagcctgcaagcactatagtgaaaggaaagttttgtaccttgggtaagggatcacgttttctacccgcttcgcatacgatcctagaataggtcactatggtagcatgatgatgcccagtgtcatcagaccattgtttaataataatgccagtacattgtggtcgcctctgcccatctgcaaacataggtatgatgctgtaatcatctaaagaggaatagattggatgaatcttgctattattttgtcactaaatcataccatccatgatgtgcgaaatgctgacaatggcgcgtgccgcctgcaaaaccaccaccttgtctcttgagctctgtatggcctcggtggtgtatgggtccttgggctcagtcttgatagggatatctttatcacgttctgaaagaaaacaaatttatttagggcttctaaaatggggaaatttaactatttgccactcttgtgacatggcaattaacgatttgccacatcttgtcaatgacatgtgggccctcatgtgtctatgacatgtgggccctcatgtgtctatgacatgtgggcctagtggcaaatcgttaagcaacatccgtaagagtggcaaatagttaaaagcccctctaaaatgtgcattataagattttatttttaaatttctgttgcaacacgcgggtattcagctaatactcataaattggagtaacaaagttggatcaagtgacatatgaatatagacatgtgctcgatcctaccaaaccctaaatcccgaacccaaattggggatttgcaaaatcttagacgattgataaataaatagcgaaactggaaaaagaaaattcagaagcaaactaacaaacctttctcaattttcttgatgatcttactgacctcgtggcactcgtcgttccacttgcgcacatcctcaacattgccatcctctgggaatggcgggtattgaggacgacggggtgcaggagcaaaaggtgagacagttgttccgggcgaagtctgcccctctgccctcagcagcctctgcttcgcttcttccgtaagaagcgcgatagtcgggcgtgtcggtcctcgctgcttcctctttcttcttcttcttcccggtctctgttcttcagatttctcctcagcggcatctccttcgctcctcacggcactcgtttctgatctgctgctgctggggtctggaagagggaggggcacagagcttcttcgacttggagaagacattcgatcagcggggggcagcaccacgaccggccttgccaacttggcgcgcgggagagggcctgaaggaggatgcggcggcgccggcggcagatttgtcggcttgccgaagaggacgagcaggggacggaggacgagggagaagagacggaggcccaacaattcgctttatatagaaggaaaatgtatactttgactccctcaactatccctcgatttataacctccaaccataaaaccgggtatatcggctcctccaactattaaaaccggtgcaaacaagattttggaggtggttttagctgacgtggtattcacacggcggtgttgatcaagtctctattctacgtggcgcttatgtggcattagaattaaaaatatatgtgggacccatatgccattcacacacacaaaaaaaaaaaaagaagagtattgtgggactccttcccttcttcctccccctctctctcccttatctctctcccctcggcctttctcttggtcggagcagcgactgggacggcagtggggagcggtggcggcggtcgggacggcggcggtgagcgggcagatgctctccagcctcgccttgatccgattgatggcgtcgtagcctcgcatgctccggttgggcgtcgcgtccctctcccccttcccgctcctcgacctcagcatgatcgatacgtcacacccctgcaatcaacactcagatgatcgatcgccatggacgagcaggaagtagcttgagcctgggcaattaaaattgttaattacctggacgaagcagtcgtggtaatgcatccggtgcagagaccgcgcgagcgtgggatcctcctcatctcgcccagcacgacgtcctccgcgacagggcacttggcatggtagaaccccacctgcagcccgggccacgccgctgccgtcgccgaacctgcgacgacctcaccgagtcaccgctcacccgtagggccagcaaaaacagcaggagctccagctcccgggacatgaggcagcaagctgtctcaacggcgccgcgctgctccccaccgccacggccgctgccactcccgaccgccttcaccgctccccaccgtcaccgccaccgcttccgaccgtcgctgctccccaccacctcgtccccaccgccaccatcggcgagctcctccccaggcgcgcggacggccggcgagttccacccccgcgcgcggacgccggcgatcttctcccccggcgcgcggacggcaggcgagtccacacccgcgcgtgaacgccggcgagctcctccccagcgcgcggacggcaggcggacggtcgacgagctcctcccccgcacgcggacgcccgcgagctcctccccttgcgcacggatggccggcgagctcgtgggacggccggctggctcctccccgcgcgtggacggccggtgagatcctcccccgtgcgccgtcgacatcgctgccgccccgcctctagtgttggaaggtgagaggagtggaaaagatgagagcgagaggggggagaggtgaggatgacatgtggggcccacatatccgtgggtcccactattttctttttgtgtgaatgatatgtcggtcccacaattttttttactctaatgccacataagcgacacgtcgacaacacgcgggacgaagaccgggtcaacaccgccacgtgggcaccacatcagccaaaaccgcttctaaaaccacccagggatatagtttgcatgagttttgatagttggatgagtcaatatatccggttttgtggttgaaggtcatgaatcatactcagaccatagttgagggagtccaagtatactttttcctacgtaaaaccctagctcttctgcaattcgcttttacataaaacccaatgggctcctcatcgtagcgcggcccattttgcagttataagtggtttttctttctttttttggtttatttttaattttgtttcttttaaaaccactagcaaagtgctcgtgggttgcaacggggaaaattaattatttgaggttgtgttaataacaaaatttggtaagatatgctcaaagttaaagataacaccgaggcagatttggagcggatgtaatctttccagaaacaaagtgtgcatcggctagcaggttgtatcggttgagtttgaatcggatatagttggtctcgaatcatgatttcaacgcttttttcatacgtagttaaagtccattacaggcaattgtatctattaattagaaatatttatgtcttcagatgtttttggcaagagtccaccacgaggacttgttcatatgttttataacttaggaaagtttcagtcgtgtctagtatggacaagtttgtactacgggtataaatatattcctagaatcatgtagaacaaaaacgatcgttcaatacactctcagcgcatcgccacccttttttacttttctacttttgacgagttcttacttcgaattaggacatcggtttcaatctcccgatgggaggtaacacttgtcacaatggtttgcattatcgaggttattatgtcattttagatatgttaatgttcttaatataatcactgattatcagatatcgtagttaatataagttgatatttcgatttacttgtattggctggaacttttctatggttttgtcgtcgatatcggctaaattgttttgtcgactaaggtatctactaccctgaaaatcggtcaaagcttgattgtttagataccatgtttctcttcataatttatgatgcatcaattgagtttgacctattaagtcatgcttagaaccatgagctctagcatgtttcttgattgccaataagggtagaattggagtttcagccgatcttatctgatataatagttttaacatgttttgcttagcttagtcatgttttacatattatatttgccccttatacatatgtatcaccttatttaaatatatttagtttgcattatatatatttacttacattgatatctctatgtataaggttgtatcagagtattagctggtgcattatctttcactagatatctaggcatgccctggcgcgccgcttggagagagcttggttgctgagtatagaattgcaatcctatggcattactggttcaatcagtgcagtaaatattatgaaaaaaaagtgacatagaatagcattaggaaagttgacgaaggtaataaaaggattagaaacataatataacagagtagtttatatggagggtgatgaactgttcatcggtgtaagggtagtgaaaatgaccggtgtaagggtaaccttatgcacgacttaatataatagaatagcatagtgaaagttgacgaaggtaacaaacaaaaggattagaaacataatataacagagtagtttatatggagggtgatgacagttcatcggtgtaaggattagaaacataatatagcattaggaaaggttttttcctaagcattgcattacagtagtaggtagagatgaaaccttgagcgcaatatttacagtgaaacaaactgtgcataacaaggatataaaggttctaagtaatcagcatagcggtgctagtcttagagtaggtctcatgatggtagaaagatggatgtttatgcgcttcataacagtagaagtatgttgctggtgcagggcatgaacattgcattcacaggagatgtactgttgcctgcaactgattcatcttgtggaagtgaaaaatgcagattcttcccacttgtatcttgttggctgctgcaaaatctgaccatatcctgcctttaggttttagtgtccatctgttgacttttgaagaagcatggtggttgatgtgtttcttgtaatttgtacttgaatttgtgttgtcttacgctgtgctagtggctgaatatatttctttgaaaattattttgtgcgaaatctgaccatatcctgcctttaggttgtagcatccatctgttgacttttgaagaagcatggtggttgatgtgtttcttgtaatttgtacttgaatttgtgttgtcttgcgctgtgctagtggctgaatatatttctttggaaattattttgtgaagtactgtcataaaaattgcatgtcacatatttatttttcaagagagtagattgattgcaagtgaaagatcttaccaccctgtcttacttcatgaatgtttttcatagtaacaatgtagaatttgcttgagtagtctaggaattgtgcaatatctctaacgtagttctttacttcacttgatagcttcatccgtttgttatagcagcacatatctttgacaatgcgttttgtgttggctgcgggaaaaaaagtggataagcatttttctcactatagaagaaaaaaaaattgatgaatttcattgaaagaatttcattgaaagtaataagtaaagtatttggacctgtagaagttgatccagtatggtgcttgaacctgagttggatgtgttcgtttttgtgtgatttagttttgtggactctacctgaaaggcaaatcatagtaagaaagttagataaagctgaaaatacagtgagtaaaagtgaagttaataccttcaacgttggtaaaagatggatgacgaggcgcagttgatttggttgaaaagcttggtgcagaagatgattggttattgataagtgccttggccgctttatctggaattggacatctactatatccttctttgttaaatatgatcacattgagtcttgattttgataaggtcctgaaaacaacagatttagattctcccatctttaagccagcttcttgtatgaattccttccatcctattgtcatgtacagcttgtcacgtgcttctgctactttgacgcggatcttcaagccatgtgcagtcattaacttgagagttcgtccatgcttaagcctagatgcttttgtaactgcaactgggataggctgtataattgaaaatttgtattagcacttgtaaagtcagcatactgtacaagacataaaatatttcttgttaagctcaccagatagtcttgacttgctgtcttaattttgaccatggagaatgttggtgaatgcatgattgtaacttcaaattgtatggttttagtgaggtgtgtaatatatagagagtaataagaaagaattcatggcgtgcttggatgatacttttcagtttaattatgaagtgtttatcttttattttaaagaattggatgttggtttagttggcaaaagtagtcgataaaataagctgaaatacttagtattgtattaaatacaatgttgtaagttgagtgctgaattgaaaatattggatgcaacttaggagggatgtatatagtgagatacgaaaatgaaaaatcacaatatagttaaataagtaagaaatgttgcgtgagatgatcgatacaaacatatatccattaattagtttattagccacttttatgattatttacagtacatagttatgttcactctacgttgaatgtatagtgtttgagatgctgtggaaggattatgtcatgataaaaatgacacgtcaaatg

SEQ ID NO: 933 - DNA, 23087 bp, Oryza sativa
aaaagggctaataaactaattaatggatatatgtttgtattattaaaaagtaaccatagtaaacatagataaatgatggcccaaatgaatttccatgtatgtttaggatggattttgtgcgaatctgtgtttaccatgttatgccattgttgttataggtaaaacaatgtagagatagatttaaagaggtcgggggcgaaaataaataacagttggaatatgagttaagaaaagtgctcagttaatttatccttcgatataaacgacataaaaagtgcttttatttttaaagtaagggtagttttttttattttggtttcattttttaatatctaagttaataagatatccgtgtaatgtttagctgtgctatgtataactgcattttttttgcatttttttatcattgtgggtaacagttgtcgttgtatttgcgcaggagataatgatattagattgcatgtaaaaacatggatctatggttagattacctagtaaaagatgacttgcgtgcaataactccaagatcttgcaatagacgaatttttacatcctgcgacataaaaaatatgatttgtcacttatctgtaagttgaaaggtaataatagaaaagggtaaaaagaagaacaacaaattatattagcgttaagataagaggctgtgagatggagtaatgatttatgggcttggtttggcaagggtagatctgtgagtgggaaagcgaagggagggattggagagatgcttaaagaagcgattaatcagtgttcagtgttgattttggtgatggtgttacgggtgttgtgattttaagcagatgagaaggatggcttgccgcggtagctgaagtagcgttggaggtaggggttggaggaagaactcactatttttttttttggagtgcgatggctggcgaaagagacttttcggagaagagatttcggatgcggtggagatgaatgggaagaggtgaggttgcgggcgttgctgttggtggaagagatgagaggagcatatactccctccgtccaaaaaaaactcaattcctgtgtttccgtgtctaacgtttaaccgttcgtcttatttgaaaaatttatgaaaaaaattaaaaagataagtcatgcataaagtattattcatgttttatcatctaacaataataaaaatactaatcataaaaaaatttcatataaaacggacggtcaaacgttggatacgaaaaccgaagaattcgttctttttgggacggagggagtaagatttatgtggatatggagaaggagaaggtaacggataaggataaggaatcgaatatttttttagaaaaataacatctgctgcgtgatttcgatgcagaggaccggtgggtgcattgatggccatattggtcagagtataaactaatttgtgcagttctaaatccgtcctaaaatatagaaaattttaattccttatctattgcatgattagttgtatttttgttttgcatttaggaaattctgttataggatgccgtgattttatggttctaattgcaacttactgtacaaagtttttttgggaaggcattttttaaattagaagtctgcttatgaacattacatctatcagtataatagtttcttattaaataaggaaaataaattttgggaaatgttggaaacatccttaaagtcaaatgttagttttttttattctctctttttatacaattcagttatcaacacgaccacacatcctaataatttgctggtacttagtggtttttattatttcacgagtgccttcttcgatttgaggtggatgagcaattgctacgagtatgtggttgagttgtttattgtacgtgttgaagtcgaacttgacgggtatgcgcattggttttaattaaatatattattttttgagacaatgattttaaaaatggcataaaaatcatccgaacgtgagaaaggggcatgacattattggaggtcatctgatgattgattaacttgacgttaggaagcgcttttatatgtgattattgtctgtggcgaaagtgacagtcaagggaatggcgttagtaagtagcgtgggaagagggaataaagagagaggataggtgggagagttagcaagcaagacaggtgaatatttctgacaactaatatgtttcttaggctgtatttaattgggtattattattttaatggatatggtgtttattaattaatgtataatctttaatattgtattgttttagaaggtgattagcaaacacatttgcaatgtagatgcaaaatagtagtggaacatggggttctgcatatttgtattgtagatgcaaaagtagatgagaaaaaaatatcccgaacaatgcttctctcacatccacatttcacattcacattaggtgcacgaaaagttgaaagccaaaacaaacctctacgtacttggtaaaatttcctactgtttctatagctaaaactgcttactgcagcgataacactaactaacataactaagaaacagagacacaaagataatagaagttgaatgtagaataagcatatcatctttgttccagataaaatggttaaactctacaggcactctcagtagcttataaataaacaagctactgaaaatagagaatgaccttcagaaacagaaacaaaactccctctcccattgtcacatccattggcatgttcaccccttgcattcttgaacctcttgatcgtccctctccatggttctgctgaacaagaagtcaattaattaagctccatgacatgttaaagctagctcaccgaagccatgtttagaagataccaacatgtcacgtgtgaatcagttagagaccatgatttataatagcaaagcattttgcattgataggatcagtgaatgtgcattgcagaatgccagtatgcaagaaaaaatagggacaaaaaaaccgtactgtactgcttaacaccttccccagaacaaaatgattttagaaagatttaataattatcaaagttagtacatgtgcttcaatgtgtgcctttttgttttcctatatcagtcattttagagtgtggggagttcatgcatgtactcattcactattttatcccaggtgagaaaccatatctgaacacacacttgaacaaagttagataactatttatcgggaaattgatgtactcaatcactgttatgaaaagcaagaaatcactttgaaacttaattcaagtaaaaaaagttctatgttgaatactttaacttggctttacacatcctaaaagttcaacaactatttgaacatatatcacaaaaagaactcgttgtaattttattgctgaaatatcaccttgtcaagtaagaaatgccgtaaaagtccatggatgacgtgctgcttaatttctcatgctaacaatgttaatagttgatgaaactacatggcgatatttgcaattaaaaactcatatatacatgctgacaaaacttacatggtcaatgcaagtcctcatgttgtcgttttctaactaatggctaacaaaactacactctgcaaacaaaactaacatattttagatgattgccctcatgctgcagtcatctaactaatggctgacaaaactaatatcttactttgcaaacaaaactaacatattttagatgattagaccctcatgctgtaatcatctaactaattaatggctgacaaaactaatatcttactttgcaaacaaaactaacatatattagatgctcaggtcctcatactgcagttatttaactaatggctgacagaaataatttctcagtttacaaacaaaaccagcatattttagatgcttaggtcctcatgttgcagttatttaacttatggctaacaaaactaatttattattttgcttacaaaactaattgctgataaactaacaaaaccaggtaataattgcttacaaaactatgttagtggatgacaacaatagtatatcacttccaacttccaagttaacagaatggatcatgagttcagaacaagacaaaactaatttggtatttaaataaaaaattcgcttgtttccccatctaatgtacaaataaccattattaactagaaaaatatcaaaatggtgttcccccagctgcaaatgttggagtcacatgaacggtaagcatagcatactatggagaccaacattctgaaatacaaaaaaggggctatttgtgtccttgtcggtgaaagtgcatctaggcccctaatgattttaatgattgattacaatgcgattggagaggactaacattttatttaagcaagtgtgaaggttgttatgtcctcaatgagttgcagagtgatgcataccccattgaaagcgacgtcatgatgagttacggcaatgagcaaatggtatattgtgtattttactttctttgcatcttagaaaagccgtactattaaggggggtgatgcattgacatataaggagtgatgtgtgtgctcaaaatcaattttttggaagcatttctccttgcttgtgtgttctggaaattttcggaagttccgaaaatacacagaaccaatttttcgcttctggaaatttttggaagttttcgaaaaagattttcgaaagttttgaaaatgactgtgaaggcaaaaacggctcagtattttttcggaaatgtccgaaactgttttttggaatttccgaaaatgtctgcgagtcaaatatgcttctggaaaatttcggatgtttccgatagtgtttttcggaagttccaaaaatctccagaaggcatttttggttctagatattttcggatatatccaaaaatatttttcagaagttccaaaaattggcattgactttgtgattttctgttctggaaatttttggaagttccgataatgattttcggaagttccgaaaatcgcaattattgtgctccaacgggcagatctggagcagtagctataaataccccctctctccttttgagtgggttgttggtgacattggatattcttgtgtccttggcttgcttctctctctagtcatttaagccttgctttcttgtttcccctctccactcgggtttgattccaatttggtgtgtgtgagagagtgtggattcgagtttgtgtgggtgcttcttgtggtcttcgtgaagatttgtaagcacttgcatcatctccgggagttctttgcatcatcttttactcttggaggttgaggactcctagaggagttctggctaggtgtcgctcctgagccaccgatctacttgtggttggccgggagaagtttgtgaaggccggatctcgcctccgcaaggaaagagatacccttaatggaaggaggagtgctttgtgcaaccttttgaggaaagggttagcaaagaccctgctctttgtgagctcctcaacggagagtagaatcccctcaaggatttgaactccgggaacaacttcgtgtgctacatctccggtgatatttcttcctccatctcctctagctttgcttgtttgtgtcgctataggtctagttgttgtttgtattttgattatcatgtggtaggcatctagatctagaatttacctttgttttcgactgctctgagatttttcggaagttccaaaaattcctgcttccgcatttacttatgttttaaattagcctattcacccccctctctaggcctaattgaccctttcagtcggaaaacaactttgtttatagagagcgaagctgtgcccacactcagtgaatcagtgaatatataatgcagtttctgcctccggggcgaaaacctatcagcactatccgacaacacatgtttttgagtattgtattaatatatcagttattatataaagtgagcgtagctcaactagtaatgttcctagtggtggaactaacccacccgggttcaagttctagacttgatatgggcgtgcacatttacgtttaatcattctttcaatggtaggcgacaaacccgtcggtagcgaggcaccatggtgacttcgttagtctcaaactatgctgactcggtctttcggatgtgctgaaagagttgagtgcgtgcgtgttgtgagcgcttgcaattgtactatgtttctcaaacttagggtcccctccaaatatatactagatgataccccgcgcgttgctgcgggatactatgtgaaaacaaatagtatgatcgaagggaatatattaaaataaagccaatctaccaaaggaattctacagtaattctacagtttgattggaatataatatgtctgccatataagttcaaatgacatttatgttgttcagagagtatatacaatatagcctgtaggaaagaaaaaaaaattgtatggtttgtttgttagagattaaagaaaagtgcttcttgctaatctggtataggaagtgcataggcaagtgaactgataattaggtttcaaaaaaaaaagaactgataattacttgaaggtgtgtcaatccataccgtgagcgagcttgatgataccagctagtgatgttcccttcgatttgctgtaaacattaagaaaacatatattgactctatttataagatgaaaccaagtttttatatcagttagctcatgcaagacgaaggccttagtctgaagggactgaatttgaatcatgtcttccatccaatggtctggtgctggactgaaacgattcaagttctagctgaataaacaacagtgcacatatatagtagattggggtaatgaaaaacggattcgatcccccaaaaaaaaagttaaccatcaaagatggataaggtagtttttacaaaatctctatatatctgaatatataataaaataatgatggtcagcttgacaaattgcaatttcatacattcatatatcgatggaacacaaagtactgaattaccagattgtttgctccgcaaaaggagatggaaccctaaagtactgaattgcttgatcgattgatccagaacgggacaatatatatgcctttccgcgtgatacttcttccacctgcagtaaatttgggcatcataatcataatttacacacagaaaccaacaaataaaatgtcaagtaaatttccacgggcacattacattccgaaccaaacaaacaacagaaacagcaagagaaaattctgataaaacgaaggagcgtaaagtagatacacaaataagaaacggtatgcgaggaaatgagggtgagaggaataaaaatggcacctgccaggtcgccaatgaaacggaagagtgatgatgatgcaggtatatgcccatggaagatgtaatcacatatgtaggagaggatatgaagcaatccattttaatggcaaacgttatcaactatcgaatgaggaggcgagtagaccgggaagcaacgggataggaagctgcgccatacattggtgggcgccggtagtttcctgagcggcggggccgaaccaatgtagaggaagcggagtggtggggggaagaaagggtgctgcatggggggtgggaggtggggagtggcggcgattcccttgcccggcggcgcgagaggggagatgcgggagaggagaggagtcggagcgatgcggtggggccattcgcgcgagagagaagtcgttgatgcgggagcgctcgcgcgggggagcaatgcggtggggctggagaagcgagattagatccaacggttaggaaaagaatgatgacgtggaggcaccagaaagcagagaattcagtagtggggatgatttgtataggtatatagatacaggattactcaacacacacacacacacacacaaaagaatcacaaacttacccactcatggacaccattaataaataggtagaacaaaatcaacacacctctatcaaattggaaaatgaaaaaataaaatacattcccacgaagcaacaacaaaatcatataaaaaatgttgaaaagtgatcctgcaactccacttgatgtaactctaatatcctatcgatcagtgttatatctgcctgtagccatgttggattggtgagtgaagaacaactttactgtaagcagatgcaagagaaatatgtaatattgagcactgcagttgtctttttagaaataatacttttttaatagggaatcacaaaaatagaggttgtcagactaaaattgcaagtataacaccctatcgaacaaccaatgttcgacaagggtacatattgaacaactataatttgacaagggataaaaacataaaatagaaaaatcactttgcgctactatgcgccactgtagcatgcaggacctatcgaacatccccatttcaatagtccacctctcttccatgtactttttattttttttaagtggactaacaaccttgtcgaacaaccgcagttcaacaggagttcgacaggtacctatggaatggttttagccaatcaacttctatttttgcaattttttattaaaataatattatctctaaaaaagtttccattttttttgtctctatagacgatctggactgcttgacaaagcaaagaacttcattgaggaaaacaacatcaatcatgtggcttttgtttggatggggctactgtcagcttgccgatttcactagcacaaggactatgcaaatttggcttgtaaagatttgcttcacttggagcaatatgatgctggatccaagctatacaaaactgcattttatacattcaacggtgacagatccaaccatttacacattcaaccagtgacagatataaaagaactaatacctgatagtcatagaccgacaccaccggcctcaaatgcgaccataacgatagtgtgcatgacgagagaggaggacaaaaaaaaaaggatggctcatggaggataactagagggtgcgattgcgcatgcaaaggtggagaggaggaacgatggtggctcatggagaaagagcggtggaggtggtggtagggatgaaaacggatcgagtacggtcgaaaactagctctaacatattcgttttcatatttttttctcagaattgaaatcggaatcggaaacccggatacgaaaatggaatcgaatattatcgaatacagacacggagcgaatatgaatcgaaacgaatacggtaatgaataattatcaaaatatcaagacccctcaaaataagcttcttaaaacgaggaagagatatagccattagttttcaaacacaaaacatcagtattttcaaattttatctctatttataagggcaagggggagatagaaaatgttatgtttactttccatacaaatttatgttatcataaaacaaataaattaatgtgtatcactcaaattttcgtaggcacattgaaatttttaaaaattggttgaatattttaaattttgggttgaacatttcaattgaaagtttttaaaaatttgagtggttatttttcagaattgaattttttcatttgtttgtatgtggaccagttaagaaagtttttaaaaatttgagtggttattttttagaattgaattttttcatttgtttctatgtggaccagttaaggacccgcatggaaaaattgattccatacgggtgacttaagaatccatatgcaaaaataaattttgaaattttgaaactaatttatctcactcatatgaactccaaattggatgattcttttccctaaatgtttctaaaatcatgctctatcatgttattgtgttcttatcttctattattttggccatttttctcttgtgactttgttttatcaattaaaaatttgaatttctaaacttcaaataatattttgaagctataattaatttcagctgaaaaagtcatgaacataaaagttgtagagctcatcaagacatacaacttttattttggtcatttcttcatccgataaagtgatagtaacattgttcacaaagtttacttctctcttatagtttatagaaccaaataagatagatgtaaattttatataagatagatgtaaattttatgaacaatgttactatcactttgtcggatgaagaaacaaccaaaataaaagttatagatcttgatgagttataaaactttgttgttgataactttttcagttgaaatcattaatattttaaaatattgtttgaagttgttatattttgaaattcaaattcaaacggttcaaacaaagtcatatagaaaaatgaccaaaataaaagttgtagatgttgatgcgttatacaactttgttattgacaatttttttcatttgaaatcatttactacccgaaaaattatttgaatttcttatattttaaattcaaattttatatagtttaatcaaactcggatggagaaatgaccaaaataaaaatgatagatctcaataagttatacaaatttgtatttgacaacttttttcatatgggttgattttgtgcctttaaattcattttaaagagccacatgttaaaaaaaaaaatcgatttttacactgaaaaaaatccaccatttttttcacctcaaccttatcttctctttgactcttcctctcttctctctcacacactttctactctctctctctctctcacttcctctcatccacagggcgcagggcggggcgagtggtggccggccaagggcggtgcaccgcgtggcgggtgaagcatctaggcccccggtgttaattttggtaattaatgacaagcgctaattgtggactaaccgctaattgtgctaattttgttaattttgctaatccaggccgatggggccctctgacagcacttcaatggctagttttctagccgttgcagagtagcacggtctgaccggccacatatctccggtcagaccggcagagcacaaagttgggggatttcgcccccaaaggctagttttgctgggtgggagtataaatactcccccaccagcagcaaggggaccctcttggcatctaattcaattgcatacaccctttgcacctcactcacactcacttgagctttgtgttcatccatctagtgtgttagagggttgattagccaagagtcaagtgcatttgcttccattgtagagctagtgtggcacttgatcatctccacgccgggttattgcttgttactcttggaggttgccgcctcctagacggtttgtggagaagttgcccggtgacctctccgagaagtttgtggagaaggcccggtgctggtttgtaagtggtttggagttcaccaccttcggagtgaaggaagaactaccctagtgatcgaggcttgggtagtcctctccgtgggccagctcccgccttgtccaccccttgacgaagggggtgtgcggtggcttcgtggttgagcggtggagttgggctcgcctcaatggggagtaggaaaccggcgagtttccgaaccttggtgaaaaatctcttgtctccctgtctcatttgattgtcacatttacatttgtgcaatttacatttctagagacaaacttgagatcatatcaccctaggattgctaaacattgacataggagtttgatttactttcctagagatataattgagccactatcaccctaggtttgcaaaacataacttagttgcttagttagagttgaccctcaccaagcctagcaacttaggttagttttgattaggtgtcatttagttttaaatcgtctattcacccccctctagtcgacatctcgatcctatagcaggcggcggcggcggcggcgggcggcggcagcgggcttgactgccgcgacctaggaagcggctgcagcgacggcttcggtgggcggcgacggcttcggatgggcggcagcggcaggcggcgagggcggcggatccggcggcatcgccctcgggaggggccggatccgctgccctaggaggtgttcggcgctcggccccgcgacggccggcggcgggcgggcgcagcagcgcggatctagctagggtttcgggattttttttgtttttttttgctgaaaaatatctccggatatccgatgaaaaattccagatagtttccgaccgatttacgattccgtcggataccacccttactgttcgtttttgtatccgagaaaaaacccgaattcgtttccaaatccgagaaattccggatagttccgaccgaatttttctgaatctgaaaattggtccggacggacggaatctatccgaaccagtttcatccctaggtggtggtgccggtgcgtggagtaatagttaggctgtgtagcacgcaaaacggagcacacataattgtatgattaattaagtattagctatattttttcaaaaatagattaatttgattttttaaacaacttttgtatataaacttttttttttgcaaaaaacgcacaatttaacagtttgaaaagcgtgagtgcggaaaacgaggggaggggttgggaacttgaaggaaagaacacagccttaagggtttattgttgacatgatcgctaaccaagtttgttaattttttatacgtgggcaactagtcattagtcattataaagattataaagaaatagctagatttaaagtagtaaaaatattgagataaaggtgagagtacttgtattaactttttttgtcactttagtgataaattcttaattattaatagtaagtgtgacaaatagtaaaggtggtgtttggatcagggacttaattttagtctctgtatatagacactaatttagagtattaattatagactacttacaaaactaattacataatgaaagctaatttgcgagacaaattttttaagcctaattaatctataattagaaaacgtttactgtagcatcacaaaggctaatcatggattaattaggctcaatagattcatttcgcgaattagtccaagattatatattttattaatagtatacgtttaatatttataattcgtgtcccgatgtgacacggcttagtcccattattctcgagtagaatatgtcccttccttagcggcgtaaagaaagaaattcgtctcctccgctcctagcgccgccgagtcgcggctgaacagaacaagggagggaggggcggcgatctccatctggcgagcagagcaggggaggggatcctcgtgagcatccacatcctctttctgattcatctctctcccatcgggacacttgatatttcttgcgttcttcgttaaccctagcttctcttctagatctggaagaggctcttctttttaatttcagagccttaaccttaatacaagtaacagtttgtttgttccccgatccgcccctgctgctggtacttgggctatttgattcctgcatagtttcagagctagagctagtgttgctctttacagctttgggcggattcgcgatggcggatgaagagtcgtctgacttcaccttttgcaaggttttatttataacttgcctccctattgcttctatgttcagctacttgttatttctacaatcaatcagtcatatttttttttgacttatgtattactttcaattgtgtaataaatctgccgatcttctttgactgatttaatcacctgcttttaagcgcaatcttggttctggagatattttcttgtacaaagttctaccaccacaaattcttggaagaagcaatatgttagggatatattccactaacattatcttcatttttggcgctaatataaacaaataggtagtatctgactaacatgggatggtacaaacaagtgaaaaaaatagatatgaggaaaaggaaaaagggtaagatgtaacataagaaatcagggagactgaatggaagaggaaagaaagattcatctccgctgtatagaaatctcatatagtttgtccttgttgctgctgtaccaagaaatccaccttttgttgttgatatacatgagctttagaatttcctatttcataaaaaaaaagctatgctgatgtagtgagcttaagctaactaggtaagcacagggtacccacttgtgtatatagctccattttcatgaattatttgctactcccattttatctgcttttcttcatggtacttacattttaaatctggaatcatgagtacaagggacatatatctagattgtttgccatcttgaatctaccggatttattaaattttcatggatacttactgtccaaatggtctaaatttaaacttcctatgttgattatataatgaccatattcttttacaaacaattgaaacaaatcttcagtgacttgatatggtaacttgctgatgttattctacttatgtttttgttgtgtagatgtaacaaattctatattcaattttgttttctagatcgattttgagggagatggtggtctggagttccctaaagctatccctgtggcaagtacacctggtgatgctggtgcagataacttaaagactaagaagatcgaaggcaacatgcaggcaaacaattcaattaaagatcaaacatctaattctatatctagtagcatcaatcgtgtatcactcgaagactctaatggaaaagagtcagttcttagcagagagaatacacagtcaaatttatcatctcaaccaaaatcttcaaagaaacctgcagcgcgtgcaaaagttcctttcgagaagggctatagccaaatggattggcttaagctgacccgtacacatcctgatcttgcaggtaaattgtagctgctactgtttcttcatctctgtatgtatgattattactggatggctagtgtacatttgaaaactttcttagttaatgtattgttactgtctgaggcactataatcatgacaactcaggatatcttaatatggtcatagttaccataggaaaaacacaagcttaagagtacacacaatttttggtttcattgttggataggtgaggtcaaatgaatgagtttgcagactagtatgcaccatgttaaatgtcttcaaaaggtcctgaactacattttctactatatcagctttcgtttttcatgtggcattatcaaaactgatgaggtcagaaaagaagagggggggggggtatattttttgggtaatttgtttctagctaatacctcatggacctaagaattggtttgaacttctagctattcataagacaaaatgtcatttaattaattaattgtggtatgaacaaaaatattatgtatttcatcctcagataatccatagtgattttttttctataccattaggattcgtacattatttaagatacaggattcctgcttgtgagatcctttagtcattagtcactggattgcattttagatttggtatgcaaaggtgagaaaaggaaatacaggtgggggatgcacaatttcagcatttaggggaagagcgcgtgaacagtggcaaaatctgaagaagtttgtgattccagcggcattgaacaaagaatgcaaaaagcagtgccaagtaccaatggtgtagactgatgttttcctaatttaaagcataaatgattatctacagatgttgaaatctgaaaatgtaaatgcaattttattatttgtgactggagcatcgcccgtgagctatccaccttttttgaatataactgcaaagggggaaaatatgttggtgtgtcttgcgcctgtctatcagctgtaattcatgaacctgtttatgcttgactgaagcatatgcgtccactgttgttaatatttttattttactccttttttaactgtgtgttacttgtaatgaattgatgtttgctggtgaaataataccgatttcctttcatttggtgtggcatttttatagggctcaaggggcagttaaaccgaaggttgatttctctagaagaagttaaacagcataaaacaggagatagtatttggactgttttgaaaggtcgtgtgtacaacattgctccgtacatgaaatttcatccgggaggtaaccataagttttaacctgatgtggaatacttgtttcagttcttttcgtagctgctgttcaccttcacaatttctgcagacttcagagtgctatatgcttctattttatgtgtaacaagtacttttatgggcatttgcaggagttgatatgcttatgaaggctgctggaaaagactcgaccgctctgttcagtatccttctattattattgttcaaacatacttttaaagttgcctgctgcctgtcgtagaatttcaactgagttttagttagaatcaaaatatgctttgacatgcatgtttgcatgctaactatactcatgcatgctttgttcattatattaggtcgactgttctgtgcttattgtgaccgttgaacttatgtgcaccttgaggctagctagctgtcatatctgcagggaggttttgtccatgaatatataattcttgatatggttccttcactcccctatagacaaatatcatgcatgggtaaattttgaattcctcctggagaagtgccttgttggattcctcgatcccaatgagtagatgcgccattgagcctgaggccagaactccacttcctctttcttgtccgcgacactagtccctgatgcgtatccatcacatggagacagtttaaggaatgtaaacaagtgttttgcttcattgctaaggagatatagatgctgcttaacattttagaaaaaaaagaaaagttagaaacttgatcaccattgttatgtacaaattccttcaccattgattgctgaagaaaacaaagaacatttccatccatatgaatgtaatgtcaagaagatacatgtgttttagatgaagggatactgtggtgctgttttggctctttgcagccaacacatagtgctctgtttctttcacattacaagacgttttgggctcatgcatatattgatatatgtgcttcatatatttatcccatatgagtgtatgaccagatccgagaaacccaagcgcaccatcgtcgtccatccgccaggcgatattcctaacgacgccatccagattccgcacggagatgcgacctctccaccggccggaaagcacgctgttgccgtcgtcgccggtctagggaccgctgttaggatcgacctgatctgatgcgatcgatcccaaaatattcagcgaaattcagaacttggctggaagctacctattaggaatcctaacacggcaaggaattgaaataactgctgaaattaacttgattaacgaaatatatgagtaggccgcaagaacagaaaaatggaataaaaactatgattttgatcttcgatatagttctaaaataacacattggcttatattgagtatatcacgagtaaaagacaaaaagtgacgcctatagtaccgtaaggatacacactgcagtctatctcggtgctcttgagcaacacaatcttcatagaatctcccctccatctgttatatttaaatctcagccatccaaccaatattagcatcctcctctgcttcctcagtattttggaactctaaaactctaaagaatcaagtgctctctatcttcatgtgcctctcaaccacaccccagtcgtgtcggtcttagcctctatgcttcacgactacacctcccatgtatccgtcgttcctcgatgttggtgcctttatcaaccgaccccgccttcccaaaaccaccacttttgctgctcgtcactatcaacctttaaattctaccccttcccttgtcataatgaagttgtaggaggatagcagcagaaggtagcggtgaggtaacaggaggtggcaacggagctgcaaataacaagacaacggtgggagctataggatctggcgcccccttggccagatctgacatcctcccgacaagatctggggcctctccaccaagggagactagttgaggtggctctcaacgataatggtgggcacagtgtggtggcctacagcaacgcaggtgcagtggtgagacaacgttggtgccctcgctatgggtggggactaaccggcgatcggacatgacgtggtccgagagaaggctatccatccgatgaggatgactaacggactggaggtagagcccttgtgggaaggcggcaagaggcgtggggatggctgcgtgctagcagtatgttgctggtgttttgaaggcgatggagctgcaacatcaaggttgagggaaggttggtgccaggcgaaagtcttgtctgatggtagtcaggacacaataattgtgacgctgcaggcaacacgaatcccctcggggtgttgtcgtggttgtaggatcgaaggcatcttagaggggagggggttgaataggattcctaggagacttggctgaatttaaacttaaatttcagaagataaaaactaaccaatatgcctaggtttaagactactgtggcccattgtttaaaattaaagctagaactcctaacagttctagagcaaaataaatattgaaaggaacaagaaactcaacataaagagaagaaagttcaaacaaaagacttggcatgttttaaccgaggtatcagatattcaacaatctctactaatcgtcattggaaatctacacaagagtatagctccctcccaaggccatgaagtccatgggcgctctcatcattgtggttcttctccactcctgaaggtgaaccccgaaaccttcaccatcacgccgagtctcccacaatcatcttgagacatcactggctaggcacgctaagatgccaagagtaacaggaagaagtcttcacttgaagcccttaagaacaaggcctaaacgagtaaagaaaattatcacagatagctgaatggcgctcttggactctcccttaggttgcttagctcaatagagttccaaaaggcactaggtagtctaaggcaagaggtatttatagccttaatcgagctcattagctgtttgctaccattggcaaaaaccagctgaagttacataggatcggacaatctggtactagacggccctttatactttccaatagtaacaaggcatatagccgttgggctataaactgtcgggcaatccagaaacacgccacgttcaaaatcaatatctggtagtagccggacaaacatgtgtccaaattgttcgacaatgtgtcagaatgtcaaacaattgctagatcagcttgattatctatcggataatctggctagttcatttacactgtccgaccaacatatgaccacagttggacaacgaactagccagaaaatccgacactgcaccggattgtccggtcaagttactctagcgacttgaacaagtactatctcggattgttcgacacaacttggactattaaacttgtacatgttcagggttgtaggaagacctgcacactgacaattgtctgaggtttttacccacttgatttgagaggccacaacttagtatgcaccacaccttaaactctagcatttcccaaaaacttcaagctactagttttcaacccctctttatagcagtctttaacttaattctactacatttgtcccaactcctcaaatacattaccgatgtttcagttgcagtagtatgatctcgttgatcttatcttgactgtcttttttgggtataggcaaaacgtccacacttccatcgccggagccctaatctttttttaatacttaacaactgagattagttttcatgattatattgtcattaaccaccaaaacatcacatggggtctagattcttttagaggtgcccctccttccttcaccaatggatttctctatgttaaaatcttatccaagagtccttgagcagcggtggtactctagcgtctcaacctcctatgacaccctgtgtcaattaggatgtgacttgtgtggtccataaaagctatgtgcgcatgtttagtacagcgttgctagtttagcaagggtgaaaccaatatataagggcttgttcctccaaccatagcactttcgggttaaccgttttacatgaagcgaagacgaaagtgtaagtgggtggtatatgtaagtgagcccgctctttagatgagctgggctacacggttctggttgacgggttgttacatctccttggaggcatcgtctttggagatcccctttgcctttccgctttgaactgttggtcctggactgctctggcgctctttgtttgtcatgatggggtgggtatgtgtgcgggaagagtggatcttattctctgcggctctcttcctcctcaacccaagatgtttggtgatcaactgcctagcaaggttgatgttgtttaggcgattgcaattgctcatgtcttcatgttggtgatgggtctgtatgagggacgagcggatctttcttctctctcatgttctccctatgcaatccaattttgggatgttaattgggagcccatgcaccattttagtgttttgactttgtcggtattcagtggagtggctatgttgtaggctagtggtgaccgggtcttacatagcggcagtcagcttgatgctaggtttcttgcgtagcgttgtcagcgcatggttaagctagctgagttttttttttttcctgtcttcttctcttttttttttggaacttctgtcttcttcttttagttttctttgtgattataacctctctcagggctctagtcttatactactttttttctctactatattaataaaacattgcaccatctagtgttgttcattttttaaacaagacaattagtataagacatcgttttccaagattcaatatgatatgtttatgttgtagatttagagtttcctatattgcaacgcatcaatatttttctagtatatattataaatatcaaaattttaatcatatgttgatgttattttttttatcatggacataggttaaaataaatatcaagctgaaatattcccataattcataaatacaaagaaatttgattgcgaggtgattgatgggacatgtaacattgtacaaatgcttataatatatggacatagtgcttataaatttcaaatatttgaactaagttaacaaaatactaaattaaaagtacaatatctttctaatcaatatactcggtggtcagatccttctatttatcgtcaaatttttcttaaagtgaatttggtcaaatagcacagttaaatagatcatatatacaacagcaaataccagttgtttctggtcaattcgcaagataaagttataattcataccgataacaatgtaattctctgcaatctgggtcgtagcaatagcggaagaagagcaacagatttggacacttgcaaaccgacacggtgactggtaacgaaccgcctgcgaaaatcgtctcgacaaacaaaaaaaagattgccgccacccccacccgtgcccctacccacctccggccgatctagggttagggagagggagaggaagggccgatctactgcaggggcgccgctgcccccgccggggtgggggcggatctgggagggaggggaaccgctgccgccctcccccagactccctctagctggatctgggagggaggcgaaccaccgctgccgccacaggtcctcccccctctcccctcggccggatctgggagggagccaagcggccccgagtatcaccgtcgccgtcgccgtttgctgccccgacctgcgtctcgctggtgccgccgccgaccccgcgcctctccgtcgcgtgtggatcccgctgcccctgctcgtcgccagtcgctggttcccccgccgcctgtcgctgtgagggatctgagggagagagaggtgagggagaggagaagtgagggagagaatgctgaggacttagaaaaaaaatcttctccagccttgtctatttatattccacactcatttttgtaggtggaccacataagaggtttgccttcaaaaataaagagtatttttgcaggcggacagcgagatttaacccggtttacatttttgtaggcgatcatttgggcccgaaggttatatccgcctgcgaaaaataaatacgtacccaacgtcggcgcgaaaatgctttttctagtagtggtgatacatctccctagcaggttaggaaggactttaatccattcctaattcctgatcgttgattgctagtaaagttgtatatatatgcatttaatagttaatattacatgtgcatgtaaaatctcatcttcaaactcatcacacgtatgaaaagaaaattatattgttacggttaaaatataatttacccaatttaggctaaaactttacagaggtataataatattagaagtacatgtacattttttaaagtatgcataaataattatattatattttgaaaccgatggagtattttgtatcaaacctttttatccatttaaaatggacacttatcctttcagcaatgttgagatagacaatagtggatttcatgtttgtgatcttatatacagctttcggccttcaccgagaggtgaaaatttctcgtaaacttccacatacaagttttacagtataaattaatttggttcctaatgaagtcttataactttatgcattccaatggtagctaggactttccgggttcgaacagagatgaaaatttcaaataaacttcaaaaagaaaatcatataaattggttgttagattaatgtgctatacccaattaaatcctaataaattccattggcccacattaagtgctatgggtaataacaccaccttgcaaatctgagtgcagaggtctcaacttaaatacggagctagtggagagtctctgttgaccggttgagatggtgcgcggacaaccaggcggggcgaggcgaggcgaggcagacagcagctgctgctgcgctctctcgttttgtaacggacggtaataaacacggagaattgatttcgtatcaatgattccgtcagttacggaattaaacgtcgtgaattgattccgtcggttatggaattaaacgccgtgaattgattccgtattaacgagcgcgtcggttacgaaattaaacaccgcagttgatgactccgaacgttactctcgcgcctgcatatatatactccgcagcaaccagaaggacggacgaagttcttcacgactattgcacttcgagttcctcctcctctgttcctgagctgcagaatccttccccggttctgttcacct

SEQ ID NO: 934 - DNA, 981 bp, Oryza sativa
tgcaagtagttcatcacaaaaacttgatgggtcttttttggtagttggctttgctgcatcactaaaaccacgtgctttcgatggttcaaattataaaagatggaaagcgcgtgcacttttgtggttgacggtgatgcattgtttctttgtctcatggggcaaaccgagtgaaccgcctctctctcctgaggaggaggctaagttcgaggctacggattgcttgttccgtggagcattgatcagtgtgctcgccgataatattgtggatgtgtatatgcacatacctttagggaaggacatgtgggatgctcttgaggtcaagttcggggtttccgacgccggcagcgagctgtatgtcatggagcagttctatgactacaagatggtcgattaccgttctgtagtggaacaggcttatgagattcagatgctggtaaaggaacttgagaacaacaactgcgagttgccggacaagtttgtggctggaggcattattgccaaattgccaccttcttggtcggactttgctacttctctaaaacacaagaggcaaaagttcagtgttactgatctcattggctctttgggtattgaggagaaggtgagggcaaaggacaaccagggcaaaaagatcgagggaggttctagcgctaatttggtgcagaagaagaacactcacgcatcccacaacaacaacaagaaagtcaaacctgacatcaaatccaaggctacaaccaattttaagaagaaaggcaaaggaaaggcaaaaggagattgctttgtgtgtggcaagcctgggcattgggccaaggattgtcctgagcgcaaggacaagaagtctgcaaacatggttattagtgagggcggaggaacattgtggtatgataaatttttagcaacagttctctctgtctgtcactcacctgattggtgggttgatactggtgctaatattcatgtgtgtgcggacatttccctgtt

SEQ ID NO: 935 - DNA, 14296 bp, Oryza sativa
acagcggaggtttgtttcgcttttccttggatgatatgtttaataaagttgtgaaccatgtaagcgatgatgatgatgagtccaatgtgtggcatttgtgactttgtcatgtgaattttggttgtatgacacgcttagccaatatgagtttaattccaaaattcactttagtcaaaggctctaagtgccatacttgtgttcaatcgaaacaacctcgcaagcctcacaaggcatctgaggcgaggaatttggcaccactaaaacttgttcattccgatctgtgcgaaatgaacgacgtgttgactaaagggggaaagaaatatttcatgacactgatagatgattgcactagattttgctatgtgtacttattgaaaacaaaggatgaagcactgcattactttaagatctataaggctgaggtagaaaaccaactggaaaggaaaatcaaacggttgaggtctggtaggggtggagagtatttttccaatgaatttacttctttctgtgaagagtttggaattattcatgaaaggacacctccctattcaccccagttaaacggggtagccgaaagaaagaactgcactctaactgagatggtgaatgccatgttagacactacaggactttccaaggaatggtggggtgaggcaatattgactgcgtgtcatgtcctgaatagaattcctactaagcataaggaagtaacaccattcgaggaatgggaaagaaagaaattaaatctctctcacctgcgcacatggggctgtttggccaaggtaaatatacctatagccaaaaagcataaatttggaccaaagaccgtagattgtgtgttccttggttatgctatccacagtgtgggacataggttcttaatagtaaattctggagtacccgacatgcgtgttggtacaattactgagttcagagatgccacattttttgagaatgaatttcctgtgaaaaatgcacatagcacttctagtcaagaacctattttatcccctgagcactttatgccgatagaacacattgatcaaacgcttgaggaaaatcctgaggaggataacattgtggcaactcgaaagagtaagagacaaaggactgcaaagtcttttggagatgactatattgtatatcttgtggatgatactccaagaaccattgaagaggcatattcatctcctgatgtgactattggaaaggaaagaagcggtacgcggtgagatggactcaattatgtctaatggtacttgggaagttgtcgagcgtccatatgggtacaagcctgtaggatgcaaatgggttttcaagaaaaagcttaggcctgatggtacaattgaaaagtacaaggtaaggcttgtggccaagggttatacccaaaagaaggcgaggattttttttcgacacttattcacctgttgctcgcttgaccacgattcgagtcctactcgctctgtcagcctctcatggtctactcgtccatcagatggatgttaagacagctttcctcaatggagagttggaggaggagatctatatggatcaaccagatgggtatgtactagaaggtcaggagggaatggtgtgcaagctgttgaagtccttatatggtctcaaacaagcgcctaagcaatggcatgagaagtttgacaatacacttacatctgttggctttgttgtgaaagaagctgacaaatgtgtgtactatcgctatggtgggggagagggagtgatcttgtgtttatatgtcgatgacatattgatctttgggaacagcctcaatgtgattgaggaggtcaaggactttctgtccaaaagctttaaaatgaaggatttgggagtggctgatgttattcttaacattaaactactgagaggagatgagggtgagattacacttgtgcaatctcactatgtggacaaagtcttgagtcgctttggttatagtgactgcaaggcagctcctactccttatgatcctagtgtgctattaaggaaaaaccgaagaatagcaagggatcaattgagatactcccagatcattggttcattgatgtacttagctagtgcaacgaggcctgacatctcatttgctgtgagcaagttgagccagtttgtttcaaatccgggagatgatcattggcatgctcttgaaagagtaatacactatctaaaagggacaatgagctatggaattcactatgccgggtacccaaaagtgctggagggctatagtgattcaaactggatatctgatgctgataagataaaggccacaagagggtatgtgttcacacttggaggtggcgctgtttcctggaagtcttgcaagcagaccatcttaacgaggtcaacaatggaagcagagctcacagctttagatactgccacagttgaggccgaacggcttcgtgagctcctgatggacttgctggtggttgaaaaaccagtaccggcaatcctgatgaactgtgataatcaaacagtgattattaaagtgaacagttcgaaggacaacatgaagtcatccaggcatgttaaaagaagactgaagtctgtcagtaagcagaaaaactccggagtgatagcattggactatgtccagacggctaaaaatctggcagatcagtttaccaaggggctaccacgtaatgtgatagactgtgcatcgagggagatgggcttgagacccacttagagttgcacaatggtggaaacctgtccattgtgatcgcagatcccgtgaatttggatggtgaaacaaactattgtgtaactgagagaagagaccctaaaatgggcttatcttcatgatgcacttctcttctaatctgtatggtagtatggtatacaccttaatgtgatccgagtggcttttcataaagcagagatgttggcctacataacatcttagaaggaacacacctatatgagtccgactgctagtcacagtctatgagatctgggtgatatctagatactcatgaaaaggccaggagtatgacttatacgctccaaatagaggggatgcaaacggcagcctagtaccagttaagggtttgagtgaaacctgaatcgcataagactgacaattcaagtcatagtccattgtttagttgtgatctggtgtagctcttttcctaggtggaagttcaacttaacagtctccaccgaaacactggtataacaaacaggatcagaaccgagagcatttcctgtgagccatgaaatttggtggggattgttagattaatgggctaggcccaattaaatcctaataaattccattggcccacattaagtgctatgggtaataacaccaccttggaaatctaagtgaagaggtctcaacttaaatacagagctagtggagagtctctgtagaccggttgagatggtgcgcggacaaccaggcggggcgaggcgaggcgaggcagacaacagcagctgctgcgctctctcgttttgtaacggacggtaataaacatggagaattgatttcgtatcaatgaacgcgtcggttacggaattaaacgtcgtgaattgattctgtcggttatggaattaaacgccgtgaattgattccgtattaacgagcgcgtcggttatgaaattaaacaccgcagttgatgactctgaacgttactctcgcgctcgcatatatatactccgcagcgaccagaaggacggacgaagttcttcacgactattgcacttcgagttcctcctcctctgttcctgagctgcagaatcattccccggttctgttcacctgcgcgcataggtgtacgggacaagcaggtgcctccggaactccgtccgcttgagaacttgcacgggtaggcgggcgatcaagtttttggtagcgcttcaagcgcgactgctcttgttcttcgcggctactgctgctgcatcggcgccttcaccaagatgtcaacggagattggagacaagaagatgaacgacatcaacggaggcaatactgcctcaaaatccagcgatgggacgttctcggggtatactttcattctcccgattctattagatgtttctttgttaatactcttcgcaatggtagcattgcgttactatgtaaatgttaatgcttatttcatattaagcatactcaagttgtatacatttatcactgtcactatatctactcatattgcaaatgtcatgtttattgtcttaatattttggagtaaaatatgccgaattatgaccaaatttcccaacattggtctcattccaactacagtctaaaaattaattgattcgaatggtagagctttcggccttcatcgacctgtgaaaaaaaattcagatgaagttagaaaaaaaggtcatatgaaagttccttatattccaatcatctcatgataaggttagtcagtcttggtagtccatctttaaaaaggatcctctgacttaacatatactccctccgtccatataaaaaagagaaaccctgaatttccgtgttcaacatttgaccgtccgtcttatttgaaaaaaatataaaaaaaattaaaaagacaagtcacgtataaagtattaatcatgttttatcatctaacaataatgaaaatactaattataaaaaattcatataagacggacagtcaaacattggacacggaaatccagggtttgtttttttttttaagggcggagggagtacgcggttgagccactgtcacgtaggctgtagcaaagcgagattcatgtgtgtcagtgagttagctgtacatgcagttaggaggatgaactttctccgtctttatacctgtgaagaagagcagaggaaggaatcgaaatcaatacgatctcacggtctctcactgttggctacttgtacagttccaactccactaactcaactggttagaatatttgacagaataacgcgtggctaagtcgtcgatcggatctggaaaaccaatgtccgtaggccggtagttctacaactaaaattttcagttcggtcaggtgacatcactgttagcataacaacgaaaattcaatagcataacacaatgaaattcaatagcatataacacaatgaaatcaagtagcatgtgcctgagcgcatgtttgtcatttggaagcccttaagccctagtgcagcatttactgtaccacctccgtatcatagtatataactacctcttctattgaatagttacattgtgcgtcttaatagtaatgttgaattaaaagcataagttggcaaaattacttctgaaaacgatcgagcaggccgcgcgaaatcgtttaacgattttcgtacaacttgggagaaatggaaaattctgagcaggaaatgcggatgcatatttttaaacagatggaaaggtgccagtagaagtattatgaatttcgtccctctgggaaactagtttaatattcttcgcatttaattttgttataggatatcatgacttcgtggaatctaatattttataacagatttgctagaaaactaccacaagtttttttctcccaaaactttcagatttgtgaccattggatcgccaagaaatttgtgcatgaaggaaaaaaatgctaaaagtttttccacagatgtcatacgtaagatcctagtgtgaactaaccaaaccataattgaatgtaagttttatataagttatatcacagttacattacagttacaataccgtcataatgcaatgtagttataatgtaattatacttcaattatgctatatttacatctaaaaatttttgactcaaaaaacctacagcagtttttagagatactcccctgtaataatgaatgtagtgtccaactgcaaataacgatattttaaaagtgtattacctcaaagattgatttttaccggctaaaatcgcgaagtcgtaatgtcctaaaacaaagtttgcccaacattagcaaaagaaaaatgggagaggtattagcataaagtatttaagtactaccataacaacgaaattcaatggcataacacagtgaaatcaaggcctaaagggaagagattaattcgtaacaaaatataaccaaaagacataatatttactcctttaaatgttccttggggtggtggtggacgtggtgaggcactcactgatatttgggccccacaaaactagctcagtaaacaaaagtgttctatggaatttcaccgcatcttcctccctctgtctttcgatttgtactggtccacttaaattactgagtcattttcgttctactgaaactgtctcgtttagggggtgtaaaattttagcgtgtcacatcaggtattatataagttgtcgtatgaggtgttcggccactaataacaaaactaattacaaaatccgtcagtaaactgcgagacgaatttattaagcctatctaattcgtcattagcaaatgtttactgtaacaccatattgtcaaattatggagcaattaggttatgcaattagttacttttttagcctatatttaatacttcttgcaggtgttccaacgctcgatgtgacagggccttggtactatgcaaaaacattgtcgtgacgaacgaggcacctaccaaacagtattttctccgtttcacaatgtaagtcattctagcattttccatatatatattaacatcaatatgtatgtgggaaatgctagaatgatttacattgtgaaacggagggagtactatttaatagcattcatccaggcaatgctccatgcatcacaattcacaaattgaatgagttgatcacacccatactagcacgcaacaacatgatgatgccgctcgttgccctcctcctgatctcttccccaaagctgttggcagcccaacagcagctacccttctgcagcagcagcagcagcaacgcgaacaccctcgcctacatggcagagggcacctacaagaccaacctgctcaacctcgccaaagacctgatcgccaatgtcaccaagacggggtcgcactcggccgccggcgccacggctgggacgacaggtcccgacatcgtctacggcgccgtactctgccggggagactccaccaactgcagcagccgcttacagagagtgctcgacacagccagcatcagtaataatggatctaccagtagtgagagtgactcccagtcccagtcgcacaagagtactgtaaccttgtacgaccatgagttccaggcgctgctaagcttctctgacacggacttcatctccagcttcagcaacgcgccggcgtgcatagtgagcaattacctgaaccctgctgtccctcagagggatgctgatcgcacgcggttcagcgagcttttctctgagctcatggagaggatctccgacgccatggtgagtagtcgggccagctacttgacgggcaaggggaaggggtggttcgacggccaggagagtcagccagtagtatacgggctggcgcagtgcatggacggcatgccgccggagcgttgccggagttgcctgggcggcatcaccgaccaagggaaggagatggtcagcaatggcctgacggaaggcatggtgctcggggtgcgctgcagtctgtggtaccactaccagacggacggagaattcttcgccggcgagccaggggtgttagcgttcctaaacatgccttcttctagagacggtactatacatgcctgctggtacttaattaccttcaccttcaataatttgtgttttgttgatttggttcaattaacccgtctttcgtcgtcagttttcaccgtctaagaattactgctcaacagagacattgctttcatctaattcactagtttccattaaactagccgtgtttagattcaaaattttttcaacaaactttcaacttttccgtcacatcaaatgtttggacacatgtatggagcattaaatgtggacgaaaaaaaacaattgtacagtttgcatataaatcacgagacgaatcttttgagcctaattacgtcatgatttgacaatgtgatgctacagtaaacatttgctaacgacagattaattagacttaataaattcgtttcacagtttaaatgcggaatctgtaatttgttttattattagtctacgtttaatacttcaaatgtgtgtccgtatacttaaaaaaaaattttggcacacgaactaaacacagcctaactttcataccttcaaagtgtcatgtcatgtggcctcttattcaaaaaataaaataaaataaaaagtgtcacgtggccttagcttatccttatcagtcaaaattcgaattttcaaccttatatttgaaaccaattttgggtttcttcatcgaagtttatttttcagcctatgctttaaatcgctaagaacacatatataaaagttttattcacaaattatttttcgtttacaaatatgccgtttggctaatttcatgaataagccaaacgatagggcctagtttccactagttataactcatatcaatggatgtgcagaaagcaagttcgggctctgggctacaattggatcgttcttcctcatggtatcattttcatgtttctttgtgtatatttggatcaaacaggagagaaaaagaggtaaatatataactaaatattagactcacaacgttcctcgtttgtgtaaggatatatgcatctgattcgattatatagctaccagctactgtgacaagaatagactgtttcactgttttcttttttcagaagcaagatttaaactacgactgatatcgatggcaatacaaaatgtgataaatctttggaggattgaagaaggcaactcaggattttcattgtataatttctctcagataaaagaagctacacaagacttctcaagggaaaacaaaattgggcaaggtggttttggatctgtttataaggtaattgactaattgtatacttgcattggtattcaacatttttaatatttatattgtatatttttcaaatgaactttgatttttttaatcagactatttctgctgtaattcctttatctttttttttcaaaaatatttatgttacatgccaatgtggcactcaacatcgtaattgtataaatgtcagttttttaaaattaaaaaacaaaaactgtgtcctccacttaatatatgactctaatgttctttcttttcagggcctattacctggtggtcttgaagtagcagttaaaagactttcagcatgttctgtacaaggtttattagagttcaaaaacgaaattcagctgatagcaagacttcaacacaaaaaccttgttaagttgcttggctgttgtatcgagggagaacaggaaaagatgctcgtctatgaatacttgcaaaacaaaagcctggacgtcttcatatttggcatgtctccaataagactagatatttctacatactacagtttgaagttacaagtattttggcaattttcaataacctcattcatattttgcagattttgtgaaaggagcacaattaacctggtcaaagcgtctacatataattgatgggatagctcaagggattctatatcttcacaattattcacgattatgtgttgttcatagggatttaaaagcaagtaacattctcttggatagcgatatgactccaaaaatttccgatttcgggatggccagaatattctattcaaatacaattgaatcaaataccacgagaatagtaggcacgctgtaagtacaaatgaatatacacagttatatatgttctccattttgcgtctaattattagttcctacaattccgtacattgagaaaattagaaattttctcctggagaagcatgcatataagttaattatgaaatttgtgtataaaaattcctatacttcatgtgccttggtaatatataacaattctacttctgtaatattcagtggctacatatctcctgagtatatttttgatggggtttgctcgatcaagtcggacgtcttcagttttggcgtcttggtcttggaaatcataagtggaaagaggacttctggattctatccttacgatggcaaactatacaatctcatttcatacgtgagtaaaatgtactacagattatcctttttgaaatggacagtggaaccgggttggtcccgatatactccaaattgagaatcatttgctttcataatatcatcattctttttttttattggtgtttttattgacagaaatacacattcatatattgttttctaataggcttggctactttggagatctggacaggggcatgagctgatctgttgctgtatagaaaacaatcatgaatcgatacaaaggtgcattcaggtggcacttttatgtgttcaggagagggcagatgacaggccttgtatcgaccaggtggtcactatgctaaacagcgagggaatgaccttgcccggaccaaatcagccagcctacttctatgtccgctctagtggcagctcagatgttttatcatgtgacagcaatataagcatcacattagaaagatagattaattgtcatcatctccattcaatacagaatgatatccaaaactatgctgtatacactatctttttgtcttccttccggagtttaatcgaattgtgttcagaacttaattattttttttctatttaataatgtaaattagtgtgacaaaacattgtgctcctatatctgatgatgttctcttgtgattatcatattacaataaataggataaacctggattgtagagtatttggcgcatctgcatttttcgaagggtctcattgattggcttattcttatgcttataagtcaaaatttaaattttagaacttggttttgattctgatttttttttattatagtttattttataacatttgcttttgagtcgctagacacgtataacaaattttacacacaaatattttttatttattaataaacgatttgaatttaacatatgaataagcgaaacaatagggctgaaaatctaaataggaaatctaaatgcgagccgtcagccaccgagtagcatcgattcctaatttcttcaacatttaaccaaaaactttccaatcaggttccaaagctttctgatgggggaaacaagaggagctttcaagtttcgagcaacaaatggagaaatttgttgggaaacccaatactggaatccctaaactttcatcacggaaaactaaaagttttagaataatctcacctcagatccgaagatgttttcaactcctcattgcacgcccgtactcgagagcagcggcggcctcgccgacggcggcgttggacgcgacgggtagcgtggcgcggctacgattcgccgcacacgggaggagagagaggaaagaggattcgcgctcgcaccgcccttcggagtcgggagttgggccgcgccgccgtgtgctgtggtgggccgttttgctggctcgcggagtaactggcccagttttactgttgaccaccgtagcaatattttagggatagatgtaggacttcacccagcccaatccggcacacgtttcgctcgaattttttttatttacaattttttttattaaaagttttacaaaaataattttccattttgaaaattgacggaagtagtcgcctaccgccctctgggagggcgatttttaaaaatcgccctctccgagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgggggggggcatggaattttgcaggcggcccccttgccgccctccgctagggcgattttgtactgtggggggggccgcctgcaaatgggcggcgagggggcatggaattttgcaggcggcccccttgccgccctgggggagggcgatttttgcctccccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtatacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtagaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctattgcaaaggcctggagagccaaacaaaagatcattgagatgaggtatggcacatttgaagcttcttatgataatttgcctcgtttgttagccaccattgcccagaagaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaatggttgggatgagaagggacttccagctaagtggcctgatgttcggagtcggtggtgcatgcgtcacatgggtgcaaatttctacaagcaattcaagaacaagcatcttatggagctctttaagaggctctgtgcgcagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactg

SEQ ID NO: 936 - DNA, 5055 bp, Oryza sativa
gaaataatgtgtgttgataggagcaggcgtggtatctatcgcaagcaagccgtgcaggaatgtgtcttgaaggcggatggtggatgtacctgcagttgtatgaagccgaagcttcatcacgttccttgctcacacgttcttgctgctgccggtgattgtggcatatctcccaatgtgtacgtctcaaattatttcaggaaagaagcaatctttcatacatggagtgaggagatatatgagttcaggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgctcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaatttgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctatagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagattgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgatgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagtagagggtgaccttcgaccggatgcaggagaagatgcgtccggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaacacatcaccccgtcgtaacttgatgatccatcctcgcaggacctcgtttgccttcgagcgcccctagctttggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcaagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtatgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgattgtcttgtcacatctaatgaataatgtatctcattgagttcacatatattgcagtgaaaacgacgctatataattgacaatctgaaggcaacctcttcatattttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctagcggagggcggcaagggggtcgtctgcaaaattccatgccccctcggcgcccatttgcaggcggccccccgcacagtacaaaatcgccctcgcggagggcggccaggctgttcaacgcaaatttctgagccccggcattcatctattaccaacggtggagggataaacttcactatttctcactggatctgcagctttatctaacgttcatactatggactgcctttcaggtagagtccacatatctttatcacacaaaaacgaacacatccaactgaggttcaagtcccactctggatcaactactacaggtccaaatactctacttattacttccaatgaaagcctttcgatgaaactcattaattattttttcttctattgagagacaaatgctttatccactttttgtcccgcggtcaacacaaaatgcattgctaaagatatgtgctgctataacaaacggatgaagctatcaagggaagtggagaactacgt

SEQ ID NO: 937 - DNA, 46255 bp, Oryza sativa
caaaattccatgcccccctcgccgcccatttgtaggcggccccccgcacagtacaaaatcgccctcgcggagggcggcaaggggcccgcctgcaaatttcgttgacggccgtcgcccgagagcgaacggccgtctgccacgtcattttcgccgccctctgggagggcgatttttaaaaatcgccctcccagagggcggtaggcgactacttccgtcaattttcaaaatagaaaattatttttgtaaaacttttaataaaaaaaattaaaaataaaaaaaattccgtttcgctcgaccgttctgcagccatggtggtactcattggttctaagagcaaggttaatagtatagtacattgctagctccaaatcatctatagtcaatataataaccaattcatataatagttgcttactatactattaatatctggtcccacctgtcatacacacattacgtcttggagttcgtgctgcagctggttatagatctatagcccgctgctcttctctctcttcttttatctctttaaaatatatttatagttggcttatagcctgctattgcatctgctctaagttctaaccagactggcacagattcttctatgcacagattcctacaaaatcaattttaccccgtataaagttcagattcactcagattatccgtgatttgattatttaatgcatttgttggctgcaccaatcccattcaactattagacttattttactttctgtttttttttaaaaaaataaggtggtcatatactcatgtttgtaacttccgtacatcaagatttaaataaagagataaattaaatgattgaccgaaacctaagtattcatcttaatatttattgattgtatttcacgtaggattagttaaattctttttagtcttgatgacaaaagtaatatatctaacacttttgaaagaagggagtatcaaatttagctttaatttatttatctgattgctcccactttcatgcagggcctcatgaccagagatgccagaaatcaaagaaccggctccatcagattctgatctcgactttcagaaatgaacaccgtccatccaatctgccttttgtttgggagctccacttcacttggcaggaacaaataaagagatggctcacgtttattggatggggccatacgcacgctattatcctagatggaggattttacatgcttacaaggggcactttacaaaagcatgcaacataaccctttcaagataaaaagcatccaacatgctcatcgattatttactgatcaacttgctcgatttgtggttaatgttcctaagtagtacaaaatggaactctacctctacaggcatctccattaattgatgcttaggctaaggctcgcaagggatttctaattttatttttcaactaaacaagcagtagtaatgctatttggggactatctcaaaaaactgttgcaagttttttttgagggaaaacttttaaatcaaactatagtactccctctatctaagggattttggttacaagtcacatccaaccaaaatcacttatatttagggacggagagagtataattataatataattcccctataattataatataacttgtatataagtattaaaataatatttacaacttatatctaacttatatagagattacaatgcacttacaatataatataactgtagtgtaattacattttagttacactataattatatcatagttacatttgaaatttttttccaaaaaaaaacttgcaacaatttttagcaattccatatctaaaaactagtcataggcctatgcattacaatgggacaagatctcataaacgtgatttattttttctctcttatcgcatatttttctctcgattggttagtttttttttatacaggttttttgagtggattttttatacgtaggattggggagaggaggaaaggagcatgaccgtgcttttaagatactggtagagacgccgaaacttgccttgtctgacaacttcatttcttcaacagtgttcacttcgctttgcaaaaaaaaaaaaaaaaaaaaaaaaaaaacccccaatactttaccaaataaatacaatagatacaactctaccgtgaaaaaaaatacattggtagtaaaaaaaagtagtctataattcggcactaccaacaaattgataactataaaatggctcacacaagtcgcacatatacgtgcttaaatcttaataaaatcatattttaagataaaattaaattttatttcacaatggaccaaattatgtaatttgcccaatttgtaactagtgtttcttgcagaaatttataatattttttaaaattcagatacataacccacggatgcgattgcatttgaattgtccaaaatagtttatttacctaaaacaattcagaaatgtttttcagttgcccatttgtgtataccaaaagtaaataaattatgcacattccaaagtaaagattccaatcacaaaaactgatctttaaccatattataaaactattttgtgcagcatattacaaaactgatcttaagttctttaccatataataaaactattatttatatagttcaaaaataatatagcttgtacatgccatgaagaataagtgatacttctccatcccaaatataagatgcaaccacttttttccgatatttcattatataagacacgtatgcatacatacaattaactagcacctcccccacgtccccctttagtttgttttctaaatcctccactcaagattttttttagttcatctactaatttttaaaattcaaaatctttaaatcacaatgtcatatcatctaaaaccgcttagtttatttactggtacgcatgaaagaaaaaactatgagggtcatatcccttgatctttcctatcatccaaatccattgatttgtagtggtacacaaacataagagtatctctaggattttattcttattttgtagagtggtacacgaaagaatgaggagctaagcaaaatccagctcaagcctttatgttagcatatcgtttttctggcctctgctggcaagcaagaatagcgttcaaagtatactgttcgcatggacgtccggcaatgagggcgctggctggctcactggccaaagtgaagtgatggatattgatcatgtgatatatattcgtattctaattctttcatctttctgtacattaaatttttagaggtactgtttcttgataaaaataaaaaaaaataaggaccattgaaaaatcataaaattttaaaaatatcattaactgtacgtatgtgtcattaatattgaccggtagacggtagacctattgagccctacatgccgttctcacatatatatacaatttacgttagttttctcatctaaaaaattacattagttttctatttttttcaatataagtaccatatatatttccactatattggagtagctcactaatcgagcacacgtttaaatgctaatgggtgaaagtgaaactactcctcctcgctagcccatttgcaagatccgaaatgtaacaacataatttgttacatgctgactttgaagtttctaaatctaattttcaaaaatattttatgtagatattttacttgtctctggagaaagccacattcctaacatgctgttccaatcggcgctttcctgacggtggccgtgacggtaaagtagtcctgacggttttgttttaatcctaactgtttttgaaccgctagggaaaaaaccctttttttaagtagtgtccttgctccttaggagtaatgcagaggggcaagaaagtaacaaaaaataccctctaaatttaattagaatcaaatcctaaaatttaatcagcttcagctcaaccaaccactatacattgtgcatgttttcattgattattattcatatgataagatgtgcatccgtgtcttttttttctctagttttgacaaaggcatgtctcagtagtcggtactcgattcccaagtcccaacgagggtttaccaaaccgcgcagttaccacgcggttaccatggttaccacgcacggttatctttttagtttttgaaactacggtatgtctcacggtaaccgcctttaccgcggggtgcggtaaccgcgcaaaaaaggaaaaatggtaaggggaaccccaactattggtctggtggatcgggatcctctgccgtaagcctgctgctatggcagagagcaccggtgcatggcatttcgaatgctctgggtcgttggatgtgtgatggatggttcatatttattgatacagcaaaagagctcagtgcaaatttgtctcaaaagtcgagcgcgtggatacaaaggtctggtttagttcctaaccttttcttcaaacttctaactttttaatcacatcaaaactttcctacacacataaactttcaactttttcgtcacattgttacaatttcaatcaaacttccaattttggcgtgaactaaacacacccatagtgctactccctccaatccagaatggcataaacaagaacaggactttgattaatactgctccagtctcgaaatatactccctccgtaaaaaaaaaatgaatctagaattggatgtgtccagattcattatactaggatgtgtcacatccagtactagattggttttttatgggacggagggagtagttatttatagcgtattgacttattttaaaatcaatctattctttcacataatcataaccattcttcatttaatttcttcatctaccttttcttttctcaaccaatcacaatatttctctaataattttcatctacttctttaatatatgtgtcaacctaaaaataattatattttatgacgaaagaagcagttgtcttactactttaccatttatctaggtcataaaaattataataataaactattttaaatacaaacctaataaaatcaattctgtcataagaattatattttattaattatgtcttaacaaaataaaatatatcttatatactttttaacaagggagcgctatctagctatcgcattttatttactgttctaccataactagagtgtccctccgtaatactccctcaatccaaaaacactttaatttagagccaattgaagagaatttagcagcgagtgagaaaaaagactaaagtatagctcatcaaaaaaaattattgttaggaggatagataaagagtattaaaagaataatacttatttcatttaatacttatggatctgtggactaattaatgataggtaagaagttagaaatcaactcttttaaagataaactttaaacattatacatttttattttttggacggatgaagtataacagaggggagaccagctgcttgccagtgacagaaagtgagtcgtctcatccatgttctgaccacgaagatctttacgctcgagtatgtttatatatatgctccagtccaaagatacttgagaaaatatgggcagctcaagatgtaccaatgtaaaattaaacaagccaggaaccacacgaaaacgaatctccggacagtttggtcaagttgcttgtgacaggacatgggctcccaaaaccccctatgggcaataatttaatccttctaccgtgtacttatccactaataagcattgcgaaatcagtaaatagcttttattaaacaataatattacaacctggtatttgctatgcattggtcctcacccgtctcccttcgtgttattggctgctgctaaactttatattattatgggtctcaccttattgctaataagacattgtgaaacttttaaaaacatatgcctagctacttttcttgggtccaatattgtttactggttcgtaaacataattggtgttgtcctaatatgggtattttagtttgtttaataaatattaagagcctcttcggttcacaggagttttaaattacaggaataagaaaaatgaaaattgcaagaatagcgtaggaatgtatgtgcaaaacaaatgattagaacacatgattttttgcttcaatgagcttaacaaaagaggatgaagtggatgttttcattcccatggaatcaatccattttggaggactggcataggatttacatatgaaatttttgatcggaatcctatgaaccgaatgcatgaatagtgtttattccaaaggaattaagatttcctatacgaatccatcaaaccaaaaataggcctaacgttaaggttgtgttcctttggacactttctcaacttctgctcttttatttttcgcgtgcaccgttaaacaatatattttttaaaaggaaaaaaagtacgaattacccccctaaactatcgcggtaattcagggggtaattcatactttttccttttctaaaagatttatatagaagaaatactttaaaatcaaatcaatctatttttcagtttttttaatatttaattaattatgcgccaatctaccgccatgctttgcatatcgggaaagggtttccaaccctcacaaacgcaaccttatagagaaatactttctttgagtgattttattggtcaaaatttgaattggttagattcttcaagcacctgattagctgaaatgtttgattcccataaaaaatgttggattcagtgttacaaaaatatttatgtagtgtgtacaaaatttaaatcttaaaaatacttatacgtgggaacagagagagtacttgatcaagaccagcatgttcctacctgcgtataggacggcacaaagtggacgcacgcgtgaattagccaaccggttctgtctactttccgccaaaaattgtacgatcgagattgacacgggcaaccacgccaccacaagtctacgagtctacgatgacgttaatcgaacaaccttgcccatgtcacctcttagatgtaacatatgtcgtgcaaaagactttctctaagttttctttttacagctcttgaacttaatcgttgattttggttaagctatatggctgataagacatctaactcaaccaaccatgcgctaccctttttctttaccacacagatcatttaaaattttcaagaatttcttttagataacgacataatgcaggtgcgaacttcgtagatgaccggttaaaaggaactgcacatatgagaataagttttcgtgtattgctaagaaaccgttcgtgaaaatgatgtacatttccgcccacttgtttttaggccttcagccgcttgcgaaaactgttttcgtagcagtatctagtattggtggccgatcgtgcaactgcggtgagtaatgacataatatatatatatatatatatataatgtaatctagagctttaatttgattgattccttggaatatataaatattattggtgcgtttggtctatggtagctataggtcaactttcactgcggtcgcctatgttcgtgtactgcaagtcgttggctgtgtagtctttgttgttcatgtgaccactgatcgtgctaagattaggaccagctgatacttatctctggcgaccaaagatttgcaacaggagaagacttttgcaaggtacaaaaattgtccgtcttttcattccactgttgattcatatttgtcgtgacgaccaatcctttgtctctgcatcagtttttggtgacgattgagccatggggagacttgtgattgagacgaggaagactctcgtcggtcgcttcttcttagaattcgagataagcatataaacagtaaaaacctactctctccattcagaagcacttttagctcctgctaaagtaaagataggatttacctattatctaaaaaataagcatttgtagcatttgaaagttatattaaaatatgtttatagtgttgttcttaagagcaagtataatagcaggctataagccagttccaaacatattttaaggagacaaatgaggaaagagaagagcaggggggctacagatttatagccagctgtagcacggacttcaagacgcagtgtgtgtatgacatgtgggaccaggtattaatagtgtagtatgtaactattgtatgaatgatctattagattgactatagatgaattgaagctagtaattagctatactattaaacttgctctaagtactactactatttatctcatcgattacttctcatttaaatttcttcctagcttatcactgtctcatcaattacttctcatttaaatttaatctctactaacaagaaaagatgcgtgtattttgtactaagagagtagcatggtgtgaattgttgtagtgtggtcctggttgtccttcgctttggccatattttcttttctttgtttttttttttctgaaacagcacgctttggtcatattttctacggttccattcgacttatgtgtatcctggcctcaccatccaaaataaaagaatcttttctaaggtaatgttcgaaacaaattattgataggattattgtcgtggattatctagctagctgaatatgtacgtgaattaaatagtttgaaacataaacttaataaatattgtacaagtagtctaatccaaacaatatagtagaagacttttttttaaaaaaaaagtatatttagaaaggtggagcaaataatccatgataataatccggtacggtgaaccaactgaaatatgtttctattaaacgatgtgtgactttttttgggcgttgaatcaggccagcattatgagctttaatgtctccatgacttcatctccgtgactaattgatatttgaatggtaccggtggaatagtttcgtaaaatagaataatttcctaggactatatttttgcttggtttcacaaatatatcatactagagattaataaagtcaacagggttgttttcacaaacataccacattatttatgttccttttagatgcgaaactcctaatgggcgatcgatcacccctagcgatcgggtcgcccctctctccttcacgtggtttccttttttggcactatattactttcctattttagtaaatttatgcaccaaaagtttgtacacctcaagtttacacatctaaagtttagagacccaaagtttataaatcaaaagtttttatatccgattcaaattgaatttgaatttaaatattttttatatatagtatttctatacatctgaagtttatacacctaaagtttatagacccaaagtttataagtcaaaagtttacatacccatttcaaatttgaatttgaatcaaatattttttatatatattatttctatacataattttttttaactttattttttttttattttttaaaaatttatagtgtagtaggaagagaagaagggtagtagtaagtaggaagtagtaaggggcaaggggagtgtataggcgggatggggatcgatcgcaagcgagcgatcacccattagccacgccattttagatgccgtttacaacatcgaaaggaatctaaaacatgggtttaataatcacttttctaattatacattactaaaaacatcaaaatataataattgcatcaatttttttcacaagtctaataatgtcattttcatatattaaatcctaataattttataacaatagttaacattaattttgagctcagattgtaacgtatttgacaacggatcgaagagattactagtagtgtcaagtatacacataggcgcgatatccatagaattttcaacgagatcaaagtttgcctctcacttatgctctatccatttcatatcataagtcatttgatttttttcttaatcaaacttctttaaatttaatcaagtttgtagaaaaaatatactaacattttcaatgcgatacaaacatattatttatatatattcaatgttaaatttaatgaaactaatttgatattatacatgttgctaatttttttttataaacttgatcaaatctaaagaaatttgactaagaaaaaagtcaaacaacttataatatgaaacgaagagagtatcgtttaatttaagatatgtgtgcatcttcactgtaattgggaaaataaagcaaagtgggtcacactcgcagtaaccaacaggataacgcaccacccgaaagcacataggctcttgcaaaaggtgaaaccgaggaaacaaacaatgaagaagatcagcaagagtaaaaaagtcattcagccgtggaaaagattcgaggagattgaggttaacgtgcagaaaaatctccatatatatagctcgtacacagcgctggtgacgagattccccatctggctttcatcttgcgttcaattgtttgaatatccatacgttttttcctcaagaaaaaaaaaaagctatacgtttctgcaataacataaccgttgttcatttcgaaattctgtgaaggtttgaaacccgatctttgggagtcctcaataatccctaataggagagatgtttgcggttgtgatgacccatggcatgaaattttggaactgtatgcatttacaaggatgtttctttaagaaatttcgtgactttagggatttatctcttcagtttaaggaagagacataaaaaaacaatataatgacacatagacgggtctagttaaaaaagtttttggcagctacggatgttttaagaatcggaccgtgctgtcctaatctactcattgtcggcattaatgctcggagcaattcgaaggcaagagaagaagaattactcgagatgatcgacaagcttggatctgtttgggctatacgaagacaaagcacttgtttgctaccctcctatagtcattcttctactcgaagacaaaggttgagatagccgaatcgaggagaagaggatggtggcgaaaatacttctcttggaacgtccgatcagataaaaatcatcggacacctacgaccagctcacttcttatttactaatttcttctctctctgtcgacgtcaggaaaatactacaaatcagcagcctggtggattggacgaaccatgttaccgtaacatgcatgtctatctgtttcttttcattctttcctcctctctttaaatttttttctcctaaattacttatccgatctacgaacctatcacatcgtttgtattcgttgcaattaaatctttacaacaaaatatcacatgattatattatgtcaaaagaaaaacatgtgtttcaaactgttaaaacaaaatgtttcatacgtgatagtgatatgttttaatatgtgtcttcagtgtgtttcacaaaatccctgaaactacctgctactactctctctctccacctcatgcatgcatagatgcatgtattttagcaagcttcaaaattttatcttaaattacttattcaatctatgatccgatcgcaccgttatattcgttgtaattaaatctttacaataagatatcgcttaattatattttcataaaagaaaaacatatgtttcagtccattaatacttattgttttatatgtgatagcgacatgtttcaacgtgtatcttcaccatatttcataaaatatttaaatgcttcagttgctgattttttttcaccatatataacttaaagtttcacttgttggtcaactgcaatatttgaccgtctgattttttttttcaatttcaaatgagttattttcatttaaaatgtttcatctagtgtactcgtgatgttttactatatatggatcaaatgttgcagtgaattgaaacatcatttcgctattcgctgaaacataattttcaaataaggcgttcgatgaaacatttttgatctacttagtgaaacaattctgatatacttggtgcaacagcgtgcaacatttaaaaataattcaataataagctaattttttttcatctggttatattcatgtgtggtcttgttttaaagatttaattgtaatggatttaatagtgtaattggatcatgattttgataaatattttaagagaaaaaaatagtttaaagtttgcttgattcatttatgatggatcggacggtcgtgcgaggcgtccgattattcgtctcgcgccgtacgtctgacgcgtggcgctctccggatggtggccgaagaagaagaaaagaggcatgtgaaaaattaaaatcatctgcactactacacacttcctccgtcccaaaatatttaacgcggttaactcttttaaaacatgtttgaccgttcgtcttattgaaaaaatttaagtaattattaattcttttcatatcatttgatttattgttaaatatacttttatgtatacatatagttttacatatttcacaaaaatttttgaataagacgaacggttaaacatgtttagaaaagtcaacggtgtgaaatatttagggacagaggtagtatataatactattactcccttccatttttttgtttgacgttccaattcatacctaagagcatctccagtagtaggccctactttagagtccctaaagtttaaatgggggctgtccccaatgctttaggaccctaaatatgcctttatgtctagcagtagcctccatatcttagcccctattcctttttctcttttattttagtatagaatttatatttatatttagtttaacacacaataattcaaacatagataactctagcgcgtggaattcaaccatattcaaatttgcaatttcaaataccacgattcaaatttgaattcaaaattttcaaacatgaaaatgatatatcctacgagcaaatattgaacataacccatacatgatagaaaatgcaatgaaacaaactatcgagcaccatgaagcgcccacaactgttccacaacatcatctcgaagttgctcatgtacctgtcggtcttcaatttctttatgtatctttagaaacttctctaacacaggtttattacgccattggtattcctcctttctcaacacctcactgtcctcccgatcatagtcatagtctacatcttcatctcgctcattgtcaatgatcatgttgtgcatgattacacaagctgtcattatgtaccatagggtctctgtatcccaaaatctagcaggacccctcaccattgcaaagcgggcttgtagaacaccaaatgctctttcaacatcctttctcactccttcttgaacttttgcataatgtattctcttgttaccttgtggattggaaatggtcttcacaaaagtggcccaagaagggtatatgccatcagcaagatagtaacccatagtgtatttctttccattcactataaactccagctcaggagctgtccttgatgtaagcctttgaaagagtggtgatctctgtagtacattgatatcattaagagaacctggtagtccaaagaaggaatgccaaatccataaatctttcgatgcaacagcttcaagaatcatggttggcccatccacatgccctgagtattgtcctttctagcctgttgggcaattcttccacctccaatgcatacagccaatacaacctaacatccctgggaacccccttggagtgtttatagccatcaaccttgcagtgtcctcagcagttggtgccctcaagtattgatcagcaagcacatctaccacagccttgacaaagtgcttgaaagcttctatcatggtgctctctgaaatcctcacaacttcatcaagactatcggttggaatatcatatgcaagcatgcgaattgcaccatacaccttctgcaatgcagtagcaccgagaagacccactgcattcggtctccacctgaagtagtcatcatgagcctccacactagccacgatgcgcaagaagagctcccttgacattctgaaccttctcctaaataattttgcattatatacaggaggatctgcaaaataatcagccactatgcgcaaattgccagcaaacctatccctataaattatctcacgacctgggactgaaccacgacgctttcttttggtcctcttatgctctatgtccgtaagaagagcagctgcaatgtagtagtcatcatcgtcaaacaactcctcttgatcccaccattcggtaataagatcgtcgtcgtcgtcgtcgtcaccgtcgtagaagtccatgtaaaaaacactgccatcacaagatcataaaattaataagaaaatttagagcatatacacacacgtatccaactacacatatacagtacgcaacattcaatctatgaaaagcagtgcatatatatatggttataatcgatccattgcaacaattgtacagtgctacacaatgcagtgctactataagtacagtgatatatactagttgagaatttagattgtcctggccgacagtccactacaattcttcaaaaaaatattaaaaacaaatcattcaccaccataaccatctgtcaccacgtccacaggtagtcaagaacgagtttattcagaaaaattgactggtactctactactgagatctcctctactactcaaccaccacaccacatgaccaacttcaagttttttccagaaaaatcaatggggcagcggcggtgtacaggctccggccagtgaaatctgaaaatatgatcgggcagaggccagcgtgggggcaaacaccatgcaagtgggtgatgtgcgtgcgggcagtctcagagggcacgcgacggccggcgtatggccaggcggatggggggaggtcggtgaccaggcgtacgcatggaccaccgccgccggccttgtggacgacgggcgaacaaatgtgtggaaaagtcttaccttttggggcaggcttggcggagatgctgggagttcgccggtggtcgccggagaagatccctcgtcgcagccgcgcaggaataacacgaaaaagcgcgaagcaaaattgttatccacgccaaaaaaaaagaatgatggggccgtgctcggagcccctaggactgaggccttaggggaggatttgagggccttcttattttggggctgtaatagggtccctgctggatctagtttttttatcttaactctcaaaaattgaataggggctggatttaaggttcctgctggagatgctctgaaggcgtttttttttttttgacgcttgcagttcagacgccctcctcccatacgagaatttccacccttgcccttttcacccctgtatggacgaaacgcattagtgcaaaggggcaagagtgaagggcaaacaagttaattcacagcttccttagtttaatcgggcctgtgggaagcgtaaaaaaaaaaataaaaatggaggggagtacttaacgatacataagactcctcgaacccatttgtcattgaatagatcgagtaccttcatccatgtggaatgggagaagacggcgacggcggtggaatgctacacttccggtcgttacgcgtttcatggcctgaaattctcacacgcgtaccctcgaatgctacacttctctctcctactcagcatgtcaacacttcgtgacaaatagtgtcgtcatccttgcgtaattagtaattctacgccgtaattacttgccaaaacaaaaactaaaatatctccctcaaccaaaaatttcaccccgagttactgtcaagtgtcgtcactctgtgttactactaccattcaccttttaatccccccatttaaaccgagcgactaatccaaggtgattaaaaccctaattactcccttcaccttcaccatccgaatctataaaacccgcgaatccgcgatagcagcaggagcagaagagcggccatgaggacgaacaccaccgccaccgtgctcctcgccgcggccgtggcgctgctgctcgccacggcggcgcgcggcgacggcggcgacggcgggtgcgggaaggaggatgcggcggcggggcgggaccgggcgcgggcgagggggctcaagatcgcggccttcttctccatcctggtgtgcggcgcgctggggtgcggcctcccctcgctggggcgccacgtccctgcgctgcgccccgacggcgacgtgttcttcctcgtcaaggcgttcgcggcgggcgtcatcctcgccacggggttcatccacatcctccccgacgcgttcgacaacctcaccgacgactgcctccccgccggcgggccgtggaaggagttccccttcgccggcttcggcgccatggtcggcgccatcggcacgctcgtcgtcgacaccctcgccaccggctacttcacgcgtgcgctgtccaagaaggacgccgccaccgccgccgccgtcgcggacgaggagaagcagagcgccgccgcgacgcagcagcacaaccaccaccacaatcaccacgtcgtcggcgatggcggcggcggcggcgaggagcacgagggacaggtgcacgtgcacacccacgcgacgcacggccacgcgcacggctcgtcggcgctcgtcgcggccgtcggcgaggacgacaaggagacaactctccggcatcgtgtcatctctcaggtgagaggccacctcctttaattaacgtaacacctagctaattaccatgcattcattcatgacgccagcctggtttaattaacccataggtaagaaacagcagtctcagtaaccttctgttttttttactgtcattttccacactttcattactactctctctctccgtccttaaatataagagattttggttgaatgtgatacattctaagacagcgaatctagatataaatcatgtccaagttcattgtactaggataagtcacatctaatcaaaatcccttatatttagggatagagggagtagtatgtacgtttcaaataaatattgcagaattaaaatggaatttaagtgtattcatttcttttgcacatatattttttttataagagatcccaccatatattataaattggcgttctcgaaaatagcatttataccaaagatcaaattttcggcgtattatggagtgatagaagaaagagccgaatcgcggaaaaacgagggcacatgcgcccaaaggtttcaaattcaatgtgtgtcgtacatatatcattttcggtgatgtaaaatgcaaagaaaaatgcgtgcagaatttaacaaacgagtgcaatattcagaataatatatattgtgtatcattattgacttatacaattgattgattttaattaggttctagagctagggatcgtggtgcactcggtgatcattggcatctccctcggcgcgtcacagaatccggaaaccatcaagccgctggtggtcgccctcagcttccaccaaatgttcgagggcatgggactcggtggctgcatcgtgcaggtatatttctactctctttttcttttactacatggtgttttttttttacccaaaattcatatatgtaaaaatggtatcttgcacggcatcttaaaagatatagccttgttggctcaaatcattcatgtagttcagctgtttcaccggattattgtcataaattatttcctcagcgtcttcaaaatatgttttttctaaaaaaaatcttctagtactatattatttacaccacttgtttttagaagtatttatttttttatattttaaaatatttaatttatttgtactataaagtagataatccgatgaatgaaacttatttacactaaacttgtcgtagcatgatttagtgttttcgtgctaatcttttatgtttcgcgcactggaagctggaaatttggtcttgtattgtatggtctccatcaaaagaggcaaaaaaaagactaagctactaatccacttgcttgattctatggaaaagatagggcactttattcttgaaaaacaatatatatgtaaagagggaaaagggagctatattactttgatgatttgaccaaggaaggctatgtgactaactggctcgagattgagtcaaagtagtgatcatctaaagcattgaaactttacatgatttgatagtatttcggactggtatatgtataagacaaagaacagaaaagctgaaatgtaacctgatgaatagggcttaagggcctgtttcaaatcagagatcggttaattaattagttacttctcgatttctgttatcacattttttaaactacaaacgatatgtttcgtacgaaaactttttatatagaatgtgcttatgcaatcaaataaatttattttttaaaatttttaataattaatacttaattatatatacaatgcggctaatcagcggtttccaacctctgtttagaacggcccgaagaagtatacaaatggaatggcttaatttacaagttgcctagttccggcaatatcaaccttttgcatactactcctgaaaaatgtatttaataacacagcatgagttaatttaattctcctgaaaatgtatgcaggcgaagttcaaggtgaggtcgatcgtgacgatggtcctcttcttctgcctgacgacgccggtggggatcgccgtcggcgtgggcatctcgtcggtgtacaacgagagcagcccgacggcgctggtggtggagggcatcctcaactccgtcgcggcggggatcctcatctacatggccctcgtcgacctcctcgccgaggacttcatgaaccccagggtgcagagcaaaggcaagctccagctcggcatcaacctcgccatgctcgccggcgccggcctcatgtccatgctcgccaaatgggcctagacaagcgtcactcagggactaatgtagaggaaattaaattataggtcgagaagaaaaaatggaagtgaatgtactcgccgtcgcaattttgtagtatttgtagcattctaattgaacttatatattgttaatgtgtagaggtgtgtgtagttttttttttctttttttgttgttgtgtgactaaaactgggggtactgattgtgatcgagggtgcacctgcctacctttgtgggtttgaaacgagatagcagactctgttgaatctggaactctgaaagtctgaagaatgtgtgcatggttatcaagcaatgtcgacattgtgtcgccatgctttgcagtccacgagatccgcgcctgctgaatctgatggagatgtatatcttttgacccgtccaggaagcaacagaaagatggaagatcctgcaacaggacagtgatgagaaattcatggacgacatggctgctaagattcagagcttgactctgaccaaaggagatgtgtaagattcagagtgcagagccttgttgggccttctgttctggactttgttttcgtatctgggctgagttgatgtagcagtgttggcctgttggggtttgctaatgagcccattaaggtattgtttggatgggcctgaataacagcccatccacgtgggattgtttggaatttcagttcaatatccattttgagcatggatcccaaggagaatctcataaccggtaaatcaactgatgacatgccgaaaatccgttgtaaataaacatggaacctattcccacaatgaaatcttgtttgttttccccttcgggattgctaaaactatgggcatgtccactttgatgtaaaaaaatccttaccaaattttgacaacttatcaaaattttggcaggatctcctatatagttaccaaaatttggtagcaaactaaatgtagccacttttttggcaactttactaaaatttggtaaggttgaaaatgacatcaaagtggacaagccctaaaatttgattcacttatttttcacttaatttgagtcctttttttctatgtgattttctcttctacataataagtatatgtctatattttctatgtactcttttaagtacataataaattatttttaatcctattctttttactctatgtattagaaaattacaatgtaaaaattgaaacttgtaatgtaagtttttaaatttacaatatagttaatgtaagtgtaggtaatttatggagttaaaaaatataattgttttggtgaaaaatatatgttataaatatagcacctttttaccctttccctttgtactctatgtgtttgcattaatcgtgtgtcatgcatttgtcatatgacttgtacttttctaatatgtgtctttgctgtgtcatgtacttgtcatatgccttgttcttttcggggcctattattattgattattttctctatttatctaaaatatgttttactaaaaaaatcactctattatttagaccgcttataagttatttgcttggcttatttttaaaatatttaatctattcatattatcccttctttctataaagttaatatccactaaacatctaaagttcaacatgcaaacttagtatttattgacacttctaaaacatacatgcaagctgccacatcaacccattaaacacacaaaacacaacatgcaagcatatagtaattatatctataatttatttcattcttaaactaaacataaacatgctaaatcatattcataatatttcaaaccaaatcattgtatcatttctccaactaggaaggtagcccccgcgaatgcgcgggcatgtattatagtttgtgtttccaaaacataaatcggaaaggaatttcgtacagatgcacgggcatcttatttgttattaaaaaatgctaaaaggaattatacatcactatatatgtatatactgtaagagaatttagattatcctacaatagaaaaagaaatatatttaccgtaaaatagatgatagattttagtatactactaatgtgataagaatatctcttacatttaaaaaaaaaagtccctttgtcctggtaatatataaaccgatcgtttgtcaccactacttactatcattgttattgttttaagatcgagttaggtgcactttttaataaatgaaactgtattagtatcactaaaacaaatgacacattattaatatactaaaaaaattcatctacctacataacccggtgttcataacttattttcacatctatgtataaatagtctaaatataccttatatatctaccgaataatgcgataacaccgttaaaataaacatgaatgcctctttaatggatgaagtcgactgtatctgccaaccaacgctttcgtatgtaatgccttgaaacatatgggtcccgcgtcgatgtagccatacccctaaaaaccatcctagagtacaattttaacacttagttcaatatcggtacaatcacaaatgattatatggtaattatgtcactttagttacattgcctatggtggcctttcatggacaccaccttaacacaaccatgtacatgcccatgcaatatttacaatggtatagcaagtactgcaccctgcattgaaggataaagagggacataaaggaggtgataaaaatggtttttttttaagttttgagtcgatttgtggtagagaataggcaaaatgtgtatatgaagttagtaataagtacttcttaaattataatagaatacatacaatattatgtttttcaaatgagtggggttaatcattcaacagtacttaataaaaactatagctaaagagaccatgaaaatctgcaaaacaccttatcattaattatatttcgataaagatttatactttagcggtagatttgtttccatcatatgttgttttcaactatatgagactcatttactaattctaagaatgtacttattttcacaaacttatttacaccaactaattctctagagtgcacttacagttaggtttagtggtgtatagcatttgtccatcaattatacccggtatattagaatttttatcaaccataaaaaatataacataagtagttttatgcttattttattgtattattcatgttttgccaatgctacttggcaaatacgtaattctcgtgatgaattaagggttgtattgtagcaaaataactatctaaaatcttatttatttattaaaaaaatccttatatgccattgaatgttcaccagtttcctcatattccattgaaaatttgctattcccgtatatcccactaaatgatttttttttcaattcctcatatgttatccacgtcatctgactattttaggtggcattgaaagtaagaaattacccttagctttcttttcctttcttttgtcttagttttcttaccacgaattaaaaaaggtgatgcatattttgatgttattcaactgatgtcggtatcatgaagttacttacttccatggtgagactaaattaagcacttaacctttttagttgagcataactatttttgtgaacaaattaggcacacaatcagtttgctaagccgagagatttttttttctaaactgaatgcttacatccagttagatacattaaattaggactaattaaattattgttcttagtgccatttaaaaaagaatacaaactatttctttctataatctataaataaactataaaaatggaagagaaataaaactttgcatccagtcattggtaaattggttgtgtgttgaatcaataatgattgctaaagttatagtcatagttttaaatgcaacacatcctgatttgtttggtaaattggttgtgtgttgaatcaataatgattgctaaagttatagtcatagttttaactgcaacacatcctgatttgttctttacatagcaggaaagggagtccaggggcaattttgtcatttttcaaaaaaactaacactatttctactcttgggtgacgtggatggcatataggtgagcgaaaatttcgtttgatggcatatacgggaatagctaatttacgatggcatataaggaaaccggtgaacttttagtggcatataagaaatatctatctatcatgtatgcatctcactcctcaaatagcaataaaaaagttttgaaaaatttcagatacttttagaatctcaatctcacccaaaataaacttaaaaagatccacttaaaaattaaccaaatctaaattctgttattttattatcactggataaactttaatttattttctcataaatctattaattgtgcttctcacagctcaaataagaaaaattttgaaaattccaaatactttgagaatctcattctctcccaaaattaaataaacctgaatagatcgatgtacttaaaaaacaatgctaggttttgttattttgatttttacatatgtagattcaaattaacggtgtatatttgtcaagtgatatttgacaccataaaatttgatatgaaattatttgaaacattatgatctcatttgctattacatgttggcgtcatttgtcatgatatatttatcactacaataagtttacgattaagtttaactatgcatatctatatagtattatttttaataaaatcatagattaaaggttgttgaccacaaatcagtgctggcactgatgatttttccttattagtatttttttcccattctattatatacgtgtaggggtgaaaatggcgtgggtatgtcccactcacccgcccggtcacattactttcgggacaaattcaagtacctgagacttttttggcggatatgagatcgggttcgggaatatagtatccgacggatacagattatccggtaaaaaatccgggtgttacccggataattatacggatattacacgtattacgtttttgtgaggtactttttggtactatgtattggttatactatgatgtattgtaccctatttatttcctaaggtcctaatgacctaatataatcttattatatgatatatgaaattgttaaatagtgattgcctatatgatatataagattgttgcttcgacttgatatcggaataaatatccgtaaccgatagtgtacatatctattttggtatgtataagttccgtatttttgcccgacattatccgagtttctatccgtattcggcactatccgtgtccgacccgattccaattataaaatatgggttaggatgtgggaagggtgacattcgatcgaacccgacccgttttcacccctatatatgtgtgcatgtttttttttattttttggctttatctttttctcgatcgtatatggtgtaggtatttaagtttttttttcaggtgggagacgatcgtacgacgtaagcaagttatgtttttttttggatagatattagcagcatgggaattctaagagctctaatccaatgtttaaaataacggatccactaatttaatagaaaattaaaggttggatgcttttctttttttactctaaatttctaggatttctctatcattattagagcgtcacgtgacaatgtaggagcgtttacaggacatttaacagatttttagtatataatagatttctaagatttctgtaatttatgtaagagccacgtagcggtgtaaaggcgtgtgtacaaagtttaatatacttttagtatataatatatagatttggaagaaaattcattgaatatttattatacatgttaatttaactaaacatatttatatttatgaagtaatatattttatctttatattgtagaaaatcatattttaaagaccattgatttttatgaatgtatgtttttcctgtctttaatgtacatgtgtatttttttttcttcaagtgaagattaggaaagctttatcgttttgttttcacaatcatgtacgtttgtacgtatggaaagaacaacagtaacatttgcatcgtacaaatatgtacggacagtagtagcgcttgtacgttataaacacgaggtagttactacctccgttttttaatagatgactgttgacgaaaaaatcgaacacatcggcctgggagatctgcttagctcctgtgcaggtccaaatcttgatgagatgcgggcgtgccagtcagtttgatcctgcaactgacaaaatatgtaaacagcagataaaacagctgatcggctgacaagccgatggagtagttccagccgatagccgataatagccgatgccgataccagccgataacgatagagtttaagcaatcggctatacatccaatgtagattctaacactttagtaaataatgatatataggcaatcggctactgataataaaatataacaataatatagtctagtataaaccaatcggctagcattgatatgatagaataagcattgatccgaagattaaagcacacatcggctggtggtccgatgtcatgaaatccacgagattagattaaacagtgaaacctttgttgtcatcagctaaatccaacttatatgtatatgcaatccttatgagccgaacatatttttacaaatgtataaagtctagaagagggcgggggaacatacacaacgtccagataactcaccggctgaaacctcgatgaaacccttattggcagtcaaaaagcatgctagagattacggttctaagcacgacttagtagatcaaacttaactgatgcagcactaagtatgaaaagaaacacaatatccagacaatcaaaccgttgactgattttcagggtggtagatgtctaagctaatctaatctagcaacgcgatttagccgatatcggtagaaaccctaaaacgagaagcaaccgatagagctaaattgatatgctaagactagattaacagagacatatgataaatgggtaggcaaatatatcattcaaaccagagcaatccaagaggttgaatgtactgatgcagccttgaacgacgccgacgtagacgatacaattgcctgaaccgacggaacattggacttatcccttcgccggagatcgaacactgatgcagccctgcgtcaggtgccaagtcccgccggacgataaaataaagtagaaaaggtaaaaggtggcgatgcgccgaattgtattaatcgtgaggatagattacatagaccccgggtgtacatatttatacccatgggttgatacaagtccttgtcggacaagacagaaactttcctaaagataaaaggaaaagataaagtccttataggacactaaacacactttcctaaagataaaaggaaactaacaaactattcctaattaatagataacttgccatgccgtatcctatttgaacttggtctcttctggacaagcttccttaatcaattcccttaaccgaatatagcaagaatccgacaactgacatcttgacaactctcatcggctaatctcaggacttcgaagccgatgttgactctaagccgatgattactccgggcttaccaaatttcactgttaacaatgacgccgtcaactttttctcatatgcttgaccatttgtcttattaaaaaaatttacgtaattataatatattttgttatgagttgttttatcactcatattactttaagtgtaatttatatcttatgcatttgcataaaattttttaataagacgaatggtcaaacatgtgagaaaaagtcaacggcgtcatctaataaaaaatggaggaagtatttgtcaataatagatctaatctaatggtgtaaaataatgggtccaccaactttagtaaaaatcgacggtgagattagattgtgccacgtggcgacttaggagcgtttgtaggagtgccacgtggtggcttaggagcgtttgtaggaagtttaatggacttttagtatataatagaatagaatagaatagatagataatagatatctaacatatatcccgtagcaagacgcgggacatcatctagtaaattagatactccaaaccaataattctgtcaataatctatctcaaatgggacacgcttgtggctattgagtgcgatgtacatgtacgagggttggtatgcaatcgtgaactacgtatcaacattgaaaaaaaggatttcgaatgttacatgttatttggcagttttcaatgatactagtactgtacaacaatcattgatgcattacaagatgatttcagcccaaggaaaatgacacaataatgatcagttaaaacttaacatttcgtagagtgaattactggtcaatcttgcaacatcatcctttcacttcaccggagttcatcgtcttcgcgcaacacctcccatttctgcagtctttcgccgtctccggcgaagaatcggacacctccgccgctcccatgtcgcaacaggttggcctcttcacgctcgtgcagcaacgaccaacaccattggtaccgccttcaccgccgctgcagcttccctcagccggcggcgacctcttggaggcaccacatccggtgccctcgccgccatcgccaccgcaacatttggcaacgacggccgccgttgccggcttcttggacgcggcgcacctggtgccctcgccgccgccgccgcaacatttggcaacaacggccgttgcagttggcttcttggaggctccgcagccgatgccctcgccgccgcctccgctgcaacatttggcaacgacggccgccgttgccggattcttggacgcgccgcacctggtgccctcgccgccgccgccgcccccgcaacatttggcaacaacgaccgttgcagttggcttcttggaggctccgcagcggatgccctcgccgccgcctccgccgcaacatttggcaacgacggccgcctcggccggccgctcttcttgacgctcgccgtcggctcggatgtcgatgacaaccgagtgctcgggcgacatgcccggcttcggacagcaacggcagccgttcgtttgctcacggccggcggcgccagcgtctgcggcgttgggtgcttgggagtcggcggcgagctgggacctcatcaccagcgacctcgccgtggcgcggcacgcgccgtcctccttggcgccgcccttccactcctccctgagcagcgtcatgctgttgagcacgacgaggaggcacgtcccgacgtcggcgagcacggcggcccagagcacggggcgccacgccgcggccagcgcgagcacggcggccttcacggccaccgagccggccacgttgacggcgatggtccggcgggcgcaccggccgagcctgacggcctcggggaccctgagcacgtcgctcgacatgagcgtcgcgtggctggtctccatcgccgccgccgacccggagatgcccatggacacgcccacgtccgccgccgccagcgccgccgcgtcgttcatcccgtccccgaccatcatcgtcgggccgaacctcgccttgaggccgctgacgagccggaccttgtcctccgggaggagctcggagtggagctcctccatgacgccgccgagctggccctgcgcgtgcgtcgccgccgcgctgctgtccccggtcagcataaccgacttgatgcccagcgatccaagctcccggatcgcctccgccgcgccggtccggcagtcgtcggagagcgagaagacgccggcgagctcgccgtcgcagatcacgtagccgatcgacacgcccttgatcatctcacccatttcttgagctgtaaacgtcacagatttcagttcagtcagctcagcttcagctgatcagctaattctgaagcttaattgtcaggaactgtactactactacaaatgatgtgttttgctcacttgactgaggtgatgacgctcttgccaatgtccttctgttcccaatgtagatgtgctttccatggatctctccatagatcccctccccgggatatatccgaaaatcgcccacattttccgggtttggttggatggatttggattgagcatactccacaagtgcagctgccattgggtggcttgacttgctctcaatgcttgcaatcctgcaataaccaaagacataatttgtgccaagcatttcactgttcaagtcaattcaaaccatcacaagtactaaggatttttcgacaagtcgtaaaccgacaacagttgaaaatctgtcaaatttgttcagtgtagcagctgcattccaagagctgaaatgaaatcttctttctcagtcttaccagtaaagaagatgatccatctcaaccttgtgatccccaaccagatggaacgagtcgatgctgaactctcctctggtgatcgtcccggtcttgtcgaacgcgacggccctgatctccccaagtgattcaagaacatctccacccttgatgaagatccccatcctcgcagcgcgcagcattgcgcagaaggatgccaccggtgtcgacagcactaatgcgcaggggcacgcgctcacaagcatcaccagagccagcttccaccattgctcaaggccatctgctccgagcagagccgggatcagggccactcctgctgcaacaaccaccacggctgcaacgcaccaagaacagaaatgtctttgttactgatgaattttgtgttgtaaaattggagatgttgagagtttaggcgatgccgattgcgcacccggcgtgtagtactttgcgcacgaatcgatcagccgctgcgtcttcgacctgctgttctgcgccgcctccaccagcctctccatcttcgccaccgtcgagttctcggcgagagccgtagttctcacagcaatgtaacctgaaacgtgacagcctctcaatcccattgatcatgacatgaacaaatgtgtgctattgtgactattgagttggatgcgtcaatcagtttaccagaacttaagctgatgagaaaagacggacaattcaacgacacggacgtttcagagttccgtacatttgggaactctgaaactaagagatgagagatttttttgattgtttgtttgtttaccgtcaaagttcattgtgccggcccagacctcggagtgcggctgcttcggcaccgggaaggactcgccggtgaggctcctctcgtcgacctcgctctggccgtcgaccaccacgccgtcgacggggacgatctcgccggccctgaccgcgacgacgtcgcccacgcggacgtcgcgcacgctgacaacctcgcccgtcgtcgcgatgaccgccttcaccggcagcatgcccatcaacgacgacatcccggcgctcgcctgcacacctcgcaacgtgagtgttcgtccgggttcgtgccaagatcgccatggatttggtgaagaggacattgacatgtactcctacctttgtgcaggccagcgtctcgagccattctgcggtggtgaagaggaagacgatggcgccggcctccgtgtagtcgccgaggcagagcgcgccggcgacggcgatgagcatgaggacgttgatgtcgagcgacagccggctcgccgcggcgaacccacggcgcaccatcggcggcgcgccggcgacgacggccgccacggccaggcactgcaggggagggaagagccactcgaagaaggacgccgtgaggaggacgccggaggcgacgatgtacgggctcggccaccggctgaccacgccgctgctgccgtaggctcgcaccgacgcctcgaggccggccttgttcagcgccttcactgcactccaagacaaagacgacgacgacgactcgattcagtgagaatctcgcgcgagaatcgcgtggaggattaatggcgcgcgcgcgcgcggtggcttaccgatggcggactccggggcggcggcggggtcgtgctcgacgacgacggtgcgggacgccacgacgacggacaccacgcggacgccgtcgagcggcgcgagcagccgctccaccagcgcgacctccgcggagcagcacacgccaaggacatcaaggtacgtcttcttccgcttcctcccgccgccgccgccgtcgccgccgccacacctcgtcggctcctccgccgccgcctcaggcggcagcagcagcagcctcgcctcgagcccttccgcctcatcctttccggccatcgccgtcgtctcgtccaccgcgcctccggggcgatgcaagtggggatcaaggagagggcgatctggagatgacgaggacggcggcggcggtggtgtcgtcggcgacagcgacggcggcgccaaaagatttgggatttttgtaatcgatggacagctaatccggcaatggttgtgtatggcagtgagggactttcctctaatccgacaaggtgggcccacctggcagtgagtggggagctagtcgtcttgatttaattgatgcttaatcactcatcttaatcagcaacctagcagtaggggaccagtttggattatttattaattcctcatctaaggtagtagttgtttttgctctgatagtggctataataatagtattgttgctccaaattgcatttgtttgaagttaggttcgtcaaaaacaactgcaaatggttggcgtactgaaatttggtcacctgaattggcaacaaacgggtcggatcatgaattccaaagttcataccaaaccaaatgttccctaaaattcggctgagtttagttccaaacttttttcaacaaacttccaacttttttatcacatcaaaactttcctaaacacacaaacttttaacttttctgtcacattgttccaatttcaaccaaacttctaattttaacgtgaactaaacacacccttcatatatgctgcttaaagttcatgagtaaaatagtaagcttttacaaaattggaatgtatcatgaatgcacaaactttacaccaattaacagatatcaataaaaattatatttgtttttacaagtaacatgcatctaagtctcatcttgaaatttatcgtaatagaaagaaaaaagataaaattatgatagatttatactcttaaaattgttaaatttaaatttgaggttttacacgcgtataatattatctccatcccaaaataattttaattctaggttgtttaatatatattaaggtttaataatatatataggtaggactgggaggatgaatgatggtaaaatagtgaaaattttgaatgagagtgattgatgggataattactactctattgtaataactattttagaattaatttgaatcttacagttataattattatgggacggatgtaacaataatatttactttttttcatagaattttttatgggtgtaacaggggagtgctctctctgctgttgacagctcaacccccatgctatttacatgttatttttcgaagagtggatattaaaatttccattttcacatgtcttttctgttggctgtttgcttaaaatatgactaaactgcattttagaaaaatctaactatgatttttcagccattcatgtcgcaatgctaagggtacactccacaccataaaacgggttaaacaattatgaaacttggctcaccggatggccactttgtcctctaaaatattcccatattatccgtaacgaaagcaaaacgagaaacagatggaggccaaagggtagaatatgacaagcatctctgaccgtatgaaagcgattgcaaataacaaatgccaacctacagcagtaaaattataaatgccattttaaagtttaaaccatggagggattcagttttgacttgcatgcctactgaacttgagatacaaatatgcattttgtgtgtgtgtgtgaacttgcaggtaaaacacgtgaagcaagcattgacttagaggttgttcagattaactatatcaatttgtaataaagttaccaaaaatatgcaactatttattttttttaccaaactttggtaaacacgtaagaaatcctgccaaaacttagtaatattatcaaacttttggtaatgacaaaatttggtaaactttattttggctataatctaaacagccctttattaagcttaatacctaatgataaactattcgcaatctgcaagagagtagaccataccacgtatctacagctgccactagtcatcttatggataaaatttaattgatttcgcaaataacacaaattgatgaaagattattgttcatgcatgtcagcatgtgggttcgcatgtccacggctctattcttttatgctgaatgaccgaatagtcgaatgatttattataattatttgaggatataaatgaattaaacgttatgaagatagaaaatagatttaaaacaatattcttagaaattaatgtatagaaagttttttaaacactgtttataaattcagggagcgtacgaattaatccattatttcattatttgaaaaaaaggggataaatttgcacaatctagcaacatgcgctaaaggtacccccgacaaattgggtcatttggtcattttattttggtgggatatgcaaaaatactattcctatgtacacattccgtctctagatatttgacgcagttgacttttttaaacatgtttgaccgttcgtcttatcaaaagaattaagtaattactaattcttttcctatcatttgattcattgttaaatattatactactactactcaagtttttgaataatattcacataagtttttttgaataagatgaacggtcaaacatgtttaaaaaagtcaacgacgtcaaatatttaagaatggagggagtatcattttaagctatacgtagagacaactcaacttaatttaaatattttattgccataagataaactatatttaagataaactatattttccttgaccatcgtaatttttttaaagttcttacagcatcactaatggtcctcctatttcatctccaaaaccaattttcaggtattttagtgaaaaaaaaagcactccaacagatcccctactcccctacatgatttttggagttatgttgatatgtcagagaaaacggcgcccttgcccactcccaatatcgtcgctcccaccttgtacttcctcctctccttcccacgtgtgggcgaacggcatggctttaggggggagcgcttttcccgcacgtgggagatcggcgcggctttaggcaatcaccaatgtagtgcttcggtccgtctccctagcgctgtccattaggcttttcgtctgcgtcgtcccctgggatgaaacgcgcgccctagctgggggacgcgtcgctcgctcgctttttccagggggacggggcgaagaaacccattgcgtaggtaggttcttgaggcgacgcaccccagagctttgatttcctcttccacccttctcccctatgtcaccggcccgcgcgtcaagggcgaggcgaaggtgccgcttgccgccggagagaagaagggagggcgaggagcgaggtggcgagcgcggtgaagaaggcgacggcgccatcatcgatgcagccaccgctgatgccaccaccgtctgctcgatgcggctgctcgctgtcagagagaagaagggagggtgaggagggggcggcgtcggcgagtgcggtgaagaatgacggtgccatcgtcgatgcggccaccaccggcaccaccaccgtctcgatgcggcgcggccggcgccactccatccgccggggggccagatccggccacggcggcgccggatctgccgcctccggggtcgccgccgccaccttccacgggagagagagagagggagagagcggccagatctgccgcctccggccaccggacgatgacgactgccacctccgccccgtgcgccgctcgccgtcggtcgcctccgccccggatctgctgctccagctaccagacgatgacgatgatgactgccgcctccgtcccatgagctcgattcgggggcggcggcgggagacggtggtggtagtgagagagagagagagagagaaagggagagggagacgagcggaggtggcaggcggcggcgggagcagcggcgggagagagggaagcaggctgtgagtggaacaacgggtggagggagagaggaatgcgcatgcggtcgtgcggagggagagagagagagggaagagaggggtagaataggaaagagaggaggatgagagaaatgggctattttgggttgggacactcattgggctaccagacatggcctgcattgtagatgtgagtacacctagagtaccctcagttagtgattgtagatgcccttagggggagtgctaggaggtagtgcgctgacggaggaaaacggaaatcatgttggtagtttaacataatggtccacttttaatttttgaggataaaatttaggcttttaataagttattttgcttcatattttcagtttagaaaaccaaaacaaatttttgggaaagattatacgttcagttactttgcttcatattttcagtttaggaaaccaaaaacatttttttgggaaagattatatgtattcgcttgacgcttgctgatgcatatgttgatgacatttttatttttttttattaaacatctttggacttataactgtcatattgggtctgttgttacgaacttactattaagctagcctgtttccctctgcaacgtggcgcacatccatatgttgaaaaatccgagtgagatgaatgaaaaaatcattcgaatgattgctaggcactcccattcatttttcatccatcccacacatactaatactaatatataatacaaaactaaaaagactatacccctactttatcaaatgctaatgtaactattcttcaatttaactactctcgatacaattatatttcaatacaattatattcccaacgttcataaactccgatataatattgctctaaaaatgaacttataacaaatggaaaagctaaaagtgaacttattatgagattatcaggagggagtatcagattgggaatagcattcccgtgatcttgataattgcttctgctctgaaaacgagcatatccctgcctgcagattccctccaaaaactagaaaccctgaatccctccctgatgcaccacagagtagacgaaccaaggaccaaatatcccagcagacaggactgttccacagtacacaccgagacaaaccacagtatatatgcacagtgacagacagaaacttgtagagagaaatcaatgtcatgcagcaagggaaggacataccaaattagaaacaaggcatgaacaaatttcctctaaaggctacaatgtaacagtatccatatctcaaatgaacaaccacaacagtaaccgaccagtttatgaaacaaactatcctgtaaagtttcttcttttttgttttccagcatctaccacaacagtgcgcaatgttctagagcaaattcttcacatctgccgccaacttgggactggaagagggatggcaagtatcatttgattgatcagcttagtcagcagtagagagccacagcagcagctccatggtttttattgcctactcttcttggagctgctgcaatcagggcacttgtagtgctttatgtgttccgctttcgctggtgttatcctaacgcatttgccgtggaaccaccgctcgcaaatgtcgcacccaatccaaaactcgttggcgttgtagcggccaccgcaggttccacatagggtttcactgtgttcttcttcatcgtacccatcgtcaacaactgctggcctcgaggtttttgtctgcacgtcatttgctcgctgcataacaaagccagctttcagttcgtaaaaactcaaatgggcacagttcagaaatggttcatgatgaaaataaaaactaagagcactggtacggcacctttcctgagtgcctggatttgctgccattgtcggcaccagatttattatcccttccatgcttcctatcagacagtgcttcaagcacggttggatggtcattgatcaagctgaataagcgcttcctgacaatcaagagagcaacacattggatccaggaaaaggattttgttaaccatgatatgatactttgggttcttaacagagataatggttgatgcaaagggatgttcaaatcagaatatgaatccaagacaccaatacacatggcacaagttttatgtttcaacaggttagccctgggcaggatagacaaaaatatggaaacaagatatccatgaagtaatgcaacaaataaaatagaatttgtacataaagaaagaaaacacttgtgaggcatgacccaatatttccttgggagttaaaaaataatccagcgtacaatatgaatccttcgaaagacaacagataagcaacgaaacactataaacaaacatgaaagcaacataaacaaacagataaggaacagataatgcttcccattacataatgataatacaaattttgtgactgatttagctccttgtgcaacacaaacgaagcacatgaaagaacagatggcagcacttcacagtttagcactctactgccctgatacagtaacagatagtaagatgaaacagaagaaaaataaattcaaatagaagtggaaagtgtgcaggaaaatagatactagagtacaatgaaagcaggcagaattactatgccaaaatgatagaaacttaagctcacaaagcgtcaaagcctcatctcagggagaaaagagaagagaaaaatggctggaatagaaatgcaaagttcaaccaggaaactagcaagattaactgaaccaaaaaaaaaatcaaactgaaaaacagaataaacaagataacttttgctaagaaaaaaattgcaatatcacagaattacgacttatggtttgcatggcagtcaagtactcaagtagaccaaagcaaaaaacacaaaacttcctgcataaaacattaaaaaaggaccagaggccaattaatgattcaacctaacagtactaataatttaggcacataaaacttcatctaccctttggttatccatcaaaagactccatatgacacattgcattttaggaattaaaatgtagcgagaaaaatattcaacgagtatttgcagaacttgaaaattaaggacacaaagcaaattgtaatcccaaagtttcttaaggaagaacgaaggaacagagcaaacacaactgaagctcaatagaaagaaagaattcaatttatggcatgttaagttgaataagaatggtacttgcccatttgattgtttattagttgtatcctaatttgcgaacacttttactgccatggtccataaaataggtactcttgaaaaacatgaattaaggtatccaaaacccaaatgactaaaaagcattatgatgaaaggtcatccatatagcacaacactcgaattgtaacacgaaacaaaaatttgtgcagacactgagacctttcaaagtttcaatgtactgtgaagtacacagagcctatcaccgtcagccccccaacttctgacaaggatgtgaaaactgaaaagaaatctgtcaaaacatgttccaagtgaaagatcaaattttcagacagcccgggaacttatttcaaaggcaattactactggtaggagtaataatcatcaccaagtacacacagcactgttttgcaattttatggcaaaaaataaaatcaattcagcaaacgaagaaaagaaagagagaaaataaagcaaacacagtgagaaacatggcccccattcacagcaaagagaaaaaagaatggtgaaataaagcacaataaacatgtgcaacacagcacaagcgcacacatggaccagttgagctgaaataaaatatgcaaatccataaacccccacggggcaagcacaagaacggcattacactgcacccacaacccacaaggcaagaacagagttcgattgcacttgcacccatcgaattatacgctccaagtaagtgatcttttcttcttcatagatggtcaattttcacgagatctaatggaggaaaagcgtgtggctggtacctctcgttgccgttgaggcgcgcgccgaagaagaaggcgacggagagcagccacgagtcggagtggacggcgacgagcgagagccagtcgcggcggtgcatcccgtccctggcgaagttgatcccgagcgccggctccggcagctccggcggcacctcctccgccggcagcgccacctcccaccgcccgttcgggtgcccgtacaggcacaaattctccttctctgctcacatccccaaaaccccaaatcaaaccccacacacaaaaccaccacccgaactctctctaccctcatcagatccgatccggttcggtcttacctgggtcgcagaatccgtagaactcatccacatctgcgcggcacaaacaaaaaccccccgcacgggcggcgagctcgttagatccagaagaggagacaaccgaagagagatagagagagaggcgggcgaggtgttcgtcgttattacttaccgacggtgagggcgcggacgaggccggcgcggcggccggagaagtccttgaagatgtcctcgacggtgcgcggcgcgggggagacgggggcggccatctccatcggcgtcggcggcggcgaggtcagcggctgtgtcggcggcggcggcggcggcgatgggagagagggggttcggagcggctctgacacaagccgagatttaaggctgcgggttacccgtccacgggtgcagtggaccgacagttgggtggggcccagctatcagtgacgtggggcactgaatcacgtggaagacagggtctaggaacgtagtcggggtgggggctgcgtggtggatggggccgtgggaggctgacctggcaattggagatcttctgcgcatgggtcatgtctctgtctcctgcgagctggttagtattttttggagaaatttagaatcggaattattaaaaaactgtcacaagttttttgataaaaaaaacctttcaaatataaatatagtaatagttatagtgtaactacaatgcaattatatagtatagttatattataactaccacgtaactacactataactatattgttatctttatataagttagatataaagttgtatatattattataacacttatatataagtcatattacaattatagtggaattatattacaattatactataatactatagttagattgaaaaggtttttccttaaaaaaacttgcagcagtttttttaagataatcctatttagaattacgccacataaaaaatggcaaaatttgctacggggcatccaaaaaaaacttgtaattagctagtggacaccggaaaaacacgaatttgctgtcaggcacgaaaaaaaactggtaattagctatcggacactcgcggccttattttattattttcggagaaaatggagagagaaacaatcgaaaaagactagattgccctatgtggtcaaggatgtcagcctctcccctattttcttttcttgtcctcttccagcctgtgcttcctcaccgcgccgcacgccagcgagtgcagcgcctgtcgccgccgccgtttagattacatgtccaaggagatgtgccgcaactgaaggagatatgcagcagccttgccacgtccaaggagctcgtcaaggctcttgtcggcatctggggccctgacgatggcctaaacccgtcgacggcgtcgctgctctccgcgctgtgcgccgagctcgacctggcacgcgctcacgtacggcacctcgccacggaggaccggcggcacggcgacgagacggcacggatgaggacgcagctcgtcgagaaggcgcgggagtggaggagccagcagagggagaaggtcgcggcgatggtgcgcgtggcggcggcggagctcgacggtgagcagaggtcgaggcgacgcgccgagagggtgaacgccaagctcgggaaggcgctggccgacgcggagagggagctggcggcgtcccggagggagctggagagggagaggaggtcgagggagcggctggagaaggtctgcgacaagctcgtcaggggcggcctcgcctgcggcgtggacgacgtcaggggaggcgaggaggaggtgaggcgggaggcccagaggggcgcaggaggagctggagaaagagagggagatgccgcacctcgccgacgagctccgcaggccttccggtgcgccgccaccaaggccttcccacccgcggcgccgctcaccgccacaccatcctcgcgctcacggcctcggtgctgccacctccgccgccacggagggactgccgaccagcttcggtgagggcggcgatggattgtgacgaccagcttcagcgaagtagcacaggggcagaatcgtactctcacctcagtttctctctccgttttccccgaaaataataaaataaggccataagtgtccgagagctaattaccagttttttttgcccgacagcaatttcgtgtttttgtggtgtccaccagctaattacagggttttttggatgccctgtggcaaattttgcctagaaaaattgagtttcacgtaaatatcattccataaatagagttggataaaatgttagtattaacaacctaaacggctagacatctacgctagaaagccatttctttccaattaaaatggtttttcaactaggtctaagctccccggcagagcttgagtatgagcttcgggagggaggcatgagctcgccatgggcttatatcattgtcatcaaggtcaaaacatgtggaaatcttgtgaggatgccacataaacgtgggccgtcccattcctattgccccttcatcatggtcaatttttttatgggacctccaagcagatcattttctaggtttgtgacgcaatgacatcaactgagaccgcaagaccttgtacgtagtgaagctaggaaccgcgtacctctgccttgtaccaacaagctcatcggacgtgaccgttgatcacattctccttcagcttcaccaccaccgtaccggtaaccccaacaaccttaatgctgacactacttaatttgtagtcgcaaaccctaaccctagctccttatcagacttgtcatctgatgattttaagcctcatatggaagaagccgaggagtgacggattgacaagctcaacctactgcaggatgatgtgctcgtctacattctgcacgagctagttgctgagtggtggcggcgactcagcattggcgctgctacgtggcgtcaatagtctagcttatttctcggccacaatgagagtaaacaatagatagggagagaggggcacttttgtcagttctcatgtaaaaaaaaagcaaaatcattttattaatttgtatgaaatggtggaatggtggtgaaatcaccctgttcacaacattttatccaatcctatttgcaggatggcattttggcaaagcctattttttacgttggcataatctcaattttcttatttttggagatcagttcttctatgtattttgatctccgggggattctttgtctatttatggtttacttttatccttcaaatcaaatctttataattaagattttatttcacatctacaacttacttttaactttagtgccatggccacggtacgctcaaagttattttaggagcctaaaatttataaaatttccttcattcgtttaaagaatttggccacccaaatggttatgcattacaattgcagtgaaaagtattgataaccaataggaattcgcttttggcggctagcttttatgggttttggttgtgcttgtaggagcacgtcctttgtcataatgataaggtgtctttgaggcactaacatatatgagcaggtatcaccttccgttatactttccccgttctaaaatataagggattttgattggaggtaacaattcctagtactacgaatctggatatgcgtcatgtctagatttgtaatactagaatatgtcacatccgaccaaaatttgttatatttgggacggaaggagtactccctctctaggtgtccctctctagtcgggggctctatgcgtaggctttgccactaaacaaaggagagacatatgcacccatctattgctagggcctctatattcctggctatgccattcgatgaaagagaggcatgtgggaacctagaaggacaatagggggcaattcagtggagaggagccggaaagagctgtagaatgcgtttaggaatcacctaaatggtaggaggctggcactcattgttttgtcaataaatattagtaacaaatgatgaaatataaattaattgttctagagtaactttgatttttttaacgtgcaaaaagcttgcgtgtcgacatattagaaggaagcaaatactccctctgtttcaaaatgtttgacaccgttaactttttagtacgtgtttgacgattcgtcttattcaaaaaatttaagtaattatttattcttttcatatcatttgattcattgttaaatatatactttcatgtaccattttttttaacaagacgaatggtcaaatatgtgctaaaaagtcaacggtgtcaaacattttgaaacagagggagtactagtttacaaccagccagctgccggctaaaaaaaaaaagaggaacgaatacacacggtgcgtggctgcgtgcgaagacgaagagagctactgaggaaaaacacaaactccagggaagctaacgaggaagcaagcaactcaagcaacattagcctgggtggcctaggtccagcaggcagcagggtgctaaaatggtgggcccctgagagcaattttgatctgaggaataaggatccataatggtgtttttctatgcaaatttttgttccttttgactggatcactgctacaaattaattgacactaaaatgactcttcaaataaggcatacacgtatggccattagggttcaatctctggttttcggcatatgtattgtgggtgccgatatcgtgaaatttcaaaaattttgatcagaaattgtttgattttttataaaaaaattagttaaatttgaataaatatcgccaaattaaaaaaaatatttttttgtccattataatatcatatcagggatccaatagaccgaaatttcgtttcggaattttgaaccctcagattcaccatgagctactaaattctttagtgaactgtcgtaggctcgtagctgtccgttatatccagaacgctcgtatgggagttcatctcatacttggagaatttgtagcagccagcgagccggcgatcagtggcggtgagctcgccgtcgccgtcgtacgccacctgcaacgtggtcaggcgtaggattgcaaattccagaacaaaattttagaaatttcggtcatttcggatccctccgttacgatattattttggccatattttttttgtttgaattttggtaatattatttcaaattcaactaaattttgttttaaatttcagcatttttgtgagcaccgatcaaatcggctaaaccgatatgtttaaccctggtcaggtggagcacgcacttgtccccgtcgcacaggcacttttcctcgtcgtcgccctcggggcgcagccacgcaacgaggcagtactcgcttacccatgtacacgagctcggcctcttcgtgcacccagcctgcagggacctggacgaacaccttatccttcccgaccttcacctctggcgccggctcgccgctcgcttcggcggaggcggacacgacgtggcaggcgcagaggcgcccgtcggtgcgtagcctgttggtgtcggagtagtgtggaggccgacccacgagccgagctcgccgtcgtagtggccgtggcctctgaacggcagcagccagtcgccgcggcgcgtccagcagacgtcgctgtccttgctgtagaagaaggtgacctcgacgtcgacgccgcccgaccgaaactggttcatcgcggagaggaagaagctaggcgcgtcccccggggtgcacgtacggcgtgcttttctcgcacgggactccatgacatctgcgtgttcggctctgagctccgccaacaccatgggtcgacggcgtcgccgccgtcgtagagatgtcctgttgtacgcgttcttccggtcatcgatcgccaggtacaggtgcttcttcgccgcgatctcgccggcggcgccgtttgtggcatccgaggagttgcctgatcgtgggcctatgatcaggtggcggggacgaagaaatgctgggacgtcggtggcgtcgtggcggcggacggggcgccggagatgggagaggagagggctgcgcaggccggcgaaggatcggccgcgacattgtccgcgaccgcgccggcgcttagggttacgtacaccatgcgtgacaccattcgatctcatggctatgtttttgtggcctcctctatgattgatgggctttggtctacctctcggcctttccctctggcccaagatggcccagcccaattgttgttattagttactaaatggcaaattcacgtacggagtaatatttttatgtcgcaaaatctaaatcgagagcactctcgatttagtcataacgagtgacccctatttagatatgtgctaacttgaagaatcttactttactatagcactaatccatgaagtaagttgagaaaatattcctatcatctaagcttcaaataaaattttctcttaaattactcatccgattacaccattatgttcgtaataattaaaatctttacaacaagatctcacatgattatattttgatgaaaaatcacaaattaattttatgatttgtctaaattacatttagatttcactaagttacttcttagaaatataaaagtaaattcagtaaagcctaaacgtaatttacatatattatagaactaacttataacaaaaagaaagtaactttaattaattccttttttcattgaacaaattatcatatatataattatcatatatataggttacttttgattaaaatacttcctatatattcataatgctctgaggtgattacttttattattgtttttagttaattccataatttgtgctgattaattcaatttctagatagagtcatgtttttatctctccaacagatttactttaaatgacatggcaaagttaccttcgttttgttctaagttacttatataatatatgtaaattacttttaggctttactgaatttacttttatatatctaagaagtaacttagtaaaatctaaaagtaatttagacatattataaaagtaatttatgatttttcatcaaaatataatcatgtaagatcttgttgtaaagatttaattgttacaaacacaacggtgtagtcggatcgtagatcggatgagtagtttaagagaaaattgtatttgaagtacatgtggatggtgtctctatagatagagtggtagctggtttagacaaacttagtggtagctgtgtagttacgtcctttatatgtacgtatcaaaatttaaattattattggtagagtcatataacaacgacttcgccaagaattgaactcttaccggtagagtcatatatcaacgacttccccaaattttattggttaacatcatcttctttgcccaaattgacgcaaaagaaaaatcgaactaatgc

SEQ ID NO: 938 - DNA, 696 bp, Oryza sativa
  unsure (1)..(696): unsure at all n locations
gtacagnagttcatcagaacagaaatgtctttgttactgatgaatcttgggttgaaaaattggagatgttgagaggttacgcgatgccgattgcgcaccccgcgtgtaagagtttgcgcacgaatcgatcagccgctgcgtcttcaacctgctgatctgcgccgcctacaccaggctttacatattcgccaccgtcgagttctccgcgagagccgtagttctcacagcaatgtaacctgaaacgtgacaggctctcaatcccattgatcatgacatgaacaaatgtgtgctattgtgactattgagttggatgcgttaatcaggttaccagaacttaagctgatgagagaagacggacaattcaacgacacggacggttcagagttccgtacatttgggaactctgaaactaagagatgagagatttttttgattgactgattgattaccgtgcaagttcattgtgccggtccagacctaggagtgcggctgattcagcaccgggaaagactcgccagagaggctcctataggctacctcgatccgggccgtcaatcaccacgccggagacggtgacgatctcgacggacctgaccgcgacgacgtacaccacgcggacgtngagcacgctgacaacctctgccgatgtcgagatgaacgacttcaccagctgtatgcccatcaacgacgacatcc

SEQ ID NO: 939 - DNA, 6477 bp, Oryza sativa
cataggtactataattaattaatttacatcatgcatagttgctctattctaattaaggcttttcttttggataaatggtctttaaaggaaattcatatgattttccccatattttttattttatggaacaaaggagtaggggttctagaatcatgtgaaattccttaggaatggcttaacacatggtgattttggaggaaaattaatctgatgtccaatctcattcgtttttcctgtcgtctatcaagttggtgattatttccgtatgtttttttcaatgttttctgatcttctattttgcacatcagcacatgcgttggtataaaaaaaaagtcctacataattgtttcttattcctgtattctaccgttcttgctttcggaaaaactctataaatagtcgaagaaaattcgacgtcaatgtatttcgttcagctattataacatggaagtgtttctaataaaaatggatcggagaagttcgtcttaatgattgttcatgcttgcggcactagctaagccatggagaaattgttggacagtttatgaatcatctgtgcgtgctagctagctatacatatgtaacggcaaaatagttactccttttttcatcctaaaatatcataaattttaatcgaatgtgacacatcttaatactatgaatcttaatagggagtctgtctagatttatagtactagatgtatcatacacatcggatcaaaatctatattttaggatggatgaagtaactaagataaatagcattctcagaaggcatgaacaaaccatgaatatcttgccttttctttatccctagaggttgtatttttttccttctatatttaatgaaaaagcacactctcgtgctggttccattcaaaaaaaaaacatgaatgaatagtttgcatccgatccgttacactttttttttcaagtacctgcagtagacgactagacattcatgtcaagatatatatttttttcgtgcaagtttatatagagcttgattataggctggcttaaccggtcgatagtcacgcgtcattttgatgccggctgcagcctgcaaacgaacgaaagcaaagttacaaagacatgcgcagctttcctgaagattgcatccaacggtttccccgaaatctacgacttaaagtttagtaactgcaatatcattgtgagggtaattatgaacttctgtaaggccctgcttaatttgagatttcttctaaaaatctaaagcccgaccaggacaatgatcttacactaaaacaagattactattaggaaaaaagttgtcatgcatgtataaacagctagctagcagcacaacatgtatatatgtacaaaggaaaatgcatgctttagtgtgtgagctcgcaaaccttacagtatgagtttagtgtttctttcagataacttcacacgtagttaattatcgatacccgcccacccctaatttattgacaatatattgcatgctagcgcatcgcataaatatccttatcaatgtactgctaatggctggacttgtacgttaatccaacccttcccatcggcatcatcaacgcagaaactactgttaagtaacttaagtttgccaagctcaagcttaaaaatcctggtgcatgcatgtagctaggagtatagcccttttctgactttctgtgtgcgggaagcaaaaatacacctgcgtgtccatgtaggcatgtagctctccctgtatagtacatctctctctgtctgtctctgtctctgtatgtggacttgtggagcgaccaagatcatatgcaccatgcgtaggagtatggctgcatgcacagtgcgcgctagctgcagcacactgccgcattctgatcgatcagggtgctagtatatagctagtcttttgagctttgaccaagacgtcaagctgtgcgtgtgtccggccgggcgaccgaccagcggcatgcagatgcagtgcagcaaagctaagctaggatcgatcgatgccaagtgaagtccatagacttcacgtggggggggggggggggggatcggatcatgcaagaccgtggccacgggagactacacacgcagtcacacggccacccaggccagctgccgcctgccggccggccatgccagccgcgcgatcgacgtgccactgaacgcggcagcggaatgtgtgcgagatcgacacagtagtggtacagtgtgcgtgtgcgtgtgtgatggatgtgtcgacgcgaaatgggatggctagctcgacctcgcatgcatgcttgcttcacgcaatcttctagtagccctttttaagagagcgaaagagctagcagaaagatcacaaggggaagagaaaggaagggccagcgagggccgggtgtggttgtacaaccagcaagctaggctcttcttccatgccgtggctttaaagtctcatcaataccacgagaacaaaacaacacatagtagtagcagtacgacaagcatgttgcagtagtatagtgtagccaaagtacaggtgcaagagaagaggagaatactgtcaggaggggagaaaaaaaggttcaaggagaaggaaacagggaaaaaaaagagagcaaaaaatccagagatggaatggaactgaaacttaacccctgtgcctatgaccttccaccaataggacaagcaccaaaaggagagagatcggggaggcgacttcagtttccatattacgcatatgcccttccctcctccacttctaccactgccataataataccatcaccattcctcctcctcttcttctcttgctctcctctctcgtgctccatcgatcgatcgatctctaccaacacaactacacacttgtttacctagctagatcatctcatcaggtataagagctctcgagatcgatcgagcaatgagctcgggaggcggagccagcagcgcgctcggcggcggcggcggcggcggcggaagcggaggaggaggaggagggccgagcggcggcggcggtggaggaggcgggccgtgcggggcgtgcaagttcctgcggcgcaagtgcgtgagcgggtgcatcttcgcgccctacttcgactcggagcagggcgcggcgcacttcgcggcggtgcacaaggtgttcggcgccagcaacgtgtccaagctgctcctccagatcccggcgcacaagcgccccgacgccgtcgtcaccatctgctacgaggcccaggcccgcctccgcgaccccgtctacggctgcgtcgcccacatcttcgccctccagcagcaggtactactaccacttgcttaactccatgatttgatttccaacgagtttgatatcgactgatcgatccatcggcttgattgattgattgatagtattgtttgatttgcttggaaaatccttggtctacttctgctgcgtgcatgcatgcatggaccgatcgatgcgtatggatctggatcgtcgtcttgtcctcaagctagctcatcagcagttggggggacaagacgattttctggagtaggcgtgtttctttctcgagaaaggcaaggtctctttccatggaggaaaccaacacggccaagccaagcaacgagcagtgcgaaaaagaggctaacacgccaagcgtgtaaccaggagactgtttccctgcatctggtagtacctgccatgaatgatatgcaagtctcatccgtcgccgtccgcgtcgtccgatctcgatcgatctctatcgacgggatcgatatatgatcgtacgttcaccgtctggccgcgtgtgaaatcttgggctctgaacaatccacgaagtggtgggagtacttgtgcttggttttcgatctgacctctcgaaagaacagccctagcgccaatctctagtcctagaaatccaaactttgagttctttttctaccaatcatttgatgatctgtttgcacaattcaactcgttaatttcatctcgttattattattacatgcatgtgatctactatatgtgattgcgtgatttgaaccttgcacgtactaacagttttttctgtactgatgcatgtacgtttctgccacgtacgatcttgtgatcatgtactcccacaggtggtgaatctccaggccgagctgacctacttgcaagcccacctcgccacgctggagctgccgtccccgccgccgctgatgccggcgccgccgcagatgccgatgccggcgccgttctccatctcggacctcccgtcgtcgacgagcgtcccgaccaccgtcgacctctcagctctcttcgacccgccgccgcagccgcaatgggcatcgccgctccagcagcagcagcaccaccaccaccagcaccatcatcaccaacagcagcagcaccagctccggcagccctcatatgccacgctggccagggcgccgtccggcatgacggcggcggcggagagctcgggaggaggaggaggaggcggcggtggagaccttcaggcgctcgcaagggagctcctggatcgccacaggtccgcagtgaagctcgagcagccgccgccgccgcactctagatcatgaacgacgatcgatataatcaatcgatggagagcgaggcgcaagatttggtgcggcatggacagagttcgcgacgacgaggaggagagcaagcaacgggattggaacgggccggtgatggcgagcaggtcagcaaggagtaggtaagcagcaatggccggttttcgcgtatccgccttgttgttagccgagggtgcaagaagatgccccacttgctgcttggttacaatgcggctttgcttcaattctgcaggctgcaggagaggaaggtggtacgggggagcttcagtagtagtatagctttgacatgtaggagtaacatttgtcactggtagcatttgtcaccgttccattaattgaaagattttaagaagcttctgttcctagtaaccgctgataaatgaaagagaaaaaaaaactgatttcatttttttgttgcgactaataactgtgagttgtgatggtcgtggatgaatttttgggcgtgctcatcttgtagttatgaatggttgcattttatgtggaaaggctataattaaaatcagctaccgtggaaaaattatactgctccatcgatgtattatttaataaaatatagtctgtaagtattaattaggtgtgcatgatgtaaaaagtaaccccctctgacttcatcataggttgagaacattgttaactttaaccattcttatccactctaaagatccaagtccatcttggtacagctgaaaataaaaagctgaggccatcttcctagggaaactattctaatccctcgagggaatgttccctcgtttactcaaaaaccatttaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggaatagtaggtatcattatattctacattattaattttttttagattttttcacaactatttgcatcgaatttgaaagaaaaaggtatacgagaggatatcccctcgaggaattagaatccactcccatcttcctatagttggaaagaagctttaggcatggttgctagtactactctccaatatcggtctctgatagccagctagctgatctaacaagtctactctctctatctctcaggtctcacattaggaggtataaaagcatttgaattttccatcattattaccaacattttaagtagtacattatatagatattttgagggtcgatatatatggatcagttttaaaagtggttgatttgaatataccttcgtatgcatgaataatagttaaaggcaaaatgcaattaagaccatgttaagctagccaatttatacaaggagttaccggtggagaaaccatctttactcccggttgggaaccccctttaatcccggttttccaaccaggagtaaggatccgggactaaagatgtccatctttaccaaccgggactaaggagacaatagcggcagtgcagatggtttctttttctttttcttttttcatttttattttctcccgaatcaagtaggcaaatccctaaatctaactaacatcccaaattcacatcaccaaatccacatcacaatcataaagttacttatacacacaaatcaaatacatcacaatatcctaagaaattactcaaatacatcacagatccaaacaatgaatcacaaatttctaacttctcagtcaaatacatcacagtgaatcatcacaaattaaaaaaaaaagaagccgctgccgccgccggtcgccacgaacgacgggcgcggccccgccggccgtctgccgccgcgggcgcggccccaccacccgccac

SEQ ID NO: 940 - DNA, 7572 bp, Oryza sativa
ccggccggcccgccggatgggaaggggaagccggccaggaaggggagagaaggggaggagaggaggaaggggaggagttggagaagagagttagagaggatagatttgaggagaggtgtgagattcgatctgtctaagttgtaactgtggaggagagaataaggtatagggattatatactacgtgtttaattttagtcccgattggtagttggtgatctttagtcccggttattgacatcaaccgggactaaagatcctcggccctctgacatacatctgacagtggatgaaccggaactaaagatcatcttttgtccctaaagatcaaaatttttataaccgggactaaaaataatctttagtcccggttcttcttggatgtggaactatcgtggattttgccggaccgaccaaagatgatttctctaccagtgagtagctcagaattactatatataccttaatttatatgatgttcacaccttttcttttacaaaataggataattaaacctaacctctacgtccaaccgatgtacacagccaatgcgatgttcacataactactagtagtaattatttatgctggcgtgcagttgtcttcttctgttctttggtcatatagtagtttatgctgtgtattccatagttaattactgtacgtatatatatatctgaccagcaacctcctgccgcaagccctggcctgtcaattgacgcaacgacatgtatcattctccacgtacgcatgcctctcttgcgtgttatcgaaaaaggctaggttagtgaagaaacattgcgtgctttcgcgcacctggtgttatttattcatatcactgtagatcattccatgggtcttaaacatatgatgctacacatggcgaatactaattttccgtggccacgaagcgctcaatattcgccatgtgagccatccatgtcaaccattgcaaaagtttgcagctgaactggacctggttctactggtcccaatttatgatggcccattagtcacccaacttaggtacagcccaaagaccatagcccatgaaagcctccgcattgactcctcggcccctattgcgtcactgggcgtcgcctcccctttctcgatcacccgcgtattattatccccttattaatagccgcaacccccagtaatctcccactgacattacgggcccacaagtacgcgtccccaccagccatagactgctcctagacccgtcgcaccgaagctcccctgccaaatctacgcacgcgacgcggccatctctctcccttctcccccaacctccattagccgatccaaaccacctcaaagccccggaccgcatcactctccttctccccccccacgcccagatccagatccacccggcgcggcggcggatccgtcgaggaataatggcttccccggcggcggcgccgccgcctaccccgccggagtccgacccgcggctcgtggaggccttcgtgcccttcctcgagaagctcatcaaaaacgcctcgtggcgcaacaaggcgcactccaagctctcccacactgccaagtccatcctcgaccgcctccagaacccgccgccgccggcggctgcggcgcaggcaccgtccacgcccacctcccccacgacgcccacctcgtcgtcctcgcagccgggcccgctccgcagcctctcgctcgcggactcggagctgctgctcggcccgatcaactccgcgctcggctccggcagcgccaagctcgccgaggccgggctcgagctgctccacaggctgatcgcgcactcctacatccatggcgaggccgacccgtccgccgacccctcggcccagctcgtcgcgtccctcctcgatgccgcctgcaacgcgcttcacctcgacgacgagcacatcgagctcctcctactcaagacgctcctctcggcggtcacctccacgtcggtgcgcctccatggagattgcctgcttcgcgccgtgcgcgcttgctatgatatgtacctgggaagccgcagcgtggtgaaccaggccactgccaaggcgtcactcgtgcaaatgttggtgatcgttttccgccgcatggaggcagactcctccacagtgcccgtgcaacccatcgttgtggctgatgtgatcgagctgcctgaagctgcttctggtgcttcgcctgccgctgatgccaactttgtacagggattcatctcgaagatcattggagacattgatggtgcaatcacacctctggcacggacaacttcttcagcagctgcaggcgcaggtggagcagcggctcatgatggtgcatttgagacaagagcagcagaggaaggggcacatccagcagatttgcttgattcaacagacaaggacatgctagacgccaagtactgggagatcaacatgtacaaatctgctcttgagggtcgtaaggatgagattggtgtggagggggcagtggtgggcgctttggatgatgatgctgatgtgaggattgggaataaactgcgaagagacgctttcttggttttccgggcattgtgcaagctctccatgaagacaccacccaaggatgctccagctgatcccattgtgatgcgtgggaagatccttgctcttgaacttctcaagatattgcttgaaaatgctggggctgttttccggaccagcgagaggtacagctgctctttcctcgaattcagtttgtgtttttgtttcacgctgtttgcatcctgaatttattgttatattaaccagcaacatcaaccaaaatttggttcatcactttattgtttattccatgaaaagtggtgtagtaacatccagctgtccaagtaggaaaaagctcataacttatcatcctgaaaagatcaggcattggtttgctaatggtagtgcagttgtggataatgttgctatgtaaaattttgttaccagaagtcagttctgattgcaattttatggaagttagagttgcgtgatttctatttatttcataaatatcgaggctggaacacattgaacttaaaccactgccacttttctttgctgatgttgattccaatagtgacaactgttggcactgatataagcgtataggctgcacctagtaaggcatagcactgtttgaccgttaattttaatggactatgcaattggtcaattatcctaacggtagtatgcacttgtatgctgctggcattctgagctttttgaatcagaattttggcaaaatggcaactagtaagctaccaaaatgaagcccaagtggatggattgaaagtcctgctctatagaatccatgtataaattttttattggaaagatccatggcctgatggccccatattccttgcactgttctatttgattatagcaagtttctgcaagatgatgactgcgatgtgttatgaggaaaaggcgagctttgcactgtcattttgttttgtgcaacctgttttctagtatttaaattggtgcattagatctgctgtactttatgcttggaaaatagctgaaaatattgagagatgggtttgtcatgaagccataaaaaatggacgtataaaacactaaaatcttggactgaaagttcactaagcccacccctggaacagtaagtttccgtaacaacttgcttgtttcatcaccacttagcacacaaagggttatctggaaatatatatttgtattctcaagcattatttgttagcattacacttcatctgagatcagtcctactcccatgacaactactccacatggactagcactaattcagttaggttgttgccctcaacttttcttctgaagctacactcatgacaggaaaccatattcactgcaaatggccatataatcaccactcagattaattttaaggtcaggaaacttgatgcccaaaatttgttgaaataaaaatgatgaacatagcttatgaatgattattaccattcacctgtccacttcgagcatcttcttttcaaatatgtgatgaacgcagtatgtttggtttgtataggtgatgcaattgtattttgatattgcacgtgccattgtcatattactctatatcagctaatgtagagctgttacccatcttcttggtgcttttgttttcttgaatatttctagttctaactactttgtctcaatttatacagatttctaggggctatcaagcagtatctatgcctctcgcttttgaagaactgtgcctcggcacatatgatagtctttcagctatcttgttcaatttttattagcttggtttcaagattcagaccaggattgaaggcagaaattggagtattctttcccatgattattctgagagttttggaaaatattgctcaaccaaattatcaagcaaagttgattgttcttcgtttcctggaaaaactctgtgctgattctcaaatcttggtagacatttttctcaattatgattgtgatgtacactcatcaaacatatttgagaggtaatttataatactgtaattgagctatagtgagcttctttttaaaggtccccccgaaggacctataacactcattaggatgctaaccagatattgtgttatcttaattttggactacaggatggttaatggtctactaaaaacagcacaagggcctccagcaggcgtgtctaccacattggttccgcctcaggacaccacaatgaaaagtgaagccatgaaatgcttggttgctattctgagatccatgggagattggatgaataagcagctacgcattccagatcctgactctcctaaagtagagtcggagcaaaatgataatgatggaggacacgagatttcccacacagaggataatggagacgaatgtagtgaagcatctgattctcattcagaaatgtcaaatggggtttcagaggctgcatctttggagcagcgccgagcttacaagatggaacttcaggtggatgttattccatagttatttctatatgtgtagttgttggtgggaatttgctggatgctgtcctttgccgtatgactcgctgctgttctgttgcatatttgatgttatccatttacttatctgtattggtcgattgatttatatgaatggcaggagggtatctctctatttaatcgaaagcccaggaagggaattgagttcctaataaatgccaacaaggtgggggaatcacctgaggaaattgctgctttcttaaaaagttcttctggtttgaacaagactatgattggagattatttaggggagagggaagatttatccctcaaagtcatgcattcatatgtggattcatttgattttcaaggcatggagtttgatgaagccattagagcctttcttcaaggtttcagattgcctggagaagctcaaaagattgatcggattatggaaaaatttgctgagcgttactgcaaatgcaacccaaaggccttttccagtgcagatacagcttatgtccttgcttattcagtcataatgctcaacaccgatgcacataatccaatggtaaaaaataaggtatgtatcttattggctaagtttttgtgtaatataccatagacagcctttggttctgttgtgatgtattaattaatgcagatgtcaccagaagatttcattagaaacaatcgaggtattgacgatgggaaagacctgcctgaagaatttatgaggtccttatatgaaaggatttggaaaaaagagattaagatgaaagaagaagaatttgttccccagcagcaaaaatcaacaagctccaacaaaattcttggattggataacattcttaatattgtcgaccgcgacgagatcacgtttcgacacagcgatgatctcattaagcatatgcaggagcaattcaaagaaaaggctcgtatgtccgagtaagtcatgctagatgtctagatggatagctcaatacctgtatacactaaatgcatgttttccttggtcatttttctttgctgcccatttgatttctgcaactacattattttactgatttgtctcatgtcaattatttatctagaatattttatgaatgaatcaggtcagtattctatccagcaacagatgtagtagttttgaaattcatggtcgaggtttgctgggctcctatgcttgctgccttcagtgttccacttgaccagagtgatgatgagattgtcatatcccagtgccttgaaggatttcgcagtgcaatccatgttactgcagctatgtcgatgaagactcaaagggatgcatttgtcacttcacttgctaagtttacatcacttcactcggctgcggatattaagcagaaaaatattgaagccattaaggtttgttctacttactgtgatgcaaatattagtagcgatcagctgctatcactggcaggaaattactacttttgttgttaccattattttgaaaaatatatggctgaaaattattggaatgaaactgacacattgatgttttgtttcacttttactggcttcaggagtatagttgtatctttctccctttgactgtttcatattattggattgtctagcgcatgttgaatgctcgtgaaagtgtaatatctgaatttagtgatgactggaagcggctggtcttgtacttgttagaactgctataaactaactttccattaaagtttaacgttagttccttttggttggcattttgaatatttgtattatgcttttcgttctaatcatattccatggtgcttattgcatggttttatatattagttttagcataatcataaattcagccttttctgttctcatgctaatttgttgtggctacgaattgcttcacaggcaattctattaatgcagatgaagatggaaattacttgcaagaagcatgggagcatatattgacctgtgtttctcgttttgaaaatctacatctcgtaggagaaggtgctcctccagatgctactttctttgcactgcaacagccggacctcgataaatcaaaacaggctaagtcatccattcttcctgttttgaaaaagaagtctccaaatactgttccagcttctaaacgaggttcctatgatagtgctggtgtgggtggcaaagcttctggggttgatcaaatgaacaatgtggtgacaagcctcttagaacaagttgacatggctgaaatgaatcgtgtatttgtaagaagtcaaaaactcaacagtgagggcataattgattttgtaaaggctctctgtaaagtttccatggaggaattgcgatctgcttctgatccacgggtttttagtctgacaaagattgttgagattgcgtaagtacagggcttcctatattcagattgcaatgtatttccccatacttttctttgatgtatttatagtatataggcagtatatgattgtgtttccctttctcttgtaggcactacaatatgaatcgcatcaggcttgtctggtcaagcatatggcatgtcttgtctgatttttttgttacaattggctgctcagagaatctctcaattgcaatatttgctatggattcattgaggcagctggcaatgaagttcctggaacgagaaga

SEQ ID NO: 941 - DNA, 9218 bp, Oryza sativa
cagggtggaagagtatgtttatggtatggaatctttacttgcacccatgtaccttgatttttacatgtagattgttctggtttgtttcattctttatctctgagtattgattatttgctacatatttttcaggtctttgcaacagcttcatatgatgaccataaaaatattgtactcctggcgtttgaaattatcgagaagattttgcgggagtactttccctacattactgagactgagtcgacaactttcctgattgtgtgaactgtcttattgcatttactaacagtaggtttaacaaggatataagcctcaatgcaattggttttcttcgattctgtgcggcaaagctagcggaaggtgacattggatcctcttcaaggttgaaggagaatcctcattctcttcgcttgaccaaggatggaaagcaggaaagtgcagttcttgttgataaggatgataatatacacttttggtttcctttattagcaggtaaccacatttcttgttctgcatgtaccttctgctgctttcagttgatttgtgtacagataatacaaataatgtgtccccaacttttcaaaaccttgcaggattatctgaacttaccttcgacctacgacctgaaatcaggaaaagtgccttgcaggtgttatttgacacattaagaaaccatggtcatctcttctccttgcctttgtgggagaaggtgtttgattcagtgcttttcccaatatttgattacgtacggcatgccattgatccatcaagtggttctccacaaggacagaatgtggaaagtgatccttcagaacttgatcaagatgcatggatgtacgagacatgcactttggccctgcagctagttgtggacctctttgttaagttctatgacacagtaaaccctcttcttagaaaaattctgttgctcttgacaagtttcataaagcgtccccaccagagccttgccggtataggtattgccgcatttgttcgtttgatgagcagtgccggatctgtcttcgttgatgaaaaatggttagaggtggttttatcgttgaaagaagctgccactgagacccttcctgatttttcttatattgcatccggagcttaccttgagaatgtaccaatagaaaatgggggctcttcagaaaagacagaagacgagtctcgaccattggaggatggcactggagaagcttctagatcaaggaacttgtattttgcaattggtgatgccaagtgccgggctgctgtccaactcctattgattcaggtatgcactattccttcagagaaccgttgtttgataaactagttcttaattgatctttttctggaagcatatttcttcatcaccctatgatttcctgatttttttttttcaaatctccctcctggtgatatggatgatttctctagtcactgtaggaacgaatttcttcattcagaaacaacagaactttgatggagaactatttatcaatcctatgaatatctatcaacttattttgttttcaagattgacatactggaactttcaagtgttattctagtttcacttgtttatagaatttattactacacctccactatagggtcttagtttcctagcattatcttttgcaatttgtacatgtggtcttcgttacattgttcttacattatccctgtttatatatattcatgctgttttgtaggctgtgatggagatatataacatgtacagagctcggttatcatcacagaacactgtgatcctctttgaggcattgcacactgttgctactcatgctcataaaataaacagtgataatgacctgcgatccaagttgcaggagttgggctcgatgacccaaatgcaggacccacctttgttacgcctggagaacgagtcgtatcagttgtgcttgactatcctgcagaacatttgcttggacagatctcccaatgagaggagtgtagaggtggaaagccaccttgttggcttatgtaaggaggtccttgaggtgtacctgagcactgcaaacccatctcagctttctggtgctccgcagccacttggtcattggcttattccggtcggttcttcaaagcggagagagcttgcagcccgggcacctcttgttgtctcaaccttgcaagctatcagtggccttggtgactcatctttcgagaagaaccttggccagttcttcccccttcttgctggtctgataagttgcgaacatggttcaagcgaagtgcaggtggcattgagtgatatgtttagcacttgggttggcccggttgttcttcaaacctgctgatgctgagccccatatctgttatatagtatatctccacatgtaagttattatttgctttattgccatttcttgatgttttgccattccccattttgttctgtttatcattctagttactgggggaggttgtctcttgcagagctgagcactgtagttctttttacattaatttcttttagctttggggagtgtatgttacaagatgactgaattctgtacggtagcttagttcaaaattgtgcccgttctgttggccaagttcaaagtagatatgttttgcattatgtaatttatattgttgaaataatggcagcttctgtgctgtttattcttaccctttaggatctttggcacaagttttgatcgactaaactagaaattctaaaaactatgttcaaacacacgaaacacgagtatagttcacttcagtttggacatatatccacacgttcctagcttcatcctaactagcgaaattccgtttgctacggataaaagaaaacaaatcataatatttcctaaaataaataaaagcgtgtttttcaacaatgttgcccaccttattgctacatgtgaatactcacttcaatttaatttaattttatatagagagaatatactctgtctttgagtttgtcatagttcaacgatttgttaggctgacaaactcaaagataagtatattctctatatgacattgtctctttctataatatactgatgaatttattaattgttttacgatatgctactggactaggctttttttaataaaaaaacaaaaaaaactcttaaagatatacaaggttaacaattgatttatctcattagaaataaaaaaataaattatgtggcctttttacacaacatgaaagttttttataagttacaagttatttttggtatttttaattttttttttaaaaaatctatttttgtgtgatatatgcaagagaaattgcttactcaaaagtcaaaagataatagccaaaaatatcttatgtagcatatgaaagttgatttacattaaaaataacaacaaaagcagtgtaagaatgccaattattttttttaaaaaaataatagccaaaacatatattttttaaaaaaataaatatgcaacttatttattaactttcatgttgtgtaagaaggccaaataaaaaatttcatattttttaaaacttttaatgagatagatcgattgttaaccttgaatgactacaaggatatttcagtttttttaagcctagtccaatgacgtgttgtaaaacaattgataaagtcgccggcatattatagaaagagacaatattagtggtaaattgttaaactagaataaactcattgatataaattagattctcttttatacatggtatccatttagatctagttatgtaatatattaaaagatcaagaggtaatgtgtagattcagtcgccataattgaagtttttttttaaaggagtataaataataataagcagttgcaatgtggttcaagtctgtactgtaaaggaatcttgcgttctgcgtgtttgtctagttcgtccagagttcgtccagattgcttcattctgtaattctctaattctgtatgccatgctcttcagacgctctgtaagagcgactgataatactagtgaagtttgaatatgtatgcttcggaatgatatacatttctgtttacgttggacgcaatgagttttgataatgcggatcatgcagaagataaccgttttccctgtacaggacgagaactttgcggagcagccgaatttctaatcagtacgttgcgtcgttgcattgtacagttttcagtttcgtatatgagagacttataaagcatttccctgtacaggacgagaattttgcggagcagccgaatttctaatcagtacgttgcattgtacacttcagtttcgtatatgagagacttataaaacatagcctaccccctttcgtttttacccaagtaaatactacaaaaggaagagccccaagccaggcagtgttggggcgccaactgaaaatagagcccatcgacacaatcgctacgaattgacaccaccaccgtctcacactcactgccgttgggagagatggaaaagagaggaaggagagagaggagagtccttaatatgtggagccaccatctcgttgctgttgggagagatggcgaggagcggaagagtccctaacaggtgggatccacctactgattcaacgagttaactgtggttaacctgccactttaccaggtaccgcttcccaaaccgaaaggaggaaaaaaaaggacatgtgcaagcacccaccgtgagttaccacgggatgacagctaggatgaaggccctctgttcacagtgcaagcatcgagtcggacccacagtgcacgactttaccaaatcaatccccaaactcctccctcatcacgcactctccggctccttcctccctccggtggcggcttctcccctctccccgtcggcagcttctcccctctccctctcctcgcggcggcggcggcggcggatcgagaaggccgaggcggtggcacgcgacgagctcggcgtcgtgcgagcggtggaggggaggcgacgacagatccacggtgttgtggaggctggggacgcggcggattgaggagaccgaggcgggagcggcggagctcggcgtcgaaaggctcgacgcgcgtggcggcggcggctcaagaacgggcatcgaggaggaagcgggcgaggtgagcgccgggcggttcttggcggcgggtgcgtccagcggttcttggcggcgggtgcgtccggcggttcttggcggcggcggctcaagaacgggcgttgaggaggaagcgggcgaggtgagcgccgggcgggtggccggcggttcttggcggcagaatgcgtccccggctgcctccttctcctctctcccacgccgccgcgcctcacctcccacgccgcggcggcatgccggggacgccgccgctgtgcgcctcgcctctccgtcgaccgtgccgcccgtgccactcgatttgttgatttgttgccgatttgctgccgtgtttgctgccgcgatttgtgtcgatttgttgccaagcatgggcggtgcgaggacacgagctccacagtgtagaaaagcagtcgtttcctcgcctcgcgagagaaggaaacgcgcgtctcaggttgggggcggggcgctctccacaggcgcgcgtcctcgctccacgcaagccagaatccaacgtggcccccatagcaccggtccaactgtgtgcaatgtgaagggcctaaggcctctcccactgcaagcacccatcctgagttaccacgagatgacacgtaggataaagagctttgaagaccctctctttacagtgcaagcaccactagtgggacccacaaatatctgctagtggggcccacggattcccacctccctcaaccggctcatcctcccccaaatccccaaatccactcctccccgctggcgccggctcttcttctccctccgccggcatggtggccttggtggcggaggcctccaagcggtggcggtggcggcggcctcgattgcagcggtggcgtcgtcctcgaagaagaagtggtggcggcggcgtccccaacgtcgacgagctcggcgtcgacctggccaaggcgccggccgggaggaggaggtgggggagtagatccggccggcggctcatcctcggcggccgcagagcccgctctccctctctccagcccctcacggcggcgggatgcatccccggcggctgtggctggcgcgccggcgggagacgtccccggctgctgcggcggcggcggccaccactgcccgcgccgccgctcctcctcccagtccgtcgcgcctcctcgcctcccacgccgcggggaggagggagcaagaaggcgccgcacccactgcacgcagcggcgaggaggaggaggaggaggagtagattcggcggttggccaccaccaccggcctcgccgtcgcgtcggctgccccgtgccgttactcctcgtcgcggtccacggcctgctgctgggacttctccggcgggacggcgatttcgcagattccatctcccacgcgtgcgctagggcatggcaactcggagacacgaccttcacagcgcaggcgtgggtcgattttcctccgccgcgcgtccttgaggtggttgaggaactcgtctcccaactaaggagcgagggactacgcagggacgcggtgctgcgcgacacgtcggcatttttcctagttggcaccagaaagcaacgctccacctcatcgcactgtaagaggcctaaatttattcctttcagcgtgactgacaaaactcacgcccaagtgcgcgtgtcattaggctgcgcgtgtgtccgccaataatttttggctgatctgggaggcacaggtctgatcggacggatgcagatcaccaaagggtgtcggagttttaaactccgacgttggtaacaagaacgcctttgcatgcgagaatgctaatgggcgatcaggcgcatcgtgcattcgtgcccgtgcctgatccctgctcctttgttcatggaggccttcctgcggcacggccacagcacaagacacatcctgcatcaatatgacactatcgctccttcaacgacgccatcagcgacgaggctgtactattgacagcaagaagaggccaccgcctcattcgtgcctcgcctgcgctggcgacgacgaggaattgctagaagtccgggacaccaacttcctacgaatggccggcagaaattaagtagggagtcggagccccgcaaaaaggggaaaaaaaacgctctttggaaagagcctatagctagcacctcggcagaagtagatgtttcagagtgattgtacacttaggccgtgtttagttcctcctaaatttctaactttccatcacatcacatcgaaaactttcctacacacataaactaccaactttttcttcaaactatcaactttctcctaacttcttaacttttccaccatctaaacacatccttaggttcaaagcaaaatagcccataatgcaagtcacctgaccaggccatggttcaaagcaaaatagcccataatgcaagtcacctgaccaggccattgatgaatgagtcaacacgatgttgtcagacgatgatctactaagggtgtgtttagttcacaccaaaattgaaagtttggttgaaattgaaataatgtgatggaaaagttaaaagtttgtgtgtgttggaaagttttgatattatggaaaagttgaaagtttgaagaaaaattttggaactaaactcggcctaaggccttgtttagatcccaaaaaattttggcaaaaaacgtcacattaaatgtttgaacacatgcgtggagcattaaatgtgggggaaaaaaccaattacacagtttgcttgtaaattgagattctaatcttttgagcctaattacatttgctaataacagattaattaggcttaataaattcgtttcgcagtttacaggcggaatctgtaatttgttttgttattagtctacgtttaatattttaaatgtgcgtccatatactttaaaaattttacacccaaagaactaaacacaccctaactaggtcacaaagtcgcaagttccctcagaacactggtgattcgaatttgtacaatggtcaacaagcacaacaaataaccttcggattaatccaggttaactgtacagcaagcttggtttgagcaaactacacaggttaattcacaagaggtgtgtgacactgacacacaaaccaacaacgattatcttcatgcaagtaagcacatgtacagtgaggtctcagtgaggtttcaaacacacggcaacccagaacactctagcgggacggaggtacggatggctaaacattctcacaaataaatctggccttaaccgctcgacttcgagcgaagaagaattattccagcaactgaaggcgtcacctcgaagaatacacaagtagctctacagaaaactcgtggcttgcatcatcccgtcattcacagtaaagaatcagcaggccaacgctagcatcttgcaagcagctttttttagatcttttccttggcgaagaaccgactgaaaccccggttttgtttctcgggcaattggttagaaattgaggaagatgatctcgatctatgctttgggcgcttggatccgtttggtgaaaggaaagggcttccgtccgcttcagagggggcattgtgtgtcttgtacccattcactggggattcatttcctgatgcatgcatttcctgatctgtatccagttgacctgttggcttctgtgagtattcaacaccttcggttgttccagccgcgtcctgcaggaaatcttccattcgctggtttggcgaggaacccattgattctgctggaggacgcatagattgtagttggcgaccaagaatcaatatcgtctcctggcattctgcaagtttctctgctgcagctgcgatctctttctcctgtcaacattttaaacgaatgtgctgtcagtgtcagtcaaatgcctggaatttccagaaaatatcagttttgcgcacagtacagttctaagtactcctgaaataagttagtatgaatctaaattcagcatattgatttgactagtaagtgatctaatagtatcatactttttcctgtatttacaaatgaaaatgtatagcgaaagcatttctacaagaataataataaacaacacatgaacaaaatgtatcagcagccctatctcgaagataatttctctatctaatatagcaacttgtattgttcaaaatcatagctacctcacatttaatttctctatctaattcctcatctcaacaaagcacaatcatcccccatttaatttcacatgtttcc

SEQ ID NO: 942 - DNA, 14260 bp, Oryza sativa
cctcagatgccttgtgaggcttgcaaggttgtttcgattgaacacaagtatggcatttggaacctttgaccaaagtgaattttggaattaaactcatgttagctaagcgcgtcatacaaccgaaattcacatgacagagtcatgaatgccacacattagactcatctttctcgctaatatggttcacaacattatgattattacacatgtcattcaaagaaaagtggaacaagcctccgctgtcataaccttttccaacaaaagtcccatatttagatacgacacatttattggactcaaacacaagtctaaaaccttctctacataatagagagccgctaacaagattcttctttattgaagggacatgctgcacgttcttcagctgcacggtatttcccgaagtaaacttcagatcgaccgtaccaacaccatgaacagccgcaagcgacccgtttcccatcaacaaggaggaacctctcccaacctgataagaagaaaacagagaaatgtcagcatatacatgaatattagcaccagtgtccacccaccaatcaggtgagtgaaaaacagagagaactgtaggtaatattttaccgtaccccgatgttcctccgccctcgctaatgaccatgttggcagacttcctgtctttgcgctcaggacagtccttggcccaatgcccagacttgccacacacaaagcagtctccctttgcctttcccttgcctttcttcttaaagttggttgcagccttaggtttgacatcaggcttgactttcttgttgttgcgggatgcatgagggttcttcttctgtaccatattggcactagaacctccctcaacctttttgccccggacgtcctttgccctcgccttctcctaaacacccaaagagtcaatgagatcagaaacactgaactcttgtctcttgtgctttagaaaagtggcaaagtccgaccaagaaggtggcagtttggcaataatgccacctgccacaaacttgtccggcaactcacagttgttgttctcaagttccttagccagcatctgaatctcatgagtttgttctactacagaacggtcatcgaccatcttgtagtcatagaactgctctatgacatacagctcactgccggcgtcagaaactccgaacttggcctcaagtgcatcccacatgtccttcccagaaggcatgtgcatatacacgtccactatgttgtcagtaagtacactgatcaatgctccacggaacagataatccgaagcctcgaacttagcctcttcctcaggagaaagaggtggttcacttcgtttgccccgtgaaacatagaagcattgcatcgctgtcaaccacaatagtgcacgtgctttccatctcttataattagaaccatcaaaagcatgtggtttcagtgcagcagcaaagccaactaccgaaaatgacctatcaggtttttggattgttggaaatatggtcataaatcggcatattttaatccaaaatgttaagacaataatcatggcataaacagtgtagggtgatctagtgacagcatgtaacattaccagtagcatactaaaggcatcatgaacaacattatgaatatcaggaagaagaacatagcagtaacgcggtagcatgctagaggcatcatgaatatcaggaacaggaacatagcaataaagcgctaacaacaagaacaggaataggagaaggatataccctgagaatggccctccgctggattgtgaggcagaactgcctccgttggtgttgttgttcgcggcaccggctccagctcctggtgcaccacctccagcagcagctccaggtggcgcaccatctccgccatctcctccagcagcagcagcggcaccggctccaggcgcagacatggtgggcgaggacgaggacgagcagtcgtgcgggaagcactccccaaaaacctgatcacccgcctacccggtgcgcagatctcaggagaaggtgtggttccggaggccctgctccttccgatctctcgtacgcacaagcgatcagaagcgaagaggcgagagcagcacaagcgcggaggaggaggaactaacacccgggaaagaagcaagcggatcgttctgatcggactcacggcctccttatctatcggatcgttttgatcggactcacggcctccttatctattaggagagaggcagtcatgggaacgtgggatcgtggacgcgtccttatgaagcaagcggatcgttctgatcggactcacggcctccttatctatcggatcgttctgatcggactcacggcctccttatctattaggagagaggcagtcgtgggaacgtgggaggcagtcgtgggaacgtgagatcgtgggcggtgcgcagatctcaggagaaggtgtggttccggaggccctgctccttccgatctctcgtgcgcgcaagcgatcagaagcgaagaggcgagagcagcacaagcgcggaggaggaggaactaacacccgggaaagaagcaagcggatcgttctgatcggactcacggcctccttatctattaggagagaggcagtcgtgggaacgtgggatcgtggacgcgtccttatctatcagtcgtaggaacgttctgatcggactcacggcctccttatctatcggatcgttctgatcggactcacggcgcgtccttatctatcggcctccttatctattaggagagaggcagtcgtggaaacgtgggatcgtggacgcgtccttatctatcagtcgtaggaacgtgggatcgtggacgcgctgttgcggaggaacgtgggttagtggttgcaaaagagtagcgacgtgatgtgacgcacgccacgcctctccctcggcccggcgcgcgcgcgtgtggctttccaacccccacctcaaccagtcaacagggagcctccaataactccctatttaggttgagatattcctcgcttaaatcctgaggtggtattattattcttaacacttattatgggcatctgagattcaataggataaattgggcatagcccatttattctaacaacatataggagagagtttggtgaacagcaatcaccaactgcatccggtgactcacacatgacttccctttgattacttggctacgagaacgtcctttggttaaactaaaagtctggtaaagctggtcaagtagcgttgttcgtccagcttgccgacattaccacgtaaccgaaaggtaacacgaatcggacctcgtgctaacactgcaattaagctttctctaaaacaaagcatccaaggaaggtggtaccttcccttcactaatctatttggcaggctgatgactcggagaactgaagcaaaagtagcccgtccgtgtcgctgtcctcctagattgtggaggttccagcggcctgcttatccccagaatcattcgtaacctgggctcgtatctgattccttgatagagatcctgagtgtcgcggactcgcggtgtgcagtactggattactggtagtgatgcagtgaggagtctccccgccgtccccggaatcattggtaaacctggcacgtatctgattccttaatcagaatggagttttgcttgagtgctggactagtggtactgtgtcgtgggctagtataccgtgtataagttaaacaatttcaactttaactattaatagtgaaaaataaaaaataataatcacgtaaaattgatgttactagatttgtcattaaaaaaaactatcgtaatatgtaactctttttcttaaaacatcttacttctatatagatattgttagtcaaagtagcatattagagatcgtgttgagtctatattttaagacggaggaagtagtagttttgtttgagtgctggagtagtggtactgtgtcgtgggctagtgtaccgtgtaaaccggcaaaacgccgcaccgtaaaacaagcgcacatgggtaccggccacgggctctggggctcgtggcagtcgtgggtgggttggggggacacggcgcgcgacggcgccacatgcgcggcagcgcggccacccgccgaaccgcgcgcggggcggagagggatcgagagggtgagggtgagaaccgcgcgcggcgccccaccgtgcggggcgttgttgtcccgtgcgccgtctcccacctcggtttcaccgcgggatctcgcgggcgcaccggtgtttgcgcgaccgtacccccacccacatggcgcggctgctgtgctggtgccgctgcgcgcgcggcacatgtgccaccgctccatgcccgcgcgttctcgtcggctcacgtggccgcgtcgggttggacacgcgtaggctgccgtctctctcagagcaacccgggcacatgcggacgcggggggacgcacttctccatgtgtccgccggccgtacgcgaggcccaagggccaacgccactcctcccgcggtcccgcgacgccaccaatcgtgccgcgtcgccgtcgccgctgcaatttcgtttcgggaattcttggagattggcaccgacccggatcaggggcggcgacgcgatcgcgcggtgccattatgcccgttttattggcttgtttcgatatactactccgtattaaaaagaaaaagaaaaccctggtctcaccgagatctatatgcatgtttctctgaaagtctgaagttaatcacgcgcccaaaatctcggagttactattggccaagagagggctcgtccaatcgtccttgctgcaggcacgtgcttttcgtacatcagttacaaggaacacagcaattccaatcctttcacatgcatctatgcaagcgtaccacacagatggccgccgaagcatggaaaatggacgcctctaactccggaagaaatgtcacattgatacgaactgggctagcctgaaagattcacaacctggtacagctaacttaataacaagctgcaggacgatcgaagaaaacttgggggaaaaaggcatgtgctgaaaggacaacatcatttccatagatccactgttggatacttaaacggctttaattatgagatttagattctagatctctcctatcagctgctccatggcctcccttcacagctaagaaagccgtgaatttttaggatctatactagctactataccacttccaatttcacatgactagctcctgtattttcagttgagtcttactggtatttcttttccgtccatcctatctactctctctgtttctagttttacgatattgtttagttcattttaaactaatcaacatcaaagagaataaatagagagtatattctgtactcaggattcgtttcatcagctcgtaacaatcttaccccttttgtcttccgtcactcacgtttcagctaatttttcgtagtaacagtgtccatagaacctccgcatatctactgctcctagtctcctactacagtgaacgtaccccaattcccagatgatggagtttccactttccaaagagagtgaactagcttaaccttgtttttgccttgacagcttaggccctgtttacttcacttcacaaacaatctatgtcacatcgaatgtttcgacacatacataaagtattaaatatagattaaaaaaattaattacacaaattacgtgtaatttgcgagataaatcttttaaacctaattgctacatgatttgacaatgtagtgctacaataaacatttactaatgatagattaattagacttaataaattcatctcgcagttttcagacagaatctgtaatttgttttgttattaggatgtatttagttcacgctaaaattggaagtttgattgaaattggaacgatgtgatggaaaagttaagtttgtgtgtgtaggaaagttttaatgtgatggaaaagttagaagtttaaagaaaaagttgggaattaaaccatacattagcctacgtttaatactttaaatatatatccgtatatgtaatgtggcatgaaaaaaaaaattgttcccgaactaaacaggctctcatttacggctaattattctttcagtggtaggcgacgtacccgtcgacagcgaggcgtctgtggtgacttcatcaatttcaagatatgccagcccagtcttccggaggtgcttatagggatagggtatacatgtgtgagttcataggggtgagtgtgcgcacgttatgagcataagtcggtgattcaccatccaggcagtggcttggatggcaagcaagaaggcaagcggtggaactgggccatcactgacacagtgacgcgccttaaccggtaacgcggcccccacggttcggtgggagcggaccagtcgcgtggatcggccatcatcatcctgatatcgctcgcgtgcgtgcaagctgtgcgtggcaggtgtgaatcagatccccgcgtgttgtattccgtctccacctagaagcgtacgtacgcggtgtgtgtataacgcgagcggccagtcggtggtgctgcctttgcctgcgtattttgcgatcgtttcgtgaaggccgcggcttttctctttaatcggttactgccgagttggggttgcagccacaagaagtagaaacgaacgtgtacctgttcagctatacaaagtaaacgataacaaaattctaatttgctacttacaaggatgtgctatttagggtttgtatttatggtcatgttagcttaaggtaataaacaagaggaagagagcataatagcagaacctctattttccctacttatatctataaattacatgtaaacactccactggtttggcaaacaaggtagcagctgaacacaagaaagaacaatctgaaaagggaaaagtgggtgacaggtggccaccagggatgggccagtgaagctgtctctcttccccaatcgagccgctttcccctgtccgaacgctacaaaaactttccacacgccaccctctcccataccaccacatctcccaaagaattccccgttccaggcagccgagttcggtccaaagtccaaccccgcgactgcatacaattccactcgcccagtcctctcccgcgaccgccatttgactcgcagggagccaacgccgaaaccgcgccaatcttttgcccccattttagacgggcgctgactgagccaaacccaacccaacccaacccccccgcccggcgcggccacctcacaagggagcatcggcacagccaaccgcagcgcagcggcagccaaaaacccaccgtttccaattcctcgcccgattttgaaccgctctccgcccgaccgaacctgttccactccgccgagcggaaaaaaaaaacttcttcgccgtctcgaaggaaatttattgggaagaaaccgttgcgggaggcgggcaaactgaagcggcagcggcagcggcagaggcgatggagcggtaccatccctccgaggtgtatgagctcttcgtgcggcacatgaacaccccgaggtaagggttctcgttgctgttgctgttgtggtgtgttccggtttgggatcatcgatcgaacgggtggtgagggtgctgttgttgttgcgcgcgggcgcggtgtggtacagggtggtggtggacagcggggtgtgcgcgacggcgacgctggtgcaggtgcacagcgcgcggaagcacgggatgctgctggaggcggtggcggcgctgtcggagcacggggtgtgcgtccgcaaggggtacatctcgtccgacgacgggcggtggttcatggacgtgttccacgtcacggacgccgcggggaggaaggtggccgacgcggacgcgctactggcgcgcctcgagtcgtcgctgtccgcggaagcattgccgcgggcggcggcgggcggccccgccgcggaggggctcaccctgctcgagctcgtcggcgccgaccgcccgggcctcctttcggaggtgttcgccgtgctgcacgacctccggtgtaacaccgtcgaggccagggcgtggacgcacggcggccgcgtcgcagcgctggtgttcgtccgcgacgaggagacgggcgcgccgatcgacgacgcggcccgggtcaggcgcatcgagtcccgcctcaggcacgtcctccgcggcggcgcgcgctgcgcgaggacggtcctggctgatccgtcggcggccggaaacctggaccggaggctccaccagctgctgaaagaggacggggaggccgacagccgcggcgccgcgccgatgacggcggtggcggtgcaggattggggggagagagggtactcggtggtgaccgtgagctgccgcgacaggccgaagctgctcttcgacgtggtctgcaccttgacggacttggattacgtggtgtaccacggcacgttcgacaccgacggcgatcacgcgcagcaggtgagccttccagctgtttctccccatcatccagctttcaagatttgttttggttggtccaatttccccaagtctcattgttaattttgggttcggtgttaccaattcccctctactctgttcttctctttggttgagctggcttcctctcacgaatctagatgtttctttgggtggttgtgttaggcgaatcgtcttctgtcatttttttcccaaattcttttacctcgcttttgctttctaatgacgtttaccgtttcccttctttttttgtttgatttcactgctattcctatgtcggccccatcgtcgatggaaattatgatttcgaatttggtgaggctgatggaatagttgctatttgcctcgtgtgttctgcttcgcgatgttggattaaaagttgcattttttttgggtatacatgtgtactagcttaacctgagctatgtttgcttggcttcaccgcttgcaggagttctacatacggcgttcggacgggcggccaatcagctcggaggccgagaggcagcatgtgatccgatgcttgcaagcggcaatcgagaggcgcgcatccgaggtacgtgatggagtagcagtagtatctcctttgctttccctccatgccacgccaccgatcgcggccgtgctgtgctgtgcccacttcgcagcaccaagccgcgaagtcactttcgttcttgcccgactttccactacaccccccatgtgttcggccgaaatcccagccagcgcgcgcggtgcccgtccgtctgacgcgatcttttttctgtgtgcagggcgtgcggctcgagctccgcatctccgaccgccgcgggctgctcgcctacgtgacgcgcgtgttccgggagaacggcctctcggtgacgcacgccgagatcacgacaagggacgacatggccatgaacgtcttccacgtcaccgacgtggccggccgccccgccgatcccaagacgatcgacgaggtgatacagaggatcggcacggagagcctccgggtggacgaggagcggtggccgcgcctttgctcggcggaaggcgacgccgccggccgcggcggcggcggcgggctgttctcgctggggagcctcgtcaagaagaacctcttcagccttggcctcataagatcctgctcgtgagtacagatgacgtgtccgatccgatggcatgcttgtgtaaatatgggggcggtccatgggttagtttgtaaattgagtagatttttttatgctctttttttaggatttattagttgtcacgtgtatatagtagaaatgaaaaaggctgcttgtcggtaattaacagcttggaggtttaaagggacgcgttggtgggtcatgcatcttttacatggaaatagacagatagaagatgaatgtaaatagggtttgtacataagtgctacttaatgatgtttaactaaaaggaactatcatgtttgacctgcaaatgcaactagtgtcaattctcatttgatcccttcaggcacctgttgtatgcaatgcaaatgggggcatgttttctgtgaactgtttttgcctgattgttataggagcctagtaactggtgtattagcggcccataaatattaacgtaactcattccacacacgcaatctttacatatcctgtggcaactgaataatttacttttatcactgctgattgtaattgtaaccacttgtttacaagttgtccaaaagcgctgccatgtggccagacaagagaaatccgagaacactaaaaatattaccaactagaatcatctaaagtctaaattaaacgaagtgaggcaacaagaacgattaatcaacggaatatgacagccgattcaacatgcttaggttgaactaaagaactgtgctccaatcctcatccatgtcaaaaaccctttgtacgaacgtcgctttaccacgaagaagtaaccgttttcaatgtatttgccgacaaagcttcactgtccatgcgtataaaaccatttgacattgctacagcctcattaaaaagtcgttttgagagagtccaatggccacttaggtgtccatgcgtgacatatgtgctcacggcttttgtccccgtgaaaagaaacaacaattaaagagggggaaaatatcacaattgctcacacctcgcatcaccgcgcgcggcttaagtatttaaccacgtactcgcacggaccgggcggtgccttgctatcatcgttggaattatggccgtttctcctcttatcaacgcaccaggatgcacacgaagtccgtgggtttaattccttgcgcgacgaggacgacgctgacgctcgcttagaatttttaaccggaccatgtcacgccgtgcggaacgaaccggcttaccggtttctgaacgttctttgcctgcaggttttattacgaagcgatcgaggagaaacccaacaactgccgacctaccgccaactgccaccgatcgaatcgagctgaaccaaaccgaggcgtgtgcatgccttggtgccaacgaaacgtcgagacgatacgatctcggttttgctttcggggcagctgtgcgtggtagtagctcaacggaagaaaacgacctgtaacctttttagtttccgtttccctcttttccgtcggagatgggcatgatgtaggtagctcaagttcgtaccaaaacttaattggggattgatttttgggggtgagccgtagggttccttgtcacgtgaatcctccaaggacgacgggtggatgtagcgtccatagggagcaaaacgtgcgggaaaccgccacggattagccgatttatgatcgaagctagccaagttggcaatttggtgaaatgacgatttgcgagctcgatcagaatcagccggtaagaagactgaaaaaatgaaaagaaaaatcatgaccggactcgaagctcgaattcattgcaagtttatccggacgtgaagcattgggcgaagaacaatgaatagcagtagatggcaatgctgctcatcagggtcccctttccttctgcttgtgttttctgggcccggatctcagctggtccaaccagcctttctgctactccaattgctgcaggggtttggtctggactatgtcggtattgttgcgtgccgcgtgctagacctactcctaccaatctgcatatcgaaacggcatcgttttcagaggacgacccttttcctggcttcgatctcgacaatgaaactagagctgctggcgtcctgtctggccccaagagtgtacatactcacaaatacttttttttctttctgttagtgccttaaaaatgacagctccagttggcaagaactgtcaagtgcctggcaagcaaggtagacggctagacgcttccctctgcctcgacccttgcccgtctggacgaccaaggtaatggcccccagcatcggattccttcatacagcttgggttgctgatcaatcactggatcaactgcatgtcctgattgctttatgctgtactcctgtagagccatcaggtagaactgtacaagttactacaggaacagcgatagtacttgaagttgacagtactttcatggttgcaaggtctgtaatgcggcaatggctaatcactgcataaattgattaacatagtgcaggaaaaaaaatgaaacgaggcaacaactggatccatgcatttcgtgctgcaaaagaatggttcttcccctgctccacaatccctaggagggcagggagaagactatacagtgaggtaatatgtggttctgtacaaatgaatttgcggcgtttgccagttttggtgaagtttgtgacgtggttcacacagatatttacaaccatgcacaaacatacgtatctgagagcttttcagtctaaacagggtcactgcttctaggaattattcttacaggaaggccgactggcgtggggtcattagtatcagatgtgccatgtcgagcatcttcatccttctgcgggagatcagcaaaaggaagattcaacccttcctcaatgtcagagtcgtccatataccttgtagtggacaaatcttgaggtcttctccagctgctgctacttctgttatagcttcgctcaagctcttccacacttccatcagacacatcaccagagtgataactggaacggttaccagcaacatatcgatttccaaattccggaggctccagaaaacttccttgttgaccagtagaatgttcaggtgcttgatcccaccaatcgataatatttcctttggtatcatggtgttctactggagcatgatgaaacaaattgcttgatgtcgatgcatccatatggcttcgaaccctttcatggttaaagttccactcatcgcgatctgctcgaggcgggggaaccatatcagagtcccagccccttgcttcttcaatttcagatgctttaaatgctgctgaacctgtgttctcactggtctcagggaacacttcgttgaaataaggagcctcggttctatccaagtgaggtggatggcagacgtagtaccaatccagaatatatggatgacttctttgatctgtgtcaagcaatcctaacgggcccaaattgtaaacagcaggtgagatggcctcagcacggttatggatatcactagggagtagttggtggaagatatcatccctgtgacctctggtgcttgccacaaagcctgatgcttccattgcttgatattgtgcaagagcctgctgccgtatttgcttttccttgaacttttggaggttagttaagaattgtttgccttctgcatttggttcccatgatggatacacactttgaaaactgtaaacaatcatataatagaattagacctatttttagcattaaaccttgggctgagctagcttgtattaagctaggccatttgtatcttcgaattttgcaattggtaacaaccaattacaagggcgttgtgtcctacgcctggatctacccttggctgcaacacttgtgactaactaaaacctcctaactatacatagtacaaagtggccagtatccattaggcctgtaggacaacagcagggcacattgcatacagttggaagttgggtggatagctaatctagtccctaaagttccaccagaggctcaatttggtcctttaagttctattttgtccacacaggtcctctaagtattcgttttggttcgaaatcatacttgcacccacttgattagccaataataagtcaacatttctattacaaaatatcccttatctaagagaactcattgtacacaaatttcaacagaaaaaaaaaaacagcacacaaccattgggtattggaggggtcttgagaaacaggttcactggccaaatagtacatatttgtctttttcttttcctttttcttatacatgtgaaattagggaataatagtcatttatcaagagagatgctaattagatttagctatatgtcttcacaagtgggtccaacgatgagtttgaactaaaatgaaaacatgaaggactaatggtctaatatggacggactgaaacgtcaaggaccaaattaagcctcaagtgaaacttggagtacaactttgcttattctgttattcactcttgaaaatgcaatgtacatggtggactaaagtactaaaccaaaaatggatgtcgctttcttggaatatgatgtgacgagggcagcaccgtagtgcctatattctacagagtctatagtgctgacaagaagacacccaaaaaagtatcatggtcaagtgttcagctttggccatatttatggacaaaacagttatacctctaaatacatactgctggtaaacttcgaattataatgctcggacacaccatttcgttgtagattatttctgcagaacatattttcatcatatatccatagttaatgttgacttgtacagtctag

SEQ ID NO: 943 - DNA, 11033 bp, Oryza sativa
  unsure (1)..(11033): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtactctaaccgaatgcgttgtactggtacagcctacctgcaggctgcagcacaacaaagtggctaactgtttcagtctttgacaagcgcatgctggatgatataattaacctatctaatttaaaagaagcagctatatagacacggtacactacactttgcattaattataatggagcatttggagctgaattaaagtggacgcccaacttatgaaaaacaaaaacggtggaacttaaagggagaaaaaaaaaagagaacgagtgatctttaccctttttttttctctcccgtgacattcttaggatgccctgcactcgacagttgataggatgctcagctgctaactatacttttgttattttcagtagcgagccacccacccagagccacttcttccgattctgtccatcaattcgcactgattaagctttcgctttccaattccctcttctttattgagacaatcactaaaacatacattgtgcattgtctcatctgtattatagcagattagcagtactgctatctatttatcctcatggaactttctgctaccacacacacaattggccattatgtattcacgaaatcatatccgctctattttccccagaaatatcagttttatcatcacacagtgacacaggtcacaggctcacggtatcaccgggaattcctgtcgatcaaatggaagtcctgcgttacacaattcacattttacagtgacgcaggcacgcagctaatcgagcagtggagctgcaatgaacagtgctatgcacattctctttccattaaaaacagagctgtataactcttgcccctgcagtccaagcctgcaatctgcatctccgtgcatgatgcttagtgtactatagttagtttaagctgactttgggggtctttacagctggtgcagctcgaagcacctactagcagctggctggctgcagtcgagaggtgaaagaccagtttcagacgacctggtcttcttctttcaagatcgatcacacgtatagagatagaattctccaatgtactcaacaaagaaaataataactaaagaatatttgatagttttcggagtatttttttaaaaaatataactagagtgtaattacaataggtggctagcaccgtgtgagtgtgactatgtgtgaggttatgggttcgaatccttcctcatgcgcacaaatcgattatttttcctctctaggtacatgaatcttaacagggattcaacggtctacaaaatgaaagtttcatttgggaaaaaactgtcaacaactcgataacaaatctgaagaaaaatagcaaagaaaataacattcccagctaaataatgtagcgatacacgtgtcagagaggataatatctcattctcatgacactccagtagatctgaccaaactctaaaaagcataaacacctgcttcaatccccgcgctttaagccaatcagcatcaaatctttttagacgtaaccccgcacatgcccaaccagcccatgattacaccctggctgcagtagtattattctcagaagaacatgttaccacattctgtcattcaccgcagcagttgagcaccacatttgaccagccagccagctgattataccgagcactaatgcgctattactagtataaattactccagtttgggataagataaccacccctgcatcagcgcagtcaggtcgaccagagccgtccgatccaccacccgtccaacggacggctcaggatctagctcttccccccgcgtgccacacacaagtgggtctattgtaaaaaaacctccggtctcatagtttgtgcctcgctcactcacactcacacggtagatgaagtggcgttgtagccggtaatacgtgccacctactgcgacattttcttttgtgcacttgctccttggacgttagccaactaaccgtagtcgcagtcgtctcgcctgtttttaaccgctagtagtccgtccgattagacgtgagatacgccccgtatttctggtactactactactagtactgcgtggtgatgacacattgacatgccactggcttcactgacactcaggcacacagatgaaagcttcgctgcttacgtagccatggcgaggtgaaatgttgcagccacatgcacaggctagattatggagtgaagtagtagtagtaggagtacagaagtgaggcactgtttggcatctttggatccctctcttttctcttttggagagccaggaggagcgatagcctggaggtgaaccagcctgcctttccaccgcgtccccacctacctactgggaggcgccttttgttactttcacacacatgtgtggcgcttgtttattgcgaggattgccagtcagtcaatgtgggaaagctcaatgccatttttgcagtcctgcagacgggcagtgcgccagtgtcacgttggaatgaataatctttggctaagaaaccaaaaaaaaactaatctttagttggtttctcaaggaaaccagtgacatgtttttgattgagctgttgcttagctgttagctttgcttaatgacaacttatttgcttgtcatggttttggtcagatagagaaatgagggagtgttacggctgggttttgctcggcattgtacttgaggaaacggatggatgagtgagcttagctagagtaatttcttttctaaagcccccttttttctcatatccttttcgatctataaatcgtaggcaactttccgttttatgaccataggtattaggtggtgagctgttgcgagttccatcgatcagatttgcttttttatttgtaggggtagcaactggcacaggggcattttgctccaaggagaaagcaaggccaccctacatcggcaggggcggatctaccgtgtaacggtgacaccgacgactttcggtaaaacctatagttaaactgcatattcatatattataacactatgttttaaatataattagggtgtgtttgaggagaaggggattgaggagattgggaagatacgcaaaacgaggtgagccattagcgtatgattagttgagtattaactattttaaattttaaaaatggattaatatgattttttaaagcaactttcctatagaatttttttgcaaaaaatacaccgtttagtagtttgggaagcgtgcgcgcggaaaacgagatgttttctctctcaatctcccagaacacccgggaacaaacgaagccttagcatactatgacaccagtagatatgatatgacaccattgaattaattttctggatccgccactgtacatcggtgttacgacaaacagtagtaaatactgctatcaagaaagaataacaaatgcaagtcgcaacagcaagtgttttactatatctttcagaattcagattaggttccgtgcatcatccaaggcacttcggaaagtgaaatgaaccattggaggctagtgatgctccaactgacttctgttcgtggacaataacctcgatcaatccgtgtctgtgtgaagttctttaaaagatgatatgtagagctgttagctaggagtacttagttgataggcataacaagatcaaggacatgtgtcacgattaaacggaaaaatattgtacctaccgatcccaaccgtttgtccgatgcttaatattgtcagtgtttttgttccttggaactcttcaatcgatatgataattaaactagtagacttcacaatagatagctagtagtagatggtagagatcgatgtgagataaggattaggaagagccaaaacaagtggcgtgtattatggccttccgggaggcagcctgttggcatgattgacatgtaaaatgcgtggttctattttggttgttgcggacgcggcgaaggacgttggtattgggctccagcactgtgccccctgcttacccgaaacccatcaaaatcacgttgagacaccggtagatacatactggagtagtagttttgagacaccgacattcatcaaaatcattgatagagtagtacaatacaacttcatcggtgcatcaaggaaacggtgataacactatttataatttccaaccctctatcctgtaccacagttgtcatgtttaactttacatgatgacccacaaaacgaaaatactattaatacgtaagttattaaattttaattattatttcatccttctcaaattgatcatcatatactccctccatatttataaaggaagtcgtttaggacaatgtttaagtcaaaccttgggaatataaatcatgaataactatcaagttgttgagtttgaaaatgtaaaaattatatgaatagatttgtcttgaaaaatactttcataaaagtatacatatatcactttttaatgaatatttttatagaaacaagaagtcaaagttgtattttggagaccgtatcgatgtcctaaacgacttttttttagtatggagggagtatgtttatacatcaagactaataataatttaaatttcatcaatcaagataccatgtacacattctcccacaatgcatgtatcgattaaaacaccatgccatctacacattctcccatgctgcattaattgtattatgatgaaactcgtgtctatacggttatatgatgatcaatttgagaaattttgaattatattatatgatgatcaatttagaaaggaggaagtacaaacttaaagaatgaatttatataatattttaaaataacttatactccctccgtttcacaatgtaagtcattctagcatttttcatattcatagtgatgttaatgaatctagacatatatatatctatctagattcattaacatattgatatggatgtgagaaatgctagaataacttatattgtgaaacagaggaagtatataacaatttttcggaggaatcacattgtttaactatagaattgatgagatgttgacttgttgagcgtagctgcatatacaggactcaccttacctggtgtgctctgtaataaatgtgtaaactgtaatggaaaattgctaagagagaaggcttgcctttggccctgtttagttttccaaaaacttttcacaaaaacatcacattaaatctttggacatatgtatagagtattagatatggataaaaagaaaaactaattgcacagtttgcatgtaaatcgcgagacgaatcttttgagtctaattaatccataattagctataaaatgctacagtaacccacatgtgctaatgacggcttaattagaataaaaagattcgtctcgcgtttttcaaacgagttatgaaattagttttttcattcgagtccaaaaaccccttccgacatcaagtcaaacgtctgatatgatacctaaaaattttcatttcaccaactaaacaggttatttgtgccatgcctgtgcaactattttaagagaaaaactcagcagtaactaaaaaaagaaatgatgctattattgtaatgcaagacctgtattttattgttatatcatccctgtcaccatctccatccatcctactgtgatgaaatgttggatgtgtatctctgctgcgtatcactccctccctccctccctcctcacagcaagcgcacagcacacacacactctcctcccgcttttccccacctcgccactttcttccctccctccccgcttttttgcccacctaccagcagcgcagccgcgcacccccccgtaacaaaaagcacccggacctccatctccgcacctctctcgcgtctctcctccttcccccaccaccaccgccaccgccactccattgatgctagatagggagcaggggcgagaggtgggcagccgcattaccaaaccgggagacgccgcctcgagctagtgctcgttgcagcagcaggaggaggtggtggtggtgggattccagagggaagaagaaaaggttgcgggagcaaaaggggaggagggaggcgagggccgaggggaaaaagggagaggagtgggggtgaatcatccaatccacagtccagctcctggtgtgcagtgcggcgctgatcggttgaggaggtgtgagcggcaaggtacgcgtggccgtcgtcgtctccgccgccgccgaagccaccgacacgccggccgggtcgatcggagccgcgggtcagatccagttcacgccggaattgcggcggattccggcgaccgtgaccccgccggatctgcattccgcgtggagcctccccgagccgcgccctcgcctcccgtaaggctccgaatccctttgctgcgtgcctgcttaattttttcccgtgtttttccttcgttgttgctaatttgcagccctgtgattgcgcgtctgtgttcctgcaatgcttgcgatttttgttttttggtctggattgtttccaggaaattatgctttgtttgaggcttttacgtcggttttatttttgaactttgaacagtagtactagtgagaagtgcgctgcgagctccctgttcaatccgctccatctgaaaatttcactgtttattcttatttccagtttctgactttttttttcccgttcaccggtcttcttctttttttgccctcccggactttgcgcttcgtgtttccttgtcttgtttgggccaaagaaactactagtactattatgatcaatgggcagtgaaatcaaatcgcgcggtgtcggttcggcaacgcactgtcgcgcttgcgagggtggaatcaccgcgtcgtgctcgccctgttcgggcgcttcccttgtccttgccgttctcgcgctccgtctttaccccctcctcgacgagttcttcttccccccgaacattcaatcccatccgatggaacacatggtacagatttaacccgtgaaagaatccggcaagtacggccagcttcacttcatccggtgggggtggaatgattgatagaagtagcggccggggagtagtagtacagcgctgccactgcgagattagtaaaaggagatggtagaaaaaggacaaccccacttgagcccgcaaggacgagggatttattagtagtagtgagtaggctgaagtatagcgcatctggtggctcaagcccaaatctgcccagcaaataccgccattaatgggcgtatcatgatgcttagagagtggtactggtactagtagtagctctccgcttttactccggctcacgcgcgcgtcctcgatacgacgactcctactgctagcagatgggacggaatgactgatgatgaggagcagcagtgcagcacagtaagaaaccaatggatccttcttccttgacacggggcaaggcgagcagcagtaggtgtccggtcatctcggcggaggcttccgttccgtccggcctaaccctccggatgggcttaaataaacattcgctgtcccacgccggcgatttactctcgcgggcgtcttaggtggcagccttaactgactctctcttcgccgagcgacagtggcgcgcgattgccgtatcgcgtcaagctctacagcctggtgatgctgcatgctgcggccatgcgcgcggtgatggtccacggcgtggatagagagatactggccgccttaattaagccgctctgtgcgtgtgtgtgtcatgagtgcgagaagtacatggcacggcgattacttcccgcgttcgacgttctggcatgacggtgatcggatccggtccggtggtctgcgctgtgcgccgccaacttggtcgctcgtgggggccgccgccgccgcgtgtgctgactgtagtattagtaccctttgttcttgcttcaaaggttggatttcttatgacggaattagtagtggcctgggcttgtcctatcctatactactgttctaggtctattgtaacagaaacctctgcttctggatcatcgggtgtgtgtacacgtcgccagtggatggaatgtatgactatggagccgtgaggtacgcgtggtttatgtaccttgcactttgatgagtgataaaggggtggttgattatattattgtactactcaccatatatggtggaattattgtgcactgaagtgtgtattatacttgcccaaccactcgtctttcactgttcctatgactttttactatatgcaatttgggttctttccagcagtatcaattatagaagttgtatggggtgcgcaggaaaatgtttacttattttggtggttagttcttttgtctggagctatatgttggttgcatgatatatctttcttttattttcaaaacacacatcgcctcgtgtcttcttttcagaactgttaatcctgaaacttttcattggtgtacaagaaaaacgtttattttgatgtgggttacttcatttttctaaaacattacatctgatgacatgtctatctactgttttacctttgtattgttgtcagagttggtgacaatataattagcttcagataatttgtccacctttatgctggatatagatacttactcgtcacaattggcttatcttgatatttaccttatcgttagatacattgtgcctgatggatcgtcgcagctggccatggaagaagaaatcatctgacaaatcatctagcgcagatgcttctcaaaattccaatcaagctgagcaggtttgtgttgctttcggtgttcacctgtagttagaatccttgagaaatgccattttacttggaggaagtcccaatcacaaactgtgacttattaatgccattttattaagcaaccctgcttgtacctgtgggtgctgcaaaatttgaagttatggaaagtactgggttgcaacgaggccattttttttttgactaaaacgaggccatttattagctattggactggtttatttgcattttgtccatttatatttaaaatgaaaataactattcatgtttgtggtagattcgttcatgattgattttgtatttgctgatttagttttatataggccctctctgatgctcaattaaggactacactatatcactcacatagtattttgtttcattttctttcacccactgtaccgcagaaagacataatttttttttctacatataattttgtcaaagagcaactcattgcatttttgtttgtggcacacaaaatttattagggaaaatttagattatgacatattttgctaactgctaaagtacatactgctgtgtggagtcagtagaatacccataggggacatcggtattaccagttcatttgatatttgtttgcatttattcttatctctaaagctgacattataaatggaattgtctactggtgcatcctgaaagttttccaattttaccttacctttacatgtttatttcttctaatgccatgtttccacttttcaggatgacaaagctccaaaatatgtgcagatttcaccagaaacatatgcacaccttactgaatcagaagaacaagtgaaaaccttaaatgaaaaggtgaaggccttgaatgaggacctctctgcggcacagtctgagatcactactaaagatgccctagtgaaacagcatgctaaagttgctgaagaagctgtatcaggtgcacagaggatcactatgttcttttactcttcctatttgagtagaataacttactaactactacttttattttcataaaccttgtgctagtggatgttggtataggtggtactgctctctttaaagtggaaacagaattcggccattcatatgttttcttaaaggttgaatgatttataaaactgctacagtagatgtatttttgatgggctatatgctttgtcatgtttaggttgggagaaagctgaagcggaggcctcagcactgaagcttcagctagaaactgttacattggctaagctagcggctgaggaaagagctgcccatctggatggtgctctgaaagaatgcatgaagcaagtaaggactgtgaaagaagaaggtgagcagaagctacatgatgtagtctttgcaaaaaccaaacagtgggagaagataaaggccgagtttgaagcaaagttacttgagtttgaacaggagctcattagggctggtgctgagaatgatgcactctcaaggtcactcgaggaacggggagaccttttgatgaagattgatgaggaaaaggctcgagcagaggctgaaatcgaagtcttgaaaaacacaattcagtcaggtgaaagggaaattaattcactgaaatatgaaattcatgttgtttccaaagagcttgaaatccgcaatgaggaaaagaacatgagtgtgcgctcagctgatgttgcaactaaacagcacatggaggatgtaaagaaaatatcaaaactggaagctgaatgccaaagattacggggtcttgttcgaaagaagttaccagggcctgctgcattagctcaaatgaaaatggaagtggagagcttgggcagagattatggagaaagcaggttgcgacgatcgcctgcaaagaattccagcttccatcgtcctatgtcccctatgtcccctgttcctgattatgcatttgaaaacttacagcacatgcagaaagagaatgagtttctgactgcacgtttgttatccatggaagatgaaaccaaaatgctaaaagaggccttggccaaaaggaatagtgagctgcaaacatcaagaaacatgtatgctaagacagcaggcaaactccgtggcttggaagttcaatgttgactggtagccaacgtaagagtacttcgaatcccaacatggatatccactttgatggtgcactgagtcaaaatggaagcaacccacctagtatgacctccatgtctgaaga

SEQ ID NO: 944 - DNA, 689 bp, Oryza sativa
atcatataaaaggaattgagatattccttcatatgggacaactttaagtcattttaaattctagtgactttgacgatagtaataatattacagaaggaaccggcggtggctgtggacactgacgagcgacgcgtcgtcgatgacgggaccacacagcgtgccgtcggacttcgtggtgtaggccatgctgacgaacactacccgcgtccgtttctccgtggccgtgaactcgagcagcccgcgcttgtagccgcccgtgccctgcgactggtacgtcaccttcacgctcccgcgcgacgcgtacgcctgcacggtcagggacccggagcacccgtcgccggcgtccccgacggagaactccagcctgtacgaccgcccgggcacggtgctcacctcctgcagcatcgccgtctccatgccggacaccagctcaaccgcgcgggcgccgcccggcacagcgtagtgcgccgcgtcgatgtacttgacggacttggtggtcgacaggatcgtccacggggacagcggcgagtagtcgtcctcgtccatgggcggcacaagcacgccccaggacgtgttggggaagatgtacgggccctcctcgaagcccccattcttcagcatgttacctggttcattttgttcgattgtttcatgactgtgagcacatccttgtattcaattttgtagag

SEQ ID NO: 945 - DNA, 125 bp, Oryza sativa
tagcttggggcataccgacgctgctggatggcgaacatgctgagcacaagaggggtgtcacaccctacctcctacgtcttctgtgactaacaaaaagaaaccatcgaccacatcattctcgactg

SEQ ID NO: 946 - DNA, 1416 bp, Oryza sativa
acatgctttgtgatgcaaacattctaaggaactgaaggaaggatatataaaagagtaaaatgatcgatgaagtgcgttggagaagtgaaattctacctattgtttacagtctgtcattatgatggtacacgcttgaatttgacagggaaagggtcaacacggagttgcacacagatttttgcttgttcattgattagcttgagggcttagtataatcatagctagttacttccgtaggcatgagggttgacgtttacattctcccagagaagtacaagcaagtttttataatgctcatttacctctcttataaacatgtaatgccagcaaattaaagtgaatgcggaggagtacaagcaagtttttataatacccagttacctcttttaagtatgcatgcaatgtcagcgaagtgaatgaatggtactcactctgttccaaaatacatgttcagatttataactagaaattgttatattttgtaatagagggaataatagattcatgtaatcggaaagatcatgctaaaatgggggaacagtgtaaacagtgaaccataaacttgattccagagtttatgcagttgctgacacgcaagaattctaattaattccattgctttccttcatatcctacatacagcagcagacagcatcacagcaagagaacggtcatggatcacgtaccattccattcatcctcgagttctgatccaataggaagtgccctttccgtggcagataggagtagaattgatacctgatgaagacttcacagctgaaacctacgaaggcggcaggtcacctgatcataccaacatggcgtcagctttcagtatgtacatacttctcgtcaagtcatgacacttcagtatcgacgaatataatgtatgacgtccacctgatcatacagactctgtcagagtgattatgcgccaataagcagaaatttatagcacaaggcaaggtggaacataatacaaaacgtaagatttaaaggtagatgtccttggaatcaaagtatagtgtcaataccaaactcgtgttgcacatttggcgtaagaaggcaaatctcctccaactaaaaaaaaaactgtgctacgtatttaggggtacatgttgggacagatatcaaaatataatttctatatttaaaaaatggaaatctgaagatggcgtgtcacatactcacatggctccattgaacagtccaaagtccactgcctactttcaacactaatgaaaaacgtaccagatactttccatggaatgctagtaaacattagctctgaacccgttcaaaatctttatctttcaaaaggatcttttaatagaattgcaccaatccagctgagcaagcaacagaaatgctcattttgaaaatacattgcactgcttttacaggtatgggcaatag

SEQ ID NO: 947 - DNA, 4711 bp, Oryza sativa
attcaatttaaaactattactatagttgatatctactccagttcagattcgtagtactaggaaatgtcagattcttatattttgagacagagggagtattataccaaacattcaagtaccaagaggcaagaatatgacttcagttccagatacttctaaaaaaatacaatctctaaggcaaaatgacatccagaaaagcttcaatactgacttcatgcttgatccaatattctctccatttaaatcagccatgttggagtttcaaacaaacagaaactggcataacactgcacagttggtctgtcataagttacttatgtctgcatataacatctcacgaatttggagctagaattgtcaaaccaagctagttatggtactaactgctatgggctaagagctactgaatcagcataatcagtgcaagagtaatacatcagactatcagatcattatgtaccgcttcgttgcagacaattgctaaggcaccactgcagctttaaatcctcttcacacacacacaaaaaaaaatgacacaatactgtttaaacactaaacagtattttcttttgcaaaatgacatcaaatgatgttatgctgggctgagaaatcagcattagctgacggagatctaggatactaggttgcatgcaagatactgtctagttgcaacatatctggtatgtatgattctctgaattagttttctcaaaccataacaggaaggaacttagcaatacaccatcaagcaacaaagatgtatttaaagaaattattaagtaggttttaggactcctatgctttttaagtcactaaatagcacatttgggtgggcttgatacattttgcactagcaatttgcaccgaaatttgaacaaacagacatgttaccttgaaatttagcgagattcgtcaaaaaaaaaaaaactgagacgctagtgtcaacataatcctgacataattttggcaactatcaaaagtatactgattccaatgaacaaccaaatatttagaaccaagtttgtgaattgttggcttatgcttactccatttgttacaccataaagtagacataagggcagggtctacaagtactgaaggagacacagaatatcactttctgatatttgctatacagactaatggttcaaccatgacaagtcctattcactggagcttctatgccacttgatctttctgtacagccattctctcactcgcagacatttgataaatatatggatcatttacaaaaaaaaaaaaagaaggagagggattttcaaacaggagatttggtgattagttcaacaagccaagggaccaatgtcaaaagagtcataaaactaacaacatatgtcctagaatattagtgcaatcctattggtacacctatcatattgatgcatgcaatgcctactccaataggtagaaaccactgttagtaaaagaaatagaataagtctattcttgattcatcattactgaaaacggtaactttgtacagtatggaggatcatatgtccagtttggaccacatcatctaactgaatgaagtaccattattcttaatttgcgttgaagctcaacataactgtatcattgttcttagtttgcattggagcccaacataactgtctagagaggagtgaaagcgaacacatcatttaatttgtttctggttttagcttatcataaaatatccgagcattactcatagtcactatagttggttttatagatgaaattaaggttagacaaaaatacgttaaactgtcatgtctctcccgccaattgttccatattttcagaacataataataatactctttacaacataaattgaaaacaaaggcagtttgacaaatgccaaattgtctaaaagaaatggcaccaaacaagattatcgtaatccacagaaatgacaaatgttgtctaagatactagataaatatatctaagacaataaaatatcagccaatgaaagaagctaaactctgctgaacaaaccaatcaaacaagaacatgatatggcaaataaaattacatccttcattcaaccgatatagctagtaccagtagcatacaagtgtattgactctgaaatgctaggataagaagtttagaattacaaagcattttatatttactacgttctgaaggaaggtggtaatttatgaaggttgcaccatgtagttgtagggttattgcagctcaacaatgccagacaccacattgagcggtgaccaagaatccttagtgattaagcaaagcaactcaccaatacttcatattgacttattgagaacaagtcataatcaatgcaactaactttccagaaatgaaatcacaagatatgccagcggtgttgcgtgaaaattcatattttggaccgttgctccgatgaatcggagacagtagatgcatatatctgatcgaattgcatgaaatagactataaatttacgatagtcaaagtgtaattaatagtaaggctcaagaatcaagatgtaaactacgagagaataaaaaacaaattcaagtgtagaattattaagcaacacaatgtgctccatgaatcaaataattttctcaactaaatccaatagtaaaacatcactaaaaatggaagtaaccatacaatatgcaaacacttctgttctacaaacatgaaaaaaaaaatctgcctattgtccaagagtaccaaaacagtaagaaaaagacatgagtttcatcaaagaccaaaactaaagacagtcaactgattgtcttctggacctaaataagaattgaacaataaatggattcatatttaaaagagaagtaacctgatttcagtttttcattgatagcccaatcaagcgctcgttgtgcagcttcagtcaatggtgggtgcataggactaaagtagaacatttctgatttcccaagcacatttgctgcctcctcgcgcactttgagcagcgtaattccattagcacgcaaaagttttgctgcatcactagttcctgtaagcaatgaagttgcgactaagtgcagtcccatgagcataatgaagtagcaaaccaaaaaggaactacgaatgctagttcaacagctgggtactttcatggtatatacgtcaattacagttttaagatgtcaataagaactcctgacagtttagaggcttatatcttatgtaggctcgtgaacatagtctcagagcacagcgcagtttgctactgtcccaacaaatcaaaataaaacctgaaaaaaaacaatcatatctgaaccactgaaaaccaatcaaaggttgaggctagaattgcagagtttaccaacacccctaaattatcatagtctctctccatcttatttttatagaagacattggatttatttgtggacgccatcacacaaaatctacataagtcagcaagcaaaggtctaaacattgttaacattatgaaccaaaagggttgtcttactcccaactgttttacattgaagcatgtttactttttagacagtttactgtgttatcctggctactcattctggaagaaataccaatgaggctacattaaaatggcctttttttttctttcttatattttccatgactagagactccaggtgtcactattgcggatgtacatggatagaacaataggaacttgagaacttaataactctgcactcagatgatgaatattacaacctataaggcagatgatttattattcgatagtattccattgtgtttgcatttggcatgctgctccatatttttcaacatgcatgaggcatgtagacgtgcaccaaaattaccctgacttctacagttttgtataaacgtattttaagtaaggaaaatgccattatagtatctttgtaaaaccttcatgccactacaaaggtttaacccctatagccttgtatatcatattttttctctttccccactcatctgttccaatttccatcacaattcacaaataattcacccccttaggcaccagagatgcaagcgaacaaatttcagtgataatccaagatcatttgcctcaccctcgacaaggatgcccatgaggagtccttcagtgccagtggttgggtacctcatcttccgagcctccagctccgccattgcaaatgacctcaccgctcgtgatgaccacctaaacccgtgtcagctccccaatatagacagatggaaccggaatatcaagagaaattgtactcaccggatcttcttctccccagaagccacctctggattcctgaaaaaaacgtcaatcaccgtatcaaaagtggcaggatccaaaaatacaaaactcaaatctcgcaatcgaattggttactcttatgagctaaattcgaagagagggactagggactttgagaaacacccgaagtgaaggagtatttcatgataaacattgatgagtggggttgggagcattagtagcttgctcttacgcggtggggagctgagcgacgacggccgcgacacctcggccccgggagcgggaggcggaagttggggaccccgcggcagcggccctgagggaggcgggcagcacacgggctgccaggaaggagacggaggatgagggcgcggtgtggtgcggcggggaggaggagaggaaggagaggaacgccgcggcggcggcctgggcggcggtcgccatggcgggcggaggttttcgggggaggggggggctgcagga

SEQ ID NO: 948 - DNA, 19781 bp, Oryza sativa
ggttctgagggttgataggggaagcgataagtcgatgcggcgaagacaagggaagaggaatgtgagtatagcttcgttgcaacttgcaaaacagcaagcggcacaatcagcaagttcacaaccggtctggtgcattgaagttacaacaaaattcatggttccacttccatcctccgaatatcgatggctcgattttttgctgtttatgccaaaaaaaaaaagtaacacatgcatgtaaatactttttttttggaacatgtaaatactattgaaataatattaaaattttctactacgtacttcctccgtttcatattataaaactttctagcattgtccatattcatatatatgctaataaatttagacatatatatgtacctagattcattaacatctatatgaatatggccaatggccaatactaaaaagttttatgatttgaaacggaggtagtaagatatttgatcttatactgataacttattgaattatagacatatataaaaaaaatgtattcttgtatggttacaaattatgcaacttctttaaatataattgattaaactatacttcatgagaataatttgcatgtacattggaatagaacagagcaaatatgtagagaagttaattcttattgtagactaactattaaaattgttcaaaagctcactctttatgaacacattgggatcacttcaaacaccaccatgaccatgaggcaacatgatgctacaacagtagaaaattaacttaaataaagagataaacaacatgcggattgttttgcgttagtgttttcttactgagaatattatatagggacaaatgattacgagtacataatgagaaacgcccaggggtcttcgggctagctccacaaggtggtgggctagataacctgggttcgaagcctcatccattataattatttgatattaggtcattttctaatagtcgtgtttttgtagttacaaaatgggtaatcggcacatattggctttcttcaattgatctagttgcattaattctacttgtaagttatggttgatcgtactttgagcggaatatggttttactctatttttttagaacaagttttactctagctcaagtcgaaaaaaataaacaatgctccgctttaacggactaattggcatgtagctacgattatgtactccatactagtctactagctatattttgagacgaaggaaatagataatagtgaacccgcaacacgacaatgtatttgttagctatgcatggttctaagtagacagatacaaccacaaccttctatattagctttatatggaactagggatgttatatccaaccttgtcgacgagggcacgtaatctgctcgatcacgacacacaaagatcttagaaatttggagcacttgctagtgaaaagctcactaggcacaattgttatagtgttgtgtcgctttggtcgttgccttcaaagtctagccctgcctattcgacttcgtctagtcgttcgggcttggctagcccttgcgtcaagaggctgcgacctacaagagtgagcgagacatttgacattgtagtccgctgttcatcttgccacgacaacacatcggcacccaaaatcccagactttcgagtccccattgttgctggcttgctgcatgttcatcttgttgtctcgctaacgcctatagtccatgacgttgtcagccgtccatgttagacacccatgcaatgtcgcaatctcagttttaaattggacatatgtttttttaaatattttataatcttaatttacattttgtcccgggtctttaaattcctaaatacctaggcctaaagtgtgttggttgagtttctgtgtttttggtgagggttgggagcccactcacctcccagacgaaagacatagcagtcgattagtgcacgattaattaactattagctacaaaacataaaaaataagttagtatgatttttaaagcaactttcatatatttattttttttttaaaaaatacaccgttaaacaatttaggaagcatgcgcgtgaaaaacgagtgatgagatttcacgtgcatgctttccaactgctaaaaaatgtattttctgtaaaaaaaatttattgaaaagttgctctaaattttctatagcaaagggttagcttaaagttgagagctcccgtcttggaacaacgcacgtgcccttatgtacccctgacaacgggtcccccacagagtgtttacaccagtagagtccccgccggtcagtgtcagctgtggtcacggcagtccccgtcgtcctcttcttctaccagcgggccgcaggcggagaacatcgggagcgagcagcgcacagcgcagcgaggagcccagaaggcgacaagacagatagacagaagccattcatatcgaaccaaaaaatcaacccacctaaccaactgacatcccgggtccaccgcaccccatctggcgggtcccacacgcagtgaaacgtgggtggtgcaacccgccgcggcattctgttgcggaaaagagagagagaccccgaggatgacgaccggagataggagtgaaattggaagaggagaattcctctttttttttttctctccctcccccaaaaatccccgagatgccgaagaggacctcctcgcattcccccaccgtctccgccatgaatcccctcctcccttcctcctccttccccaaattcccccacccggacccaaacctcagctccccaaaccctagcccgtgtagctacctcctccacgccgacgccgacgacgaggcgctgatccaaatcccgtgcccgaaccctagctccggcgcggcctcctcctcctccgtcgtcctgccgcccatcgacccggcgccgcacatctcatcgcagttctacaccttcaccgccgagtcgcacgcgctcatgctgcgatgcgtcctcgccggccgccccgcggccgccgacgaggtccgctccgcgacgcccccctccgtgctcgcctcgtggcgggcggtgtggaaggaccggaacgaggacacggcctacctcaccgcttggaagcgcatccaggacaagctcggcgcgtcggccgacgggcggtccctccacttcaagtccaaccctgggcagcgcgtctcgcacgtcggccagtggcgggacatagtctcggaggcgcacgccgaccccgacctgctccgccatctcgggctcaaggacaccgtcgaccgaatcaagcagtcatggaccgtgggtgccaaattctacggcattccggagtcattcgtccgtgtttgtgtctctgcatgtgctgtatgtaaggccgcacctgcgggacagcctgattttgctatgtcatcgccagggcgggggaaacggcgccgcaggtttgaatatacggagacactagatgtgcccgcgcgagatgttccacgccgactgcaacagttggctgctaagcataaggtggttctctgtatcaggcagaagtatataaggcataaaccattcatggccgaggtgaaagattatgcatgccaccgtgctggggtgccaacttcaagtggtgtgaatgctacgtcttcttcaggaagtgtccctgatgggaagaagacacgagtattgaagcgggaaccatatcaatcaaagaggtgtggttgtgggtttcgtattcgggcaattgtgccaatagctaattacaatgagaaagacaagagttttgtatacgaggaggagggtactgcagtgttcaagctttatgcagtgcattcagggcatgagccagggccacttgatggcaatgcccgaattgttcataggttagttgggcataagggagctcttgagttcgatccagacatttatggtgtcagtgaggaaggagatcctaactttacgattaagggagattttgatgttgaaactgatgattcacatcttgcagttttgcagcaaattcgggatctcaaaacagaggttggcttgttagaagggaaggtgggtaagatgcacccagagcttttgggttcactatccaatgagctatctgagtgtttgcacaggatcaggaagtttaattttgatggcaatgtctgccagccagaagatacactgatgataggcaacgaggaggttcctggatgggggccagctgacgtttctcaccatttagatcagcatgacggtgcattctgcagggatgatgagatgcttgatgatgacgatactgattttggttcaagtcttgggcctattgtctcgtgggatggaatgacggcagaatgtgaggataggaagatgctcatgagtgatagtccaaagtgtgacaaatggatgctcaaggaagacgtgggcgactttgttgagaagagtattcttaactgtggtgatgacgatggtgtggaggattcaaaaattatcaagccattgatgcatgatgagaccatggtagctgacccaggtttggtaggtattcatgtagaaggattctactctggagccaaatggtatgattcaccggtaggtttggattccagtggtgatgcagatgtcagttttagacatggtggacttgtgtgagatgtgattgtccctgataccaggaacatcatgtaaattctgtatacaggaggacatcagcttgtaccaatttaatgtagtatctataggtagagcttgaaccaaagtgacctgcctgccctgatatatacatgctgcatttatcgactcaacctttgtttaacttatgtatagtccccgtgtgggtttccatcttgttacaagacaatataactttggttctgttcttgattagctatttagtcataacttaatgttttgtagaactctcaccctccctctctctctctcacgtgcgtgtgggcacgaatgtgcatgtgcattttgtaaatttaatgcaaggttttgcacacaataacatgctgtctctttactttgcaagaggaatctttgtcatctttcctgttcaattgcatctagtgtattagttattattaccattaactgtgaaaaacattatccctgttcatacctaaaaattgttcacttccctcttgtttattctagtacatatcatttgtgcaagaaaactgcaactgttctttgcgagcctattgaacatcactttttaatgacatggtattgactatgcatgatgtatattctcaaatttcatggtgttatatgtggtttactggttaattttggtgctacaagtgtatgtgtgaaagatgaacgttgttttgttttgtattaggtacccttctgcattagactgattgactgggtggatgtttactatgacagtataaatccttcattgtgatgccacatgaaatacataattatttattattcaaacattaaatagatcttagtgtttttatcttcttttgccaagtcccttttttcatgttataaattctactatctacaatattcattgagcgttaagatgttaaatattatttgtcaaagctcaaggaatggttgagtgtccatgtcaaatgcttcaggaacattttcttctgtttgttttatatattcaattctgtatggtcaggcaaggttcttttcatatttcatttaatcttttcaaatgctgatatatatatatatatatatatatatatatatatatattaacgtctgaagcataatggttttggaggactactgttatgcaaattattgcaaataacttttatgttctaaatctacaagttcactatagttcttcatggaatgcattctgtgtaattttatcaaaaggctattctggtaagcattcgtgattcccccctttgataagctagatttctgtttgcattaagcatataaatttgatagattttgaaggggttgccttaagtttttctcactttttttttctgtatttgcaggattgcaatgagttatgtgtcatcatttcctctgctatacacgtgtttattgttgatgaaattaccatcctatgagcaatgcccttatggccttaaactatcttaaccgtttaatcatgaattttctctcatgcagatctgtcagttaacttcgtcatgccgccttttctgcttattggcgtgatctggcgtcacatgatgcatcatcaggttgaggtctggacacaagaacccacatacattatttgtctgtttccattttgcgccacttgttacatctataatacaatttgatgcaccactttcaaatttgggtttaccccttgttttgccgccaaacatcatgctagacaatctccgttgttggctagacacataaaaggtaacatctgtccttcgtcagttgatccagtcaaaattgcagggattagccattcatgcaacgcatacctatcctggctcctgcatcgtcctattctgaacgtatgaattcttcatccaaacattacagttactttcctatcatggttgtgggagccaaaatggacccgtggccaaggaggctggagcaactgatgtgattagcagccattaactaagattttttttcctatggcaaaattagcaaggcaggatttgattagattagcttcgctgtttccttttgtcttttagaaaatatgtttgttagatcctggttatagacaccaagccatacactctatggatttaatgaagaagtaaccaatctaattccttccaatgtaaatcttcccagtctaacttcacttctcccaccaatctaattcctcccaatgtaaatctccccagtctaacttcacttctcccactaagggccaatcgtccttgtggtgtttccctgtttgatctatgctcctaacatttccagaatcttttaggcttattgatgtattgtgcaagtaacccataaaacctgatgtcaacaaaatacattccctggcaagaaaaggtcaaagacttgagcaacaaaagacaagaaggcactggttgtgctcgatttctttgattcttaagagaaataaataatgctctattgtgaggtgccttaagtaaaacatgtttcatatgatcatattgtacttggtaagtaccataatggaatatctaatattgtgacatgcaatgcacgtactgcttgctagataggattatatgttcaagtcagcatgtccaaacgctgttcaccttttgcccaaatgtcagccaggacatgggtccacattatgagctttcttcttatcagatatgcatgcaaacccaatgcttgaaagaaagctagtgtgttggggcataaatatgaaattgttaattcatgcttgtttttcttaactgttcatggagttggactgaagtaaaacttcttttcttcaggtaattgaattactatgttgagcaaactttggcatggcagtgctcaactaaacatctcgaaatagctttatgtgatatgctatattctttgcttgcagtcacagtgtgcttttacagcttgcttgtagagcgatggaataatccacctaacatgctcaaatattaaaaatctttctttagcagttactctctttcctagaatgtggcactcaaatattcatgattataatttctttatgaatatctagattggccggatgtgatgagatttattagtttctacagatatataaaagtggctaaagttgtgtcttggataccatttaaatgttcaacacacaattcattcaactatttgtggcaggaagagtactacagacggagtcattatttacacacagatgaaatatttagtgccaagtctgcagggtgatgagttagtatctattaaacatgcgagttttaaatccatttggctgacttttgcaagaattggtaagtgcattctccattatttgttggtaactgcaagaagtgtacactaccagatatagacagtggtggggctttctagtgatgtttcttttggcattttgctaaaggcaggcctttctggacaggcacaagttgcatgccgttgctgattttagtgtgatgcatgtagttgattgaaaaatgaaaacagtaccattttatgtgcaaccaagtgcattttattagctaacttagactgggggctgttttggtttataatagaaaatggaatctatgcatgcaacaaaaaaaatgttctgaacgttaacatgcttctccaaggcattgcatgttggagtagccagtaattaccactgagagatactcgctccttgcgattagaacatagttttaattatataccatatcaatttcttctactcgtgtgcagtgggataatattgtttttggtcattgatcatcactctggttaactggtcacatttggttgaggatttaacatcatttattggcaggttgtttgtgcagttgcttgttttggggagctggagcaatcgtggaccttgttaatcttccagaataactagttagtccgccaaccagttttctaagtctctgaagccagaggtacaagtggtgcctgatgatatatacttgttaaactgcagcactcgaatcaatgacattattttactgtccgtaaggcaacaactgagccatagtatatctcatgtaatcacagggaagcggaaatttcaacattttcttatgataatgtaagtttctctatgctatgtaggatcccgcagcttatctatatatggcgcagatctcctgaagatagctctgcagactgcagttagagctgagtcagagtaagaagacgtgataagggtgactcgaatcaatgacattatccaactgtccacagtccaacaactttgctatagaatatttcatggatcagagggacatgaaaatctgaactcaaactctttcataaggccatatccaagctggtgttgcaatggtggattcccctgctcctctattatataaggcatagatcctctcaagttatatctgcagtaagagtcagaggtccaagacgtccaagtgagagcgaaaggtgtcttttccagaagacactaaccgaatgactagcatggccacaatcacagccaaatctggggtcatcgccgtatcgatggtcttggtcatgtgcgctgcctctgcagctgctggcgacaacgacatgctgccggcggcgttcgacatcctgcagcagccggcgaaggaagccgccaacctcggccacggctgctacactcggtgcttcgccggctgctttgcagctgggttcgatggagattactgctcggacttctgctccaaggaatgtggcgatgatgtccggaagttcctcagccggctgtcgccggagaactccgctatcgtcggtgacatttgcaacatcccaaggtgcatcagttcctgcgtcgaagcgaagattgatccaccgtactgcaagatttggtgtgaggatatgtgcggtgatgatgtccggaagaaccaaatcgggctctcgccgtaagattccaccagatgcgtttctttcggtccgcgcatcaatagtgcctgcgcttgcgttcagttagcgctgtgatctttcagtagcaaactactagcaagtagcagtagcttgtgtcgtcgctctctgcataagtgtgcttgcttttgttcttctatgttcccgtgttcttccacggttccactgttcttgttgttgaaggcgtcaaggtgtgtagccgactcgtgcaattacattatcttcatttcgaccctgttatcagaagtacgtactgttttagttccttgaatgcagtgatgggcgtaccagtttccgtttcataatcatgacttggtgttctgggacctgatgtccattttttgaaaggtcacccgggtgattcagtagagctggctgttggctggatcctcatgatgttttgattcagtagagctgctcaattgaagatagacgagtaatagcaccatgtgttggtaaccttatatgccgatggacttaaaaagcgaaaaattggatagatctctaaacttgtatataatttttcaaagataatagtcgtgcatcgcgttaaatcttgtccgagtaccaagtacacatgatcaatgacgcatgcgaaaaaaaagagagagaagaatcaatgtgcgcctgaatgcacactctttgttcttatcatctgatgaagttccaatccgcaattctcttttctaggaaaacaactccagtaagaactccaaatatttcgagatccgcatccccgcacgctgcgtctctcactctctcctcctcagtccgtttcgctatccttttgtcttgctcgatcgtttcgcggactccagctgccggtcgatgatgacgggagcgaagcttgcggagaaccgatcgacggcccggcaatagccgccggcatgcgcatagtgaagcctttctccctgctgatgccatggcgggcgtcgggcgatcaatgaagtgcgccaccaagagtacgtacctcctcgtcgtctacaccggcgagtactaccaaatcatcctacttgatcaacgacgccattgacgactccctcactcccgtgcctgacatcccccgccctgagcccctgacagcctcctcgccatcgggagcggaacatccatcttttcacttggcggtggcgcctacgtcgtcctcgccgagctcctcatgaccaacgtccacaaatggcgccatcaggttcgttgacatgaagaggacacacggtcgctgaggatttgaagctggccatctggatcctgtcgctggactccggcggcgagtggaggaaaggcccggagtgtcgtgtcggagacatttgggcaagcgaaaagtacgttgtcatgggagtgccgcggattagtccgcctccggtgtgccctgtcttgcgcacggtcaacgataatgtcgtctgcgttatcgtgaacgatgccgacgagactgtgtacgggagtgtggatgtcatagcccagcattttcttgccatcgacgtggaacgtaaggatcgaggtgggtgctctgctgtccgtcgttaccaagcttcacgccttcaccctgatggtggggtagaacctgtacggctgtaccctaaccacatggcttgcgaattcagtgagtacatggaacactgacaggtatagaggtacaaataatagcctctagtactgctaggaccatccaaaatacttgtcattgtcaattgttgagtaaattttattttagggaacttttattatcaatgtttcattttgtaccatcctttaaccaatgattttactttaaatcgggtattttttttacctttgttttacattggttcaccctaactctcttctcaagtataagtatataaatgatcttaagtgcgttggctcctactcatcaataaactcacatagcaatatgcaagataatttctttggcatataacaagtttgatgtagatggataaaatagttgaggggttcaaaatatcacaaaagtaaaaatacccgatccaaagtaacaacattgtttaaagggtgatctaagatgaaatatcggtaataaaagatgacaaaaagtaaaatttactcttaatttttcatgcatatttagttctaaagtaaaaatctgtatattatgtggtgtaattaggatttatatgaaaggtgatttatctacatgtaataggtcaaatcaatggtggtccactatacaatttttatcatgttatgtattatatttagaaataagactacttcacccctaaagtattgatgctgatctacataacccctggagtatgaaactgggtattttattccgtaaagtatcaaaatcagttcaaataacacctagagtggttattgaaacgggctcttgaactaaagaggagactttgaaatgggctaagtattttattcacaagtgaaacgcccgagactaatgtaaattagtgttagtatagtaactttaggcttgtcgattagtgcgtgaaaagcaatagttagataaatttgggtttactagactaatctttgcgccacacaatcatttgcatgtcaaaactacctataaaaccactgtaggggttatttgaaccgattttcatacttcaaaggtagaaatctagtttcgtactttataagtggttaaatagaccaaccccaacacttcagggtattccttatatctactatagttttaactttgagttaaatcttaaggtggtccatgccctacggcagtagcggagccagaaatttaaatctgtggggtcaattactagtggtttgtatttaagtgggatcatttctctttattgttttggatttatacataaaaattgaggtttataggacgttttttaaaaagctggggtcggccgaccccacagaaatggcctaaatccaccactgccccaggtgccacctagttaactctgcatatgggcctatgatcccttcgatcacttttcattactacaatggtgtttgaaactgatggatattaagctggtgcatgtagaatgaagaaaataattaacacattattgattaaaatttaattattaaaaacttgacaaattaatttatttgataattttaatgtaacttttatatagaaagtttgaaaagtgtaataacggaaactgagttaaaatctgtacgtgttaaatatattattcccctttttaaatttatagaagaagttaaatatgaacgttggaaaacgctgaacaagtgaacatatcccgcgatccgcatttgttgcgactcgtttcgatcaactgattctccttcccggccggacatccacatcatcctgcgatcgttcgtttccctagtcgttccaggctttttcagctctactcccctccacccaggcgcaaatcatccgccatggctcccgcctgggtcttgctcgatcgcgtcgtcaagcccgccgtcttcgacgaagaagagagcaaaggtaagggagaatcgaccggcgccccagtgaagtacctgccagccagattaaggcaggaagtccccgccggcatgcgggacgtgaagccctacccagaggttgcggatcctcccattatatctcgcttctccatgctgatttcgcggaaggcgatcagggtagtgaaatccgtccgtgtccggtgcgccgacaagagccttgtcttgttctacgccggcaccggcttccccggcttctcgtcccacggctgccacctgatctacgacgccatcgacggctctctcactgcggtgcacacattcccctttcctgtgtccggagtcgtctgggtcggcagagccgctgtcctgcgccatgccggcggcggaggaggaggaggagacggtactaccgcctcctatgtcatcgccgagctgctcaggccgtttcatggctcccttcccgatgccacgctcgtgatgtggttgtcgaattcccccgcgtcgacctccggcagcaacggccaatgggtgaaggaggacgttcgccttcccggcgaggtgtgcacgggcaccgaccccttcaccaccgacttggtgttctcgttcggtgaatcgtgcctgtgctgggccgatctgttcatgggcatcctgttctgcgaccttgcgacgctgcgtgcacctcggttccgtttcatcccattgcccaaggcttgctccttcgaccccgtcggcaagtatggccggcctcacatgcccgagttccgttccatgggccgcgtcaacggtgtcatcaggttgatcgacatggagggttttaccaacgagtacctggccgtggatgaggtgaagctgaccatctggaccctgtcagccgacctcagcgagtgggagaaaggcccggtgtgtactgtaggagacatttgggccagtgaggaattcgtcgccatggggttgccgcagcttagaccgatgtgccctgtcctgagcatggttgacgaagatgtcgtctgtgtagtcatgactgaagtcgagattgaggagagcgatgtcacagatttcgacgatgagggcaacaagctcaagttcaaggcccagtacgttcttgacatcgacgtgcggcgtaagcgggtgttatccatcacccagcaccacattgaaagtatgggtgatcttataccagatctcatcgcctgtgagttcactgcatactcggagctctcaaaaggcatgcaggtattactactacgacacccaacatacttagttatttactcacttgaagtatattgttctgttaacacaataacactttccacagttctaatgcttggttatcatgtccagtcagttacatcttagtatctcacgagtaacggagtaagtatattaggctagttatcctactgaactgaactctagatagcatatgtgtgtgctaatcagccatcatgattgtctaatgccaaatgacttagctcttttgccatgctacagccctcctcgtccaaaccaggaacgccattttttcattctgttggtacttctaggaactggagaacgctgtcatagttactttcacttcactacaaagttgtgatggcttgtccagtagatgtatccaattgaattcttgattcagaattgatatagacctattttatttaaagatgttacatgtggtaaattcaaactgagcaccaagtcaccagcaaggttctgtaatgaaatttgtgaaaagtgcaatctatccataacgtgtgggcttggttggttttagctattttacttaaatgcctcttagaattgaccttatcagcatgcccttgtgtgagtattgctcattattattttagagagtacagacaaatggggccaatgataggtatgttgcggcgaggcaactacatcatctgaccaaacctgaccataattcttgtcgcagttgtacgaaaatctcttttcttttttacttctgaagtttttttagcgttgtgtgttggaaaagagatttgtctaactaaaattctctatgtaataagtatagaatcgtatcctctataccatagtatatggaaatatcatgtgtaccagtgtaaggccctaactgagttatgttactttccctagctggtactccctccatttcacattataagactttctagtattgcacacattcatatatatgttaatgaatctaaacatatactccctccgttttgaaatgtttgacaccgttgactttttagcacatgtttgaccattcgtcttattcaaaaacttttgtgaaatatgtaaaattatatgcctacataaaaatatatttaacaatgaatcaaatgataggaaaataattaataattacttaaattttttgaataagacgaacggtcaaacatgtgctaaaaagtcaacggcgtcaaatatgtgtagtagatgtcctaagactatctaggtttctcaatgatgaattttcatttatatatatttggccacatattaatttcctgtctagctctgttaattgtaactttggtatgcactgagggaattattgaagtggattaagaaccattaggccattttaaatttgtctagtttgacatacattaatttgtttctgctaggcaatggtggaaggaaatgagggtgaggaaagcacaaagcggatgaaggttaaatgatctctgcatcatgtggaacttcgatggtttttgcaacatatcaagtaggattaacattgaagattggtgtttgattagcacccatctatgtggaaggatgaatgtgatgtaatcattctctagaagttatgatgttattatcagatggtagtaaaactgaattgctagtgtgttttgttaacgctgatggttttaacattacttcatagctacctttgaattgtctggtcatgccgggctggttgatggctgactccgataagtgatacaagtggtacctgatgatatcttttgtcaaactctagcactccagtcattaactagttgtaaatggaatagtattagtacttatcttaaggcaaaatctcaaaatcgtacagtcttgttcttttatttaaaagaaagaatattctgtgcacaatcttggaactctgtgcggcacaatcttaaaactgtgtgctgtagttttttttttttaaaaaaaagaaaactatgtgctgtaggacgttttgtgtttatatcagactaccaagaaaaagagaagtgaaattttacgcatttccgtgccaatatacccaagttgctacagagtacagaggatactctgactcatactctctacgtccatttgatattttacttagtcaatttttttaacatgtaatcaaatttatagaaaaatatattaatattttcaatataaaacaaacatattatcaaattatatttaatgttaaatttaatgaaactaatttagtgttgtagatgttactaattttttctataaatttagttaaactaaaaaaattttaattaagaaaaaagttagacgttatacagtatgaaatggagagtatctcccaaagttagcacgggaggaagtcaactccaactctccagtgagagccaaaggaggcattttttgaaggcacgatcgactgactggttcgaaacaatgacactactttaggatatttttgttggatcagaggaagtgaaagtttataaaaaaatttcatttgaccatttccaagttgctattgtttggagtgcaccagtttctctataaaatgggctgatcgatctcccaaggttagctttgcaggaagagcttggtcctaccacagagctcgaaaaaaaaagtgctttcgagtagacacgagtcacacgatcgagtgactagcatggccacaatcagaggcaaatttgggatcatcatggttgcgatgatcttggtcgtgcgcatcatcgccttcgcatctgccagtgacaacgacgagctgccggcgttgttcaacatcctgcaacagaagcccgggaaggctgcacaggtcggctccgactgcttcgacgaatgctggagagactgcatcctagggacaccgtttacgagtttgtgcgaccagctatgctatcaaaaatgccttgttggttcccggaagatctgaagcaggcgcttgcattaaggttggtcagatgcatcagtagtgtctgcgctgcgcatctgcgttcagataacagcattgcgatcatttgtttcgtcagtaaattgagtataataatttggcattagcatgcgtcgtctctacgtatacatgagtttgctttagttcgagcattcacaatgtataattccgtatgggtattaaggtggggtccacaatatggataaagcaatgaaaagatctgtgcaatgtatggagcccttccaactctaaaaatgggatccacaaccatataattatttcgtttttttctcttccctatcagtgctctcgttactttgcctgcaacattgtaaaaaagaattgttattttatttggagtgtccgtcctcacgtgaagggccgatttattagggctagggtatgataccgccgcctgcaatgtatagagcgtgtgctacagtgaaaagattctcttagtacccttgttaattcacacattgcaggtgctcttagtaccgcttttttcttcgaggctccaataaatgtttcggctgttcaagccgtcatggtactacctctactatgctgatatcgagcctgttcactttgatatcattttcaaccatactatttttggtaaagttgctaaaaagtgtcttcgtttaatttgttgctaaatttgataaatacataagaaatcttgctaaaattttggtattgccaaaatttggtaaggtttattttggctacaatctgaacaggtccatcgttttgccttcatggatcaataattccctgtgttggacagatatgccttccttttccttgtttatgtcattaattatataataatgtcctgatgtgtgtttgcatttaaccatttaacatgaaagaacacaccgacccgttcatccgcagcaactcctggttggcctttagataacgtatttagagattagtaatgatttaggctccatttaaaagctatgcgacaaacgagagaacgtattttttaagataaaaaaaatactttcccttgattctagacttacaacttgcaaccattatctagctcctttgtgcttctgggcctcgccaaaccagcttatgcctcccgatggtcacggtgaagctatggaatgccaaccacaaaagtagatcaccatcaacttctaactctggcttaatcctcagccaggcgaataggatcgaagttagagtaggtgttgtttgcttcgagagggtggttatggccactctggacgttttggtgtagccgcgggcggagagccctagcttccggcgtcccgcgcgctccccatggatctgaacaaagcgacactctactttcatgaggccactggcccttccgccatggcagaatcatcggagctccgatgataacttgttttgtaaaactacggtcgttattaacgggagagtgaatatggactagatcctgattaatatagggttttttttgagatattatgtatcaggattattaggggcgatcagaaattttgcaaattgctcaaactaaaatcctagctattggtttttagaatacgtaaaagctctgcgtatcttttgtgtcaaggagagaggagttttaaacctttacaaagtattggttgagaaaacaaaggaacacaaaaggaaaggaaaaaaaaagagaagcgtgagccgatatgcgacaagtttggcgatcgataagcgggaggctcctcagatgggcaggccgaccgttgcttcttccgtggccgcacttgctacctctttccacgatttcctctcattattaaacaccatattgttttgttttgttcctttcaaatgtccaggctaccaagatgacaatggtgtcaaagcatctcctatttgctttgtcaaccttcttcctagcgtcgcaccaccactcaatgaagcaagcattgttggaggggaagtaaaggggctgtcaaatggtgtggagcttggatttggggcagtcgagaaggatgtggtcgatggtttctttttgttagtcacagaagacgtaggaggtagggtgtgacagccctcttgtgctcagcatgttcgccatccagcagcgtcggtatgccacaagctaggtgaagtatttgcactttgattgtgccgagctcttaatactagctattagtagctgtagaagattttcaaaatgtcttctacctactattccatctatccaaaccattattatttggattaagatagcaagtaaaattaaatggagggttgaagaagtttgaagttgtcatattttctatcacaaattttaaacgctgtaagtaataaaattattggtagctatcccatttctttcaaaatgcccccggcaaccggcgcttatgcctgtcgccgtctactccgacggccgcctcgtcgccgccatggtccgatccctagcaggcaccgcctctcccctccctcgagctacatgttgccaccacctcacaagaaaaaggacaatatataccactccattcgttgggtttcgataaaatgccatccactacgatgcaaaagataaaatgccactcagtaggttatcttcggtatatttttgccgctttgagaaggcttaagactaaaatacccctgttgtggagagagaggaagtgagatagaagccggacggcggccgtggtcgccggtggcgagcacgcgtggggcgggcggtggaagcctgacggcagtggagaaagaggaagagagaagggagccggacgccggcagtggtcgctagcggcgagtgcgcgg

SEQ ID NO: 949 - DNA, 6637 bp, Oryza sativa
ggctcccctcttccttcctctttctccccacagcagggttattttagttttaagtcttctcgaagtggtaaaatatccccaagataacctactgtcattttattctttacatcgtagtggatgacattttatctaaacccagcgaatagagtggcatattatcctttttctcccacctcactgcctcccgtatcccgaatcctactaccatcctccttttcgtcctatcctctcccagaccatggggatggaagcgccagatctaccggcccctccgaggtacgcgccactcgtcaaactccccttttctttttccagtaccccaagatctgtcaccaccgcctgccgccaagttctaaacaatgcaggattgaggtggagaactgcttctccctctctgaaaatacagggtccatggtggacatgatcaatgtcgcggcacgatgtgcctttttactttgtgcaagtgagatttcatatgatgttggagaacgctacaatttcgcgagcattctgcttcatttcagatacacctgttgctcactgcacaaactcctggtaattcccatggcatctgatgtgttagtagtgtggtatgatgcttcatgaatttatactagtactaatgtgctagtgttagttatagaatgtttattcatcacccggttctttccagaaaatattgtacagcttatacccaatcttatggcttgttttcatctggagtgctcaagcctcaagggacatacatgtattactgctactaccaccacttaacaagttacatactcattttcatctgaatcacaattctaatacttgtttcttatgcccagtcaacactaacttaaaccagttaccagactgaacattagataacaaatgtcccagctcccttatcatactagtggttaatctctcacacgtcatattaacttagaaagatgctttaaatgataaccaagtattacaactggtgcctgatactctgatagaaacctttgttacattctaggactcggataaatgacatcatctattatcaacaagggataactcttctgtagtaggatatggatatccatgtgaggtcatcagagtagcaagttgatggatcatcgccatgatgctattgctgcatacggaagatgacctgatttatctataaatgatgcagtggtgctgatgaccaatgccatctctgcatcagtcaggtccaagtgaaagcgaaaaaaaggcttttcagaagacaagatcaagtgactggacggtcacaatgagagcaaactcgggacttatctttgccgtgatgatcctgataatgtgtggcgcatctgcagcttccagtgacaatgatgagctggtggcaccgttcgacacatccaatggcctgagaacgctgtgaacggccacttgggctgctaccccgggtgcttcagagactgtgttacaaggatgcctgaatgctgttctgtgaggaaatttgctgtcagcatggccgatctccttcggttcacgcatcagtaattcatctatttgcgttcagataacgttgtgaccatttctttcagtagcagtagcttgcgtcgctctccgcatgagtaatcttaagtctttggcaattcactgtaatatatactaatatgctcttccgcggggtcccccattttaattcttcaagccggcgaggtgtgtaatagattgggatggcctatggccgtgatctaagggcagttgatgtttgtgaattcagactgttcctgtcgatgtcatggaacgcattgtggacttgtgcttggttgtatgaggtgatgtttgattcactagcagtcactgttggttagatgcaaaaggataaatggcgtcttgcattgctgaccccttactggttgcagtccagatgtaaaaaaaaaaatgcagatgaacttagaagaccttggacaaggataccaaactttaatacccatgtgtgtcaattactccattctgatctgaagattgactttgcagtttgcaatcttgctaaactgaagatagctgtaagtatggtgaaagaaaaacaaaagctaaaaaaaagatgttgtccggactgccatgtgcattgtattctacaaggcggtttttgcagggagataatagaggtgcacacaactcgagtattctgaactctcgcatatgatgcaagtggcattcgcgagttacttagtgcgatgaccacagatctcgaaccaatgatccattttctttttataactatgatccaatgatctgcaaccatagatgtattcccatgttacctgatacaataagatgtgtcagttcatctatataagacatctacagtagtaagacgaaagggagccaacttctgtagaacagtattagagagggtcagtattgctcatacaacttgtcctatatggccgtcactacaacgggatcaaaggccatcgcggtcgccttcttgtgcatcgcctgcttcgcccttgcagcgggcgccgccgccgacgcgccgcggtggcttcacatcaatgccgcgcgcgtcggcacgagctgcatggagtgcgtcctctcctgcatctccggcgggggcctactcgacgtgtgccgttctctctgcgaggatttatgcgatgatccagaagccttcacagtcgtaggtagcagaagcagtagtcactgaaacatcgaatggcccatctctgccagtattcagattgccgtcgcagtatcctcaggtccatcttaacttgccagctctgtccgctattactggttttggatcctggatgaatgaagtgatgtatttgctggttctcctgtttatgcactgtcgcatcatggccgtgatgtatcatgtatgtgccctgttcgatgtgtgtgtttgactgacaatgctagatttgccgagccaaagatgcctccgacttgaccctctagaaaggcagaaaccaatttgtcactacagatctgcaggcgctgcatgctagcagcaccgtaatttacagataaaaaaaatatgtgttcaacctttctcaaatcactacagagtctgtaactgcttggctgatcagtttggatgcacggactcaagtcaatcaacatccattctgatcccagcgacagagccactacttggctgatcaggcaatttactcttgtgtttcaatagttgtaagaatcgatctactagtatcattacctggtcgagattcgagagacacgatgaataaatacgtagtacggcatagtgctcgaggccaggtagcagttgttcgacctgtgcggatagtttcttcagaaagagaatccaagaaacaggcatattcgcaggcgcatcgttgccaaccgcccggaacaaacgtcaatcaagtttgtcctacgaacgcttcactcctcgcctccccgctccgcgttcttgcggtggattcgcatcttgtgaaatgcgaatccaaccgaaggagaatcggttctacaaatgttcgctttcgcctgaatccaccacaattgcgtgcatgcccaactcgaattctacgaggaatcggaatcatgaacctctcaaccacgattacttgtcagttgtcaccaggcagataacaagcacatgcgtgtaacacctcaaaaacagattctgaaatgcgaattccaaagccaagtggctacctgtacatcgcaatcaccaggtcggttcaatgttagcagtgtgatcacgcattcacatatatgagacccgtgaggccgtgacaaacatactgaacatatgttggaaatatggtcataaatcgatatattttaatccaaaatgttaagacaataatcatgatataaacagtgtagtgtgatccaatgacaacatgtaacattactagtagcatactaaagacatcatgaacaacattatgaatatcaggaataagaacatagcagtaacgcagtaacatgctagaggcatcatgaatatcaggaacaggaacatagcaataaagcgctaacaacgagaacaggaacaggagaaggatataccctgagaatggccctccgctggattgtgaggcagaactgcctccgttggcattgttgttcgcggcaccggctccagctcctggcgcaccacctccagctccagctccaggtggcgcaccacttccgccatctcctccagcagcagcagcggcgccagctccaggcgcagacatggtgggcgaggacgaggacgagcagtcgtgcgggaagcactccccaaaaacctgatcacctgcctacccggtacgcagatctcaggcgaaggtgtggttccggaggccctgctccttccgatctctcgtgcacgcaagcgatcagaagcgaggaggcgagagcagcacaggcgcggaggaggaggaactaacacccgggaaagaaacagcacaggcgcggaggagaaggaactaacacccgggaaagaagcaagcggatcgttctgatcggactcacggcctccttatctatcaggagagaggcagtcatgggaacgtgggatcatggacgcgctgttgtggaggcagtcgatcggactcacggcctccttatctatcaggagagaggcagtcgtgggaacgtgggatcgtggacgcgctgttgcggaggcagtcgtgggaacgtggattagtggttgcaaaagagtagcgacgtgacgcacgcacgccagccacgcctcgccctcggcctcggcccggtccggcgcgcttgcgcgtgtggctttccgacccccacctcaaccagtcaacagggagcctccaataactccctatttaggttgagatattcctcgcttaaatcctgaggtggtattattatccttaacacttattatgggcctttgagatttaataggataaattgggcctagcccatttattctaacaatccccaccaaatttcaaggcttataagaaatgttctcaaggttgtgcctgtttgatataccagggttttggtggagactgttaagttgaacttccacctaggaaatgagctacatcagaccacaactgaacaatggactatgccttgaattgtcagttttgtgtgatctggtttcactcagacccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaaggcatgagccatcttaccatgcaggaaagaagagaagtacatcatgaaaatgagcccttttcaagggtctcttctctcagtcacataatagtttgtttcgccatccaaattcacgggatctccgatcacaatggacaggtttccactattgtgcgaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatatgcttagatgacttcatgttgtcctttgaactgttcactttaataatcactgtttgattatcacaattcattaggatagctggcactggtttttcaactaccggcaaatccatcaggagttcacgaagccactcggcctcaactgtcgcagtatctagtgctgtaagttctgcttccattgtgacctcgttaagatggtctgcttgcaagacttccaggaaacagcgccacctccaagtgtgaacacatatccactcatggcttttatctcatcagcatcagatatccagtttgagtcactatacccttctagtacttttggatacccggtatagtgaattctatagctcatagtgccctttagatagcgcattactctttccagagcctgccaatgatcatctcccggatttgagacaaaccggctcatcttgcttacagcaaatgagatgtcaggcctcgttgcactagccaagtacatcaatgaaccaatgatttgagagtatctcagttgatcctttgctattcttcggtttttccttaatagcacactgggatcataaggagtaggagctggcttgcagtcactatatccaaagcgactcaaaaccttgtccacatagtgggattgcacaagtgaatcccaccctcatatcctctttgtagtttgatgttaagaataacatcagcctctcccaaatccttcatttcaaaactcttggacagatagtccttgacctcctcaatcacattgaggctggtcccaaagatcaatatgtcatcgacatataagcacaagatcactccttctcccccaccatagcaatagtacacacatttgtcagcttcgttcataacaaagcctgcagatgtaagcgtggtgtcaaacttctcatgccattgcttaggtgcttgcttgaggccatacaaggatttcaacagtttacacacaattccctcctaaccttctattacatacctgtctggttgatccatatagatctcctcctccagctctccgtttaggaa

SEQ ID NO: 950 - DNA, 559 bp, Oryza sativa
catgagaggctgccagagcaagtagtactcgaatcgtgatcaagcgagcaactggtgagtatgtgtcaaaaaagtcctcgccttccttttgggtataacccttggccacaagtcttgccttgtacttttcaattgtaccatcaggcctaagctttttcttgaaaacccatttgcatcctacgggcttgcacccatatggacgctcaacgacttcccaagtaccattagacatcatcgagtccatttcactgtgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatgggcatgacagtttcttgactagaggtgctaggtgtatgtttcatgggaaattcattctcaaagaatggagcatctttgaactcaaaaattggccca

SEQ ID NO: 951 - DNA, 19560 bp, Oryza sativa
  unsure (1)..(19560): unsure at all n locations
cctgaaattattgtaagcaactgagctttagacgaagaaaaacaaggctgattgcatagcatgatagtatctataggcctcaacaaatggcagagcttgcagttaatataatacagtaagcacatggcaggcatttagaagaaatactggacaggacaatgactgcatcataatagtaataatatctctgcaaaagaaggtacctcattatactctctaaaaatccaccttgataagtttgaccatcttctagatgaagctgtactggggtgattataaatttcttcagcatgtctcagaatgaggtacactaatgggaatattacaaggcagggtgaaaggataagcattgaaatgcccacaaatacaagtcgcttctttaacacagctgggcttgttagaaaatctttccgaacacagaatttactgcagaagaaaatgatattggctttcagtatagttttagaggttaaaactacacacacaaaaaaatcgtggaacatcccaatgcgatgtgcgagctcttgctagaaggtttcagcggatgttgtacaaactggaagctgggagggtatcttagcacaaatacgtctttaggtgctattgtgcaaaatccacataagagctgtttgatgggaatagatgggggtgaagaaaagcatccagcttttacacagattgaatatctaaattactcgatatctctatgaagtcatcagaaaatcagtaaagcagtaaagcttgagttaagatgtttagaatttagtaaccagctagctagagacaattatgcataacatcaacaattctgtattccacacagattgaacataatgtataacaaaagagaatgataaagattggtagggacatttgcactctcttgtgcaattaagtgttattacatgacaacttaagggtgtcttcacccgctttctcccaaacgcaggattaatgtggaagaaaaagatacctagattcattatgttgacagcagagtatttgccaaacaaatgttatcaaaatactttggccgaataatccaatgttagctagttaaaagtaacagagctacagacttccttacctatcaaacatactttggaagatgcaccaatttaatgtccattctagggctttcgggagtatcagatggtttctcctgttttgcaaatgggatttgacagttggtccagctccaggtacccaaggacgaattggaaatgagataatgcctttattgaccatcccaatcaagtaattttctttcctcattattctcatgataatatcatgctccgagaggtcccttacaacacaaagtttctgagatttctgtagcaggacaaccttctcaattattttgggccatgagatggtttggatctcaagatctgtaattttcagactacacaaaaagaaaagagaaggtggattcagtcattgatgattgcactgagctataaacacacatattaatcagaaatgttacctgttacagtagaagtcacgaatattcaatgtacttctgagttgcacgaaaaacttgaggaagttgataagaccgtaagttgtcaatataaccattgatccaatagtgatcattttaggaaatgtgaatggaactaatggattatgcttaacgacttgcattagatcacatggtttttccccggattcgagtgcctctacaccacatttcaaatggccgagggcattccaatcaacaattaagaaaaagaacccaatacagcataccataaaaagtacgttaagcatctcaattatccatttggtaacaatgcatcgtagcccttttgcacagaaatattcataaagcctttcaaagaaaatatccaagtcagcaattggttcgtccttgaagccttcaccatggagaagtccagatgggctctcgcttcctgaacctggcaaccttctgtagtccgataactctatttcaggtggaatatcaatgagcagttgtgctgataatggtgattcgcttctccatggccaattaaatcgtggttgcacatttctgtccttcgaacggaaggacatcattcatgaaagaacaagccaagaccaatatgtatccttgccatgccacaagaaataacctgtcaccaaaaccaaaaggaattcaatgaatcacactttgcataccagcaatttccagcaagtacaacaaaatgtatgtgtgtaaaaactcacaagtatgggagctaagaagaaactgagctaacgctcttacttgtacgtctatatacagctacctttttcatacaatctgagcctaaacaaaattatgaacaagcttaacgcaggtaaaccgaaaaggcaccatggataataaggctaaaaacgaacttatcctatacatgcactagatgccaaccagggtagtgcctccatttccagaggcagcagcaatgtgatgccaaatgaattcattcctaatgatgaaacggattttgctcagaaatgttgacgaattgatcaatcaactgcagccgaaacgtaatcgcgcagtacatatcaccattcacatcgtctgtgtcgcctccacggaaagcaattcggtgtcccgcacggacctcacggctatctacttaacaaccagttgagctaacttctagccaaacctctccccaccaacacccaacccacctccgcacaccgccgttccaaaccctagatttctcatcccaataacgcctaacaccaaaacgaaaactcgttcatccaaagctaaaaaaaatcagcacgaaagcggcgcggaaggaatggggggagagagagagagagagagagcaatagactccaccgacctggcgggcaccggcgatcgccggcgcacggggggagggggcgcggggcggaggaggcaggcgacttgcggtggactgcggcttcggggagggttggggaatcgcgcggaggacggggaagacgaggcgagagacgaacgaggagacgaggagacgagaagcgggtggggtgtttccaggagacgtgacgggatcggggacagaatggaatcgtactggacgggggatcgtgtttattcgtttcgtttatccatgggtttggctttgctttgcttcgcgtgggcggctgctgctgcgcgcgcgtggcctcgcgttgtgctggtcgccaacgacgccaagtaactgggacctgggggccatggggcttgggcttgccggcgcggtggatttccggatgaggctaactaattaaaaattgactaacactaatattgccatttggggaacggatttgttgtctcttcgtttcgtcgtactgctatatattttggttgggttggtgcagatggcacgttaattttaatctgttgaaatcgaaggcttgaagccacttcgcagatgattcacaatttagcctctctcatcattcacagcagatttcgtccttacaaaaacaattagcaaattgactactccctcgttcgtttcaggttataagatgttttgatttttgttaaagtcaaactactttttattcatatttaaccaagtttatagaaaaaaataagtaatattttcgactcaagataaatttattataaaatatatttaattattaatttaataaaactaatttgataaatataaatattattatattatctataaacttagtcaaatttgaaacagtttgattttaaccaatatcaaaacatcttataacctgaaatggagggagtatgagaatgagactagcgtactatggtggtattctcttctagagaaaaataaggatgaaattagttaggaaagaaaactattagcacatgattaattaattttaattattataaagttaaaatataaaaattatttgatattttaagataacttatatataaaaaaatttaatacaaaacacataatttaacaatttgaagaacatactaaaataaaccgagtttaaatatatatgaaagaaacagcatcgtatatctcctctgcggaaatatgccgcgcggtggaaaagagggcagctagcgcacgggatgccgtgcaaaactaaagtcatgggataattagacactcgataaattaatagatctttccaaccgcgtcacctattgtccacatgattcctcgttgctttcctcagccagatcctcctcagtctcgcgcgtgatacctcatgggcagagcactgtcgcagcaggccagagcaccaatgccctcttcctccaagatccttggtatcgctccccccacgtcttgaaccatgcttccgatacagagagtgacctcggttgcggcaatagtagggaacaaggatcgagccgagtggaagggagaagaggagtagtagggaacaaggatcgagtcgaggggaaaggagaagaggaaagagggcatgtacttgatacctcgtagttagccatacctcgcaaccaaccatgatacctaatacctcgtagccagccatgatacctgatgcctcgcagctagccatgatacttgatacctcgcaggtaccatgtatcaggtttgatacctatgggtatcagtcatggtaccacatgtactaagcatggtacctacaggtactaggtctgatacctagatatcagtgatgataccacatgtaccatacctacggggtatcggctatggataatacatcatgtacctgcacacactccgacaatgagcatatgatggctcaccatcgcgtcgccgccaatgaaagctctacatctagaagcttcatggtcatgcccctccatcaccatcagcaacgcgtctaggagttcgagaagcccacgttggtcaacatccttcccgacagcctccctacttcctggttgcccccttccgccatgggagcctagatgtagtgggtgtccatgcctcaaaagcttgagacggaggaggaggcaacatgaccttgtaaccaacgtgcactcggggtagatccaacagtgaggaggagggggaggggattcgttttcgggggcctgcttcgccgtcgccatgcatgcatagaggagctctctgcaacagagagaagggaaagggaaaaaggagggcggaataggagaggcggatgaggaagacgaagactgggaaagagaagacaaatagataataacgaagcgttacccacttattccgtttccacgggatacggttgggtagtttttctgggtggaaaaagccaacgtactagtccctccgccgcgcggtggaaaaagccaacgtactactccctctatccaagattataagggacaatggccccttggtttgtctctaactataggggattctatcaactcatctgacaagcaggagtagtgctgtttaattttgggaggaatgtttaaaatttgagtagatgtggtggaaaaatatgctctgacaaactcatgtcagatttttttaagttcattctaaacctgccaaaacaatactttattctctaaagtacattttgtagttcgttgaatgttccaatgtatactccctccgtcccattctagtactgaatgtgacatattctattacactatgaatttggacacacatatatttagattcgtagtactgtaatatgttacatccggttttagattcgttttttatgggacggagaaagtccttccatatgtccatttatccgctttttcatcttccttaattaatactaaatagaaaataatctctcataattttggacggatggactagtacgttacaacgcgcggatgcacgcgtgtcgctgcgtacagccgaccgcggctacgcgtcacgcgttacacgcgtccacccgcaaaatccccttggtttgttcctaagccaccagccaccgggccacgcgaggcaagcggtgcgccgccgccgccgccgaggactcgaggtgcaactgtgtgcaagtcccgtgcaggccgtctgatctcatgggccagttgaagattaggattcagtccaaataggggatatgtatctgttgggctgcatgacatggccaggcccaatgaagatggcctcatgaaacaaggcctgttcctgggccagtaggccagcctaatcgtctgaaatggcccgtcgacgcgagaatgctacctagcgatccctgggcgatcagattttgatcccctctctccacctggttttctttgttggcaccgtgttacttttttattttagtaaatttgtgcacctaaagtttgtacacctcaagtttacacatctccataaatctttttaaaaaacaaaaagttagaaaaatttatgtatagaaatatatatatatatatatatatatatatatatataaaatttgaattcaaattcaaatttgaatcgggtatgtaaacttttgacttataaactttgggtctataaactttaggtgtataaactttatatgtatagaaatactatatatatataatatttgaattcaaattcaaatttgaatcagatataattcaaattcaaatttgaatcaggtatgtaaacttttgacttataaactttaggtgtatagaaatactatatatagaaaatatttgaattcaaattcaaatttgaaacgggtgtataaactttaggtctataaactttagatgtatagaaatactatatatataaaatatttgaattcaaattcaaatttgaatcggatatataaacttttggtctctaaatttagatgtgtaaacttgaggtgtataaactttaggtgcataaatttactaaaataggaaaataatgcggtgcggtggagggagggagagggggagggggatcgatcgctacccccatcgccacccattaggtgtaccctgcccacatctgactgttcgtgacactaatatttggtttgttcatccctcaaaaaaaaaaaagaggtttgttcatggctagaagattcgttggcaataccactactactgttaaagtggaatcgtcctcctttcgttccctcctgacaccacatgtagcacccgtacatttcgcgtgtgcatccatgtatccaatatttagtttttcttgatcgtcctctttagagtcttagtccaataaattgctgttactatatacgggatgtattatcttttgaaaaagaaactctctctgctattggaagcctccactcaattaatggcatcccaaggagaatccccctgttgaaaccaaatggatatgatgctcaaagtctctgccatgccatggaagtcagccgctttctcagctgtgaatctccgtagctttccagaataaaatggtgaaggacaatcaaggcgtgaagtctgtttcacgatacctataggtactttggattgctgatgtgctattctccaatttcaactttagcgcgccaatgaccgtatgtcgatttcgatgggcctgcaaaggaacggcgccgtccaggtttattactccgtaagtggcggagagaaaaaaaagaaagaaaagaaaggagtgcaggtaccacaacagaaataacaagttagcacaaccagccacacgccccatatagggatgttgatcttgtggtaacctacgtgcagtaaacaaagccactagaagaacgactaccagaataaaatggtgaaggacaatcaagccactatagaagaacgactaactcaagactttctcagttagatagctgctggcatttagtactaccgtacaggcacccctatttgatctctctttcagacataaacaacagaattgtactagtatatgattttatttaccagtgaagtgttccattcctaaagataacggattgtatgtagcaaggtagcatatggtgatgatcagcttattaaactggtatagcaacagcccggagtggcgtagccaactctagtatcatcccgaacttctccgccatgtccaccccgttcttctcgacctccggtagaagcctccactcaaaccggtgcagcaacgacgcgagcatcaggtacaccatgcgaacagccagcggcaaccccggacagatccttcgaccagagccaaatggaatcagttcgaagtcacggccacgcaggtccacctcgctctgcaggaacctctccggcatgaacttgtcagggtcagaccacaccttgctgtcccgaccaatcgcccaaacattcaccagaacacgggtgcccttgggcaccgtgtagccaccaacctgtgtggtcgtttcggcttggtgaggaagcagaaatggcgccggaggatgaagccgtaatgtctccttcacgacggcttcgaggtacttgagctggctaatgtcggattcctcaatttcttgtttggagccaatcactcgagcaagctcctcacgagctttcgccattgctggtgggttctgtagcagctgagccattgcccattctacagttactgcgcttgtatcacttcccgcgctaaacaaatcctgcagaaagtaacccgggcaatcatgttgtatacttcgataatttaattagagttttggtgcaacgagattactacatggacatatcacatactctaaaatcccaatgaataattcagtagcacgcaccgtaaacagaaactgtagcgttggccgatcaaaaccccggccatcctccgggctgcggtagtcgagcaaagcgtccaggaaatcgttcttgggcggctccccggcagcgcggtcccgcaggcgccgttcgatgtgcccgtcgaacacggcctgcagccgctcgaacaccctcgccacccgcctccgcagccgctgcgggtcgagcggcgcgacggccgggaagaagtccgacacgttcggcaccccgacgacgatggtgaactccgagatcaagtcccttaagtcccccaccgacgactcagctcgggcgtcgccgaaatccgcgaggtcggcggagaagatggtgctggagagcaggttcagggaagccgtgaacgcggcgcggccgacgtcgacggccgcgccgtcgcgcgccaggcgcgcgacgtgggacacgagctggcgcaccttgtcccggcggaggcgctggtgcgcgtcgaggctgcgcggcgcgaagagctccgcggcgcacaccctgcggagcgcgcgccacagggcgctgctgggcgggagcatgcccatggagaagccgtcgtgcccgcacgcgcgggcggcgtccggcacggagcgcgcggagaaggcggcgtcgtggcgctggaggatgtcgcgggcggcgcccggggaggaggcgacgacggtggtgacggtgccgaggcggagcgtcatgagcgggccatagcgccccgcgaggcgcgcgagggagcggtgcggctgggagccgaggtcgaggatgttgccgatgagcggctgcgggcggggacccggcggcaggttgcggcgggcgtcgacgaagagacggaggaggtacagggaggagagaaggagaataacgcacggcgtacacaagaggaggagctccatgattgaccgtacaaaacgtgtgcagggtcggaacgatactcgtatgctagggtggatactcctgctaatctgctagtatatctactcccatatagagtgtgtactggaagagatggcaagacacgccaaagatgtgcaacgtgtttgattttgagccaacgagagagggttttctgatatagtcatttaattggaatcgtaccattatcattttacacatataaccattcgtcttattaaaaaaatttacaattattatttattttatttgtgacttactttattatccaaagtactttaagcacaacttttcattttttatatttgcacaaatttttttaataagacgagtaatcaaatagcgcaaccaaaaagtcaaaatcccttgtattatgggacggagggagtatgtcagtacttacctcttagatgaatttacaaaatgtttgggaccaaattgtcattttctctttccttcatccttctttccctttgtcggtacttaccttcaaggccgccgcctccgtctactcccgcttctgtaaaactatattgtataccttcgtgtggtgtctgttaggttggataagatagagtttgttaggatgttgttagtctcatctatccaactgaacagatcacgtgtaatatggatgtaaaccacggtgatggttgttatcaccatatattaacaaaggtgcggcctctaacgaggttcaacgcttctgcacctctgattttcacatggtatcagagcccttccatccaccaaatcgcatctaatccaactcatggtgagttcgtcgaagacggcggccaggaaccctctcggtggaaacgcgatctcggagaaactctccaaatcaaaccatgtgctttggaaagcgcaggttatggctgttgtgcgaagagcccgccttgaggggcatctcaccggcactaccaaagtccccaacgccctgatcacgacgacagcaggcgacaagggagaaaaagaagtcacggctcgtaatccagaatttgatgattggattgcaaccgattagcaggttctagggttcctgctctccactctagccagggacgttctggcgcaagtggccacctgcaacacggctacagcggcatggcaaatgctggaggagatgtactcctccgtctcgagggcgcgcttcatcaacacccgcatcgccctctccaacacaaagaagggcactctctccatcaacgagtatgtttccaagatgaagactcttgctgatgagatgacggctgctggcaaagtcgtcgatgatgatgatctcgtcttgtacatcatcgccggcctcgacgacacgtatgaaccagtcatctccaccatcgtcggcaaggacttcatgaccctgggagaggcgtactcccagctgctcagttttgagcagcgtctcgcgcttcgtcacggtggagatgcatctgcaaatctggcgaaccgaggacgtggcggtggtggaggacagcaacgcggcgacaatgctggaaacggacgtggtcgtggcaacaacaacaatggcgccaaccgtggcagggggcgcggcaacaatggcggcgcgcgtccaccgggaggtgtcgacaacatacccaagtgtcaactctgctacaagaggggacacacggtaattaattgctggtatcgttacgatgaagattttgttcccgatgaaaaatatgcaggatcagcaacttcctatgggattgatacaaattggtacgtcgacaccggtgcgactgaccatgtgaccgcgaactggacaagctcacagttcgtgaccgctacaaggggcaagatcaagttcacaccgcaagcggtgcaagtatggaaattagtcatattggtcattctactgttaaaaccccgaactgtgacattcatcttcgcaatattctatatgttcctaattcaaataagaatcttgtttctgctaatagacttgtttttgataattctgcttacatggaactttactctaaatattttaatctcaaggatctggccacgaagaagcttctgcttagggggccatgccgagggcgcctctatgcccttccatctacatcatctcatgaacgccctcgtcatctaaaagaagcctttggagccatcaagccgtcctttgagagatggcacagtcgtctgggtcatccttcctctccaattgtggagaaagtcattagcagaaataatcttccgtgtttagatgagtcaaataaacaatcggtttgtgatgcatgtcaacagggtaaaagtcatcaatggccatattctagatcttctagtatgtcaagttatcctttggaacttatttattctgatgtttggtgtcctgccctcacctctgttgggggcaaacaatattatgtgagttttattgatgattttagcaaatttacttggctttatttgattaagcataagtctgaagttgttcaaaaatttcatgagttccaagctcttgttgaacgcctgttcaataggaaaataatagccatgcaatccgactggggaggtgaatatgaaaaacttcactccttctttacaaagataggtatcacacatcatgtctcttgcccacacactcatcaacaaaatggctcagctgaacggaagcatagacatatagtagaagttggtctcacacttcttgcatattcctccatgcccttgaaattttgggacgaggctttccaagccgctgtatatcttatcaacagaactcctacaaaactcctccagtttagcacacctcttgagcgcttgtttaataaaaccccagattatacttctcttcgagtatttggttgtgcttgttggccacatatgagaccttacaacacacacaaactccaattcaggtcaaaacaatgcaccttcttagggtacagtacactcgataaaggattcaagtgtctcgatccttccacaggtcgtgtttatatatcccgtgatgttgtctttgatgaaacaaattttccctttgcaaaactccacacaaatgccggcgctagacttcgttcagaaattttgttgcttccttcacatcttctaaatccagcacctaatcctggggaacaacagttagatgacaatatggctaatattcctgctaaccctgctgatcagttttttggaagcaatgtgcagcctgtttctgcagaaaatgatgaaccagacgatccttcatatgccacagaagatccggccgaagaaatccatccggaattcagtgcagctgcaaaagaatcggcgtcgggatcgccgcctgcatcagatgctgccgccagccattctagcgctgccacgtctccggatgtggtacactttcccgcctctcctcatgtgatggcgcctacctctgctgacaactccacgccgagtcactccggtcctgacaccgccctgcctaccagccatcatgatgttatgtcgccatcacacagttccgcaggcgagccgtttgcgacaggggaggaagtgattccagcgccatctcgcccaaccactcgtctgcagagaggcatacactgatggcacagttaaatacaagaatacttttcttactgtgactgatgagccagaaaatttaactgatgccttgaaaaatacaaattggaaaaaggctatggatatagagtatgatgctttgatgaataatgaaacttggcacttagttccacctaggcaaggtagaaatgttatagactgtaagtgggtctataaaattaaaagaaaacaagatgctcgcctagttgctaaggtatagattatgaagacactttcagtccagtagttaaggctgctactattaggattgttctgtctattgctatgtctatggggtggtgtatgagacaactagatgtacagaatgcttttcttcatggtttccttgaagaggatgtatacatgaaacaaccaccaggatatgaggataagtcctttccagagtaagtgtgcaagcttgataaagctctttatgggctaaagcaagctccaagggcttggtattctagacttagtaagaaactgatctgggttttcaaggatcaaaaggagatacttctctgttcttttacaatagaggaggactaattatatttgttcttatttatgttgatgatataatagtcactagctcaagacaggaggcagtgtcagctcttctgcaggatttgaaaaaggagtttgccttgaaggatctgggagatcttcattacttccttggtatagaggtaaataagatacctaatggaataatccttacacaggacaagtatgcctgtgatctcttgagaagggtaaatatgtttgattgcaaaccagtaagtacaccattgtctactagtgagaaattatctgctcatgagggtgacttactagggcctttggatgcaacaaattatagaagtgtagttggtgctctccagtatctaaccttgactagaccagacattgcttttccagttaacaaggtttgtcagttccttcatgcaccaaccactattcattgggttgcagttaagagaatcttaagatatttgaaacattgtactaaacttgggttgaagctatgcaagtccaagtctatgcttgttagtgcttattcagatgcagactgggcaggatctcttgatgatagaagatcaacagggggttttgcagtttttctgggagacaacctggtatcttggtgtgcacggaagcaagctacagtttccaggtctagtactgaatcagaatacaaagctcttgctaatgctacagcagaaatcatgtgggtacaaactttgttgacagaattacaagtgcaaagtccacctatggcaaagttgtggtgtgataatctaggagctaagtatctttcttctaatcctgtttttcataccagaactaagcatatagaagttgactatcattttgttcgagaaagagtatctcaaaaattgttagagattgattttgtacctacaggagatcaagttgctgatggctttactaaggctttgcctgttagacagttagaaaattttaagcacaatctcaacctaggaaggttgtgattgaggggggctgtaaaactatattgtatacatgcgtgtggtgtctgttaggttggataagatagactttgttaggatgttgttagtctcatctatccaactgaacagatcacgtgtgatatggatgcaaaccacggtgatggttgttatcaccatatattaataaaggtgcggcctctaacgaggttcaacgcttctgcacctctgattttcatagcttcctctccctcctcggcggcaagcacaacatcctccctaaggctgtccttgagctcaccacacaggacctccgccagatcagggtctcccctcgcaaggcctcctacctccacgacctcgctcgcaagtatacctctgggatcctctccaacgtcgttgtcgtcaacatgaatgcccgctcccttgcctgcttgccaccatggtcaagagcattggcgcctgaagcgtccacatgttcattttttccctcaatcgtcccgatgtgctcctcgttgccgaccttagggtgcgcaagggcgtgcagcatgtctacgaccttgatgtcgtgccctagctgccgtagatggacaagctacgagcagtgacgcccttaccgatctgccggggcatggtacatgtggcagtaggctcatcgaattcaaggcgccgtagctgccgccggccatccctatcaggtcacctgcactgcctaagcatggtgatgacctcatgctctagcagcagcatcagcaacagagtgtcttccaaatgattgatcctcttcagatgctcccaaggatgggttgaatttggtatatgttatgtagttctactcattacttctcggtattagttgggtcctaactctgtcaatccaatgattgttttatgtacctatcgttctgtgttgggggagattggaagagagtagaactaaaaatgagggcagcggggaggcatcgccggcggtgggattcgggtggaggacaagaccaagagtaaggggaaatgatgagggaagagagaggtagaagacgagggcgatttcgtctaatacatgtgaaatatgaatttcagtggcaccattgagattacaaacaagtaacagtggcatcgttacaaatacacaaacagtaatgacatatttccaaactaggatatttttaatgctatgatccaattaaccaaaaaataaagtgcttgtttatcgtcacttacaaccttaataaattttggtactgctctttccatttcatatatattataaattgttttgactttcttttaaacttctttaagtatgactaaatttatagaaaaagttagcaatttctataacactaaattggttcaatcaaatataacattaaatatttattgataatattattttttttatattgaaaatgttactatattttattataaacttggttaaagtttaaaaaaatgactaggaaaaaactcaaaactatagtatgaaacggagggtgtaccaaattttggtaacgcaacaaactaaatacagtgctaccaaaatttattaaggttcctctcttaaaactctaccaaaatttggcaaaggcataaaagcaaacaaaaacaacacagtcgaaatttggtaatgccaatacaaaatttgatatgattgattagggcaacaaattaaacaagctcaacaataattatactctagtagtatcgatcactatctccatcctaaatatatatgtttatttttctatgtgaatattcaataaccggtgtagattaattaatatatttgatcacaagatacaattgtatatagggaatgcatgtatccagcaaaaagtatcaaacaagtgaaaactggagctcaaatttctataaattcctaaaacaattattaggtgtaaccgtgaaatatatttttaccaaatttaaagttcaaactcaactttattttggagtaaaaaagacaatttttggataaatagtaacaaaataatatttacctgaaatttgtcatcttttttgcaaagatgcccatattattttcaccactgtttttaactgggttttctaccatttccgaccttactgatttcaggtggttcggtcagtgaacatcagaaacaagtgttgatcggccggtaatttttgtgtacggtttttatacatagtcaaattggtgtagcaatagcttggaggggcgtagccaacgtcattacgatcccaaatttctcctccatgttcaccccgttcctctcaacctccggcagaagcctccactcaaaccggtgcagcaacgatgcgagcatcagatgcaccatgcgaacagccagcggcaacccgggacagatccttcggccggagccaaatggaatcagctcgaagtcgcgaccacggaaatccacctctttctgcaggaacctctccgggatgaacttgtcaggctcaaaccacaccttgctatctcggccaatcgcccaaatattcaccataacggtcgcgcccttgggcaccgtgtagcctccgatctctgtgtccgtctcggctcggtgagagagcagcaacggcgcgggaggatggagccggaaagtctctttcacgacggcctgaaggtactcgaggctgtcgatgtcggattcgtcgatttctggtttggagccaatcactcgagtaagctcctcccgagctttcatcatggatgatgggctttgtagcagctgagccattgcccattctacagttaccgcgcttgtatcactccccgcgctaaacaaatcctaccaaaaaatacccagacataagtcagataatttcatatttgcacttacacttaccagtggttagctacactacttcaagagtgcaactctctcgtttgccgtggccatcgcagtcgcaatgacacccacgttaaggttaaggtctgtttggagagcttaaaattctaagaaacaattagttgatagcagcttttgaaaacatagaaaaactgggtttatcagcttctgacttctattcattttctggtttatataactacagtttctcataatctaaaaaaaagctgaaccgtttaggaagcttccgattctgaaaaaagttgtagcaactataagctccctaaacagagatggagataaggagagcaccagagctgaccaatgagaatgagctaaaacgctattgccaactcacaatctaaaacagtgttcgggaggtggagcacatgaaaacttggtggtttattaatggttaattaactaagtattagctataaataatttaaaaaagaattaatataattttttaaaccactttcgtatagaaattttttgtaaaattacaacattcaataatttaaaaagcgtgcatacggataacgagacatatgagttggaaaagtaaagaaaaaaactcggcctaatataccggtataccgtaaaccgtgaccgtagcgtttgccggtcgaactgccggccatcctccgtcgtgcggtagtcgagcagcacgtccaggaagtcgttcttgggcggctcacccgcgtcgcgctcccgcatgcgccgctcgatctgctcgtcgaactcagcgaacagtcgcgtgaacaccctcgacagccacctccgcagccgctgcgggtcgaacgccgcgaccgccgggaagtagtccaccacgttcgggacaccgacggtgcccgcgaactctgcgaccgtgtccgctaactcccccgccgatccggcgcgtccctcgtcgaggtcggcgaggtcggccgagaacagcgtgcaggagagcatgttcagcaaggtcgtgaacacgacgcggcggacgtcgacggccgcgccctcgcgcgccatcctcgcgacgtgcgacacgagccggcgcgccttctcgcggcggaggcgctgctgcgcgtcgaggcggcgcggcgcgaagagctccgcggagcacaccttgcggagggcgcgccactgggggctgctgggagggagccagggcatggcaaacctgtcgtgcccgcacgcccggacgatgtccggaacagggcgcgtcgagaaggcggcgtcgtggcgctggaggatgtctcgggcggcgtccggtgaggacgcgacgatggtggtgacggcgccgaggcggagcgtcatgagcgggccgtggcgctccgcgaggcgtgccagggagcggtgtggcttggcaccgagctcgaggaggttgccgacgagcggcagcgggcggggacccggcggcaggttgcggcgagcgtcagagaagagccggagaaggtacagggaggagacgaggagaataacacacggcgcatacaggagcaggagctccatgattgaccgtacaaatgtgtgcttactgcttagttagccgcaaaacggtgcggcggactggcattgtatattgagataaggttgggggcgaggaaaatgagaatgatagttatgatatgattaattaagttttaattattaaaaacttaaaaaatatatttatcttatattttaagcaatttttatataagaagtaaaaagcattcgtaggaaatataagataaatactaaatcaatcttaatagagaaaaacaaaggtttgagtagtgacggttttctcttgccatggttagtccttgtactgttctttatctttacgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 952 - DNA, 16908 bp, Oryza sativa
catttctacccctcattgacatgcattatacttgtacttgtgaggggtagaaacgtcatatcgtgtgtgtggctggatcaagacggacagaaaacgatcgagaattgacggaagtgttaaaaatgggaacatggtgaactttgggtgctattaaagtgaaccggtaactttcggtgctataaaaccaaaaacgtgaactttcaatgctatataaccaattttagctttaattagttaaggcacgtcggatatctggttttaacattttttagcttgatgacaagttgagggaccttcggtgtactttttcctttgtcctgcgtttccgggtcacggactccaggtttcggcccatgggccacggcctcatatgggacgccaccccacgtgagtgttgacgcggcaactgggccgttctttcagctcaatggttaaatggtacttcatctaccctaaaatataacaacataaaaatcagatggaatataatctagacataccccttacatattcatactattattctacttcctccctcccaaaaaaaacaccatctaagacaacgaatccggacattgattttttttcggacggagggagtatctgattctatgttcctataattttcatgatggagatggtaccattattttagagtaggaaagaaccaataaaatgatataaatactgaaaatagattaagaataatattctaagaatttaatctgtaaacaattttttttagaaattgcacgtttagtttttgttaaaaaaaataatccttagttcctctcatcacgaacaaacttacccagggctgcaagcatgtgtattggctttgtagtgccctgcccttgagaaaaatagtagagtacttcattttacaatcctttgattgctgagatgaaattaaacctgtttaggacaataatagtggtagctagtactcgattgttcggcctcgcttaccatatcatgcattccatacggcaaagtggaaaatgtcttgggtccagaaaatctaaggcgcgaggaaaatagtacaggctggttttgggaacaagggacgtggtggagagcaaggccacgctaagccaacacgacctccacggcatgagtaaaacatagttgcaccaaccgtcaggcattcatttcggatggtttctcacgaggacatgagagatctcatagggtgtgtttggtcgctcttgcagcgaacatggaagagagtctcctatataacacttcgagggccatatgccatgtagaagcaccgtgactgctcttagggcaggagcaatacaacacacgcaatcacgcatagcgtgtctctagccctcctgaagatgcgagattggtccaaggccagcattttcacagtgtaggcgcgattttggatgcgacacgaggagacgaggagacgaaggcacaactgtgaaaccttgggtgtgtttagttcacgttaaaattggaagtttggttgaaattggaacgatgtgacggaaaagttagaagtttgtgtgggtagaaaagttttgatgtgatggaaagttggaagtttgaagaaagagtctggaactaaacaaggcccttttagcttgctaagcgtgaaatgtcagatatgactatccctcaaaattcttcgcgggcattttgccactattgagggaattcaggcccaaatttctgaacgagagttcagcccaggggtggatctacaggagaagagccggtgtcagacgataccgacgactttcggcaaaaactatagcgaaactgcttatccatatgctataacatcatgatctaaatataattagcatactatgacaccgataagcacgttctgacaccaacaaatcgattttctggatccgccactgcttcagcctatacgttttccttgaacatttgatcagctcctccaccactgggctctcgtttccacatgtgcttgaccagccgaaaggcgagactgtctttggcagtttcagcgttgcaaaaacacaaatgtttcagtttcagaaacgaacccaatcgatcccccctactactgcagttgctcacacacccacaccccgactgcacacgtcgcctcgcctcgtctgcgtctgcgtctgcgtctgcgtctccgtctccaacccaggcggcgtaggggaaggagaaggaaggagagatcgcgcggcgcgctggctgtcgctgtcgccgtcgcgcaggctcgtccacctcgcgaaatcgtgagctcgcgcgccgctccgggcatgcagggcgccacgccgggcgatgccgctggagaggaggtgggaggcggcggggacgtggtgatggtgaggcgggcgagcgtggcggcgtgcctgacctgcccgctctgcgaccggcttcttcgggacgccaccaccatctccgagtgcctccacacctgtgagtccccctcctccaccctgctccgctcacagtccccacgctttctcgccccgcgcgctggggaggtcgtccccacgcgtcaaatctgcacatttgcgcggtgattcggggtgggtttttgaggtgacgcatggaaggtggcagtttccgccgttccatgagctatttctgcgtgggcttatttttttttccccgttggtgcgtcaaaggtgggatgattttcatcgttcgttcgcgaaataggaatttggttgtgccatttccgtggggttttgaggtggtgcgtgaatatctctcgatgtcggcatgtcgaggagggcctagcttgtgattcctgggttcgttgctcatcagctcatgtgttctacggggatttgggatgaggctatcaggccagtggaagtgatcggttgcggtggacttttgtgcggtgacgaattacgtttgcccagaaaggggcgcacgctacttatttaataatatttaatttcatgatgatctatttcttcgatgcgaggattagaaaacttgtcaggcaaatatacaaaaaaagattaatgaaatttatgaagagagtaggaaggtcctccctattttcatcaggaagaaaaggggcaagaggatgtgtaaaaggtggcacttttggttagtgtagtgtatgccattttttttttattgtcaggtgcttaaatgcatgaagcaaaggttgcatacacatcgttttttattgtcaggggacttcattctttgaaacatgttgagtggccttgttataaacaataactagttactgttcattcttggaaacatgcttagttctttttctttctagtttgttgaaatatcgtaactgtgccattgtatggatgcttggcatgtaatactgatcgaatgatgggtgagctcattaggaagttaggcaaccaaatatatagataatctagtattctgtattcggttggtccttcttatttctaagttattctggaataagagaggagaaaaatcctaatgtgggcacactgattcattccatattttttatgactcttgcaacgtattcataaagcaatagtattggagtaacaactctacccagtgtccaaccaaaattttgtaaatttggggagtcttactgccaacagctgccaatagaaacacttgatctgttaccagttaattcttgtaatatcgtgcttcaaccattgatttatacctttaaccagtctgcagaaagtgtatacatgaggagttcgtcgataaggagtcctgctgctgccctacttgcaacattgatctggggtgtgctccgttggagaaactcaggtttgtctttgtcactgtttccctgaaatattttatctacactattgcatacttctgaggcttaaaaccattgttcagttattgtattattttcttttctatgtcatgcccccaatttgatattgcgatttcaatgcagcgcatgtacatacacctaagaagttagtgacatttgggagttgggagagttttttctttaccacctctgctctcttgcatgtacaaatgagatagtcttctgtgagcaatcatccttcctccatcaatataacaactattgtgtcctgcttttttgatattattatgcatacaacactatgttcttcctcaattgccagtgataatcgtgattttgcaataccagcctagtgctgtgccactgttctgtttgcatcacatggactgttataacatcataataatctccatctgttcaatcttggcttggatggtcttaaagactttataattgttttgtttttgctcggtttattttaatgattagttgtttgttcgttacaagttataacttcgaaaggggtgagatgagcccaaacttagttcacacgatcacaccttgattaatctttagccgcttgataccgagttatcagcagcatataacaaacaagttttactttccctttttgtgatattgtagcttatggtattttcaattgtgttttgttcagagttgatcacagtatgcaattcgtaaggtcaaggatatttcctttcaaacgaaggaaggttgagaacccagaaatcatttgtccagttgcgtcacctgtcaagaggaaagaaagatcactatcttcacttacaatccctgctcctcaggtgtctatacagaaatgtttgacaaagaggagaacgaaagcttcgtgcttacgcaactttcctttggtatgtagttctcttgtaatagttcccctgagaatcggatgtgtgaagaattctaatttcttatctgtaaatccactattagaattgttcaaatgaatgtgactctgcatcaccagaatgctgtaagcaaccctataggttaggtcataccatgtatttccattgttttagtgccatagagccatctacatggtatgccagctattgtcgtattattgcagctggcacaatcacagatgtgtgctaggtaacagttcttggcactgtccgcatgtgttattggtatgctaaaggttgtgatagtcaacatgtgaatatttacgggctaatacataacaaatggttatctgaatcttctgaatttatttatagtccaggcgacattaatgatagatgcacaatacttttattttgccttcaaaactcaaatagtttcctacaaattgaggcaatccatagaaatttcatactccaaatacctttgttccaaagacatataggaaagtttcgttaggattgaaattcttcaaaaatcctccaaataccttttgttgcaaaggagatgttatgcatgaattaaatgcaaccgatgcccctcccctccaaattctaaatcgatgcgatttttattgctgttgtgtagagtatttttttctggtctgattttaatgaataaattttcttttccccgccttgtgatgtagcattctacctcgaggggcagtaaagatacatcaaagaaacttgggggttggagaccattgggttgtcaacttaagcttggcaaagacaaaaaatctctcaaatcaagtgtaaaagatacaaacagaaccaaaagtaagtctggtgatacagatgatggtgctcctgctagtaaagcaaaggctagagaaccctttacaagatatgggcgtgcagctaagaggactggaagaaagaaattgctcatgttgaagaacaaaaagaaaaggttcaaggcaaagcagcccagtaaaaagaggagattccgagcactatggttttatctacttgctgcttttgaccagtgagaaacactagacttgtcttgtgagatttgtgccgtttcttcaaaggaaaagcagaaatcatgctttgtgtttgtaattatttcaggagaggagtaccaactttaccacaactaccagcaaagtatttgaggatcaagtgagttatttggttgcacttttctagtcaaaacagtatttgttaagccacactaacaactgccttttgttatatttgtcaaagggatgttgatttgcctgcttctattatacagaagtaccttgcacagaaacttaacctctcaagtgaaactgaggtatgtctttacatatttctttcttgtagtgatcatcaaaaccagtctgttttttgtgccagtatccagattagttagaatcagcagtgagaaagaattccatcaatatttggctttcctgccagggacaagactggctaactggagctaaaatctcacaatctaaacatagttagatgtagttatggcacattcttagctgttctttggaggaaaacaacttacttcatgattatatttgaaaaggcaagaaaattcaccatactgtttccaattggtgcttgattgaaggctgaagctgaccggtgttcagttgattttgtgctgtagatacttttgccactttgttttgcgcataaccacgtttgtctttgcaatgaacaacataactgttcgctgcttcaagtttcatggtgctgcttgacacttgcaacatgtgaaattattaccctatattgacaaaagttgacagaacattctgctcattgcacagcctattttcttctgctctcaccaacgagtcgtggttgcaggtagaagtgttgtgtggtggcaaagtagtgaaccaagggatgacactgcatgatctagcagattgctggcttgagaaaggaccaaagagccgaatgcgctcatcggtaggctccccggccactggattcatggtgacattgttctatagaaggccagatgtggatgtgtcctcatccccagctccaccccaacctgacactgaaagttgccatagctgatgcagagctttgcttcgtttctgaaccatctgtgattggcttcactcattgggctgtcagcccttgattgatctgcgaatcggttccaatttgtgtgaggctcaagccacaccaattcactaatatgtagataaatgctactaattttacaagccatgttgggcttctgatcatctaccttcttcaaccattattttccttttttttctcttcaaccattgtacctaggtatgtgatctgtaatgagatgttaatcgttaagtatcagttgttagagctagggacttcatgttgtctccacgtagctagtagtactagattatgcttgtgtatttgaatttgctggtgcattcatcatgcatgtatatatataagctctggaattccttgtagttaactggatgttaagctgagaatgtataagctctagattatcagtttaccactccatgcgtgatgaaacgtgctactgcttactctgttcccaaatataaataacttgaaattgtttaccagagatcaaggtttgaaaagaaaatgctacagtgtttcttattaaggccgagtttagttacaaacttttttttttcaaacttccaacttttccatcacatcaaaactttcttacacacataaactttcaacttttctttcacatcgttccaatttcaaccaaacttcgaattttagcatgaactaaacacgccctaagtggagagtggttagggctcattcgggatgtaggttgaacgaacacagtgattggaaaaaaaataggaatgtgataggaatacatgtacaaaacatatgatttgaatatacataaatttcgtaggaacagatggctaggtgaatacacagtacagggtgtgtttagttcacgccaaaattggaagtttggttgaaattgaaacgatatgatggaaaagttgaaagtttgtgtgtataggaaagttttgatgtgatggaaaagttggaagtttgaagaaaaagtttggaattaaacttggccacaatctaattaacgcaatataaattcattttgtatttcattctcttctttttctgcttattattattaccccctatgtttcaaaatgtttgacaccgttgactttttagcacgtgtttgaccattcgttttattcaaaaaatttaagtaattatttattcttttcatatcatttgagacactgttaaatatactttcatgtacacatatagttttatatattttacaaatttttttagtaagacaaacggtcaaacacgtgctaaaaagtcaacggtgtaaaacattttgaaatggagagagtattatttttaaaaggaagccaaagtccaaactcgaaatattcggggctcccgcccaaggggtcccgctctctcgtctcctcgggactcagccccaaaaactcaaatcccccgccttcttgtcccctccgcttccccttccacttccacccccacgtcgcctcacctcgcctcctctccccctccaaaccccaccaccacagagaaaaccccagggagaaggacaagggctccacataccaacggcgccctcctcctcgactagctcccgccggtaatcccctctccccctcctcgcgctgcttcgattgcttggttcgcgtggcgcgattgcgcgtgcggtggtgggttttggttggtagttttgtctctgccttggttgcttgtgggggttcgtcgctgatcgtggtgtcgtggggagagctgatcgcggtcgcgtgatgcggtgtgtctgcggcgtctcggtcggctcgcgtccggcttcacgctgtgttgttttctgacgcgatcgtacattcgccgagattttttttttgggtgtatcggcgtggtgggtgaggcggcgattttgttcgtctgctccgtatcatcttcgatcgcttgttccactgctgatgctgtgcgcgagcgtgtcctctatttcgtctgtgcgaatgtggatgagtccatttgagtttttggtgccatttttttcatgctccgagtagcatggcgctttgatggttaatgcggctggttttgttgtgcaggggttgcgaactcggcgatggatcagtgacccgccgtggtgaagcctgcagattctacctataaggtatatcgccccacccctcttcctcggatttactagtagctgaattgttgttgactggtgaatgataatcgagcggaagctgttcaggattttgcactgctgcttgttatgctctgtgtggccctctagtaatgtggctttcattaaatcagtggttgctgcaccactgttgaaaatgcattgcactatttacacattcaacaatctatgtggtataatactaatgagaataaagtgtttattacattattccattatctaaataaattatttaattttagtgcactgtagtacgttacacattcagcaatctatgtggggttgttaacttagcgcatttgtgtttgcacatgggaatgggatcaacttgtgttgtacactagtataactgtagcttccttatggagcctagctcaatatgctatagaaaccgtctgctgaaactaataggattctccaagaaggagatgatgcggtgatggtgtgttgctgttattattttctttttgtaaactgtttttgatgtcatacaaacttcttgatgtacttgctaaactcttgagttttgcattttggttcctatatttgttttgaacttctaattgaaatgcctgcttgattccaaatttacaggggagctatggcgaaaagtccacgttctgttgttaccacaggtcttcttctgtctactttgtaactgcttatctcactttcacataacatctcatgcatttatgatttaactaagttttagtcagatcgtaaggcagtttatgcagtgtagcttacagcttatttttaccattgtgagttactgaattcaactagagccacacacatatataattatatgcctgcatatatcactcataatcacttggagttatcatgtttgatcttgcttgcaatctagaatcttgcaatagctttctacatatacatgcttgacagttataagtaagatgctgatgttgatttacttgtttatatttttaacgtgcttggttcatctgatggatacatgcttgtatggtatccaattatttcaaattgtaatataaccaacaccattttgtctctcaggaacaaaaaggcgtagagcaaaggttcataaagaagatgagcctgttgagaatgaaaacttggagagtgaatttgatgtttccaagaaagagagcaatggtgccactgaacctggtaatgagcctgttgccagcaagagaccgaagagagcagctgcctgttctaacttcaaagagaagtcattggacttatcagaaaaagattcaattatcacaatcaaggaaagtcgggttgaagagaaggaaatagaggctgttaatttgacaaggacgggacctgaagatggtcaaccttgcagaaaaatcatcgatttcatcttacatgatggagatggtaatctgcaaccctttgaaatgtctgaagttgatgacattttcataacagctcttatcatgcccttggatgatgatctggaaaaggataggggaaagggaatatgttgttcggggtttggacgaattgaaaactgggcgatttctggctatgatgaaggtgctgcagtaatttgggtctcaacagaaacatcagattacaaatgtgtgaagccagcaagcagttacagatcttattttgaacactttagtgagaaggcacgtgtctgtgttgaagtctataagaagttagctagatcagttggtggaaatcctcaggtggacttagaagaattaattgctggtgttgtccgttccattaattcaaacagaagcttcaacggaacagtaaccaaagactttgtgatctcctctggtgagttcatatataaacagcttattggattagaccatacagctggcaatgatgatgagatgttggccacactgccagttcttgttgcactgaaagatgaatgtaaatcaagagcaggattcacacatttgccagctatgccctcgaatggaactctgaggattaaggatgggcaagacaagggactgactgaggatgaggatgcaaaattagcaagactgttgcaggaagaggaagaatggaaaatgatgaagcagagaggcaagcgtggaacttcacagaaaaatatctacatcaagatttgtgaaactgaaattgccaacgactacccacttccagcctactataaaccatataaccaagaaatggatgagtacatatttgatagtgatattggtatgtattctgatgatgtacctgtaagaatccttgacaactgggctctatacaattcagattccagactcatttctttggagctcatccctatgaaagctggtgcagaaaatgatattgtggtatttggatctggttttatgagagaggatgatggtagttgctgttcaacagctgagctagcacagttacattcttcctcaagtaaatctggccgggaagatccaggagttccaatttatttgagcccaattaaagagtgggttgtagaatttggtggttcaatgatctgcataaccattcgaactgacgttgcttggtaaataccctggcagttctattttctttttgtattaccattatctccaaggggtaccatattttagctttgttagtcttgatcattgccagctcatgatggaaaaataaactcaatgcatttcggataacatatcttacacacacacacacacacacacgaatttggcattttgtttgaagcatggaattttgcaaccatgttgtgtttaccttctctctaatttacatctggtaatcaattccaggtacaaattacgccagccaacaaagcaatatgctccatggtgtgagcctgtgctgaaaacagcaaggctagctgttagtatcatcacccttttaaaagagcaaagtcgcgcttcaaagctttcttttgctgaagttatcaagaaagtagcagaatttgacagtagacaccctgcatttatatcatcgaaagcaccaaccgttgaaagatatgtcgtggtgcatggacagataatacttcagcagtttgcagactttccagatgaatctgtcaaacggtgtgccttcatcacaggtcttctagcaaagatggaggaaagtaggcacacaaagttggccatcaagaaaaaatctcaacagatgagaggggagaatctgaacccaagcgcaaaaatgggtccaatactgagaaagaagcttatgcgtgctacaactacaatgttgatcagcaagatatggggtgaatactatgccacttatttccctggggatacaaaggaagaagatcagaatgaaccaaaggaaattgatgatgatcaagaagaaaatgaagacaatgatgctgaagaggaggtaaatgttcaagatgagaaggccacaaggactccaccatcaacacggtctagaaagtcgtcagcagatactcgcaaggaaatcaaatgggaaggtcaaacagctggaaaaacagtgtctggagaagttctgtacaaatgtgttattgttcaagacctcagtatttctgttggtgcgacagtcacaacagaggatgattcaggagaaaccatcatgtgttttgttgagtatatgtatgagaaacttgatggtaaaaatatgattcatgggataattctgcaagaaggttcacagactgttcttggcaatgctgcaaatgatagagaggttttcttgactaatgactgtttagaatttgaagcaagtgacatcaaagagttggtgactgttaatatccaatcactgccttggggccacaagtacagaaaagagaattctgaagctaagagaattgaaaaggccaaggcagaggagaggaaaaggaagggcctgccagtggaatatatttgcaaaagcttatactggcctgagaaaggtggattcttctcccttccgtatgataaaattggaaatggcacaggcatctgtagctcctgtgagagaaaaccagttggcaatgaattcaagttactttctgagagcagctttgtctttgagaatattacgtataacatccatgactttctgtatatcaggcctgaatttttctcccaaggggagggccatgagacctacaaggctggaaggaatgtgggtctaaaaccttatgcagtctgccatctgctgagtgttcatggtcctgctggatcaaggaaagctaatccagaatcgacaaaagtgaaagtaagaaggttttaccgacctgatgacatttcatcaacaaaagcctactcatcagacatccgagaggtttgccttttttccatcatctgcatcattggcaatactgtgatttcacctaaacctatcttttttggcctttggtatttgattgttgtgtactttgtgatttgatccaggtgtactacagtgaagatataataagtgtacctgtggtgatgatagagggaaaatgtgaggttcgactgaaggatgaccttccaaattcagatcttccagcggtggttgaacatgtcttttgttgtgaatatttatatgatcctgctaatggagctctcaaacaggtcagctactgccaaatttttcttcagaatccctagttatctgcattgtttccactgggagatgtctttgtattattgaccgagcttgtcttgcatgatctttaaccagctaccgcccaatgttagacttgtgacactgacaaggaaggtacctgcttcaaaaaagaacaaaggaaagcaaatttgtgacattgagctaggtggttcagacaaaccaaaggatgggcaatcagagaactgtcttgcaacacttgacatttttgctggttgtggaggtttatctgaaggattgcagcgatcaggtatgctttgctcatgtagatgttgcttcataggaacattttgactccagttaccttctgaccattggattgtacaggattgtcacttactaaatgggctattgaatatgaagaacctgctggggatgcatttggtgaaaaccatccagaagctgcagtatttgtcgaaaactgcaatgtgattctgaagtacgccatttttgtttaccctctttgatatgcttatcatgtatatgtaaattgtatcttcagcacgtatctctatacgatcatgcagggcaattatggacaagtgtggtgattctgatgattgcatctccacttctgaggctgctgaacgagcagctaaactttctgaggacaagattaagaatctgcccgtgcctggcgaagtagaattcataaatggtggccctccgtgtcaggtcagttgctatgtggcttttgcctgtataccagggagctcctaacaacacattcgacattgcaagccaattgcttgaccttttgacctatccttttttagggtttttctgggatgaacagattcaatcaaagtccctggagcaaagtccagtgcgagatgatcttagcattcctgtcatttgcggagtatttccgtcctagattctttctcttagaaaatgttaggaactttgtctcgttcaacaaaggacagaccttcagattgacactggcatcactcctggagatgggataccaggtgcttgacacttcctcttcacttgtgcttgtgctatagcatttccatttctgtatacattctaaccttgtttacatgttcttaggtccgatttggaattttagaggcaggggcttatggtgttgcgcagtccaggaaaagggcattcatttgggccgctgcacctggagagactcttccagagtggcctgaaccaatgcacgtctttgctagccctgagctgaaaataactctacctgatggcaagtactacgccgctgtcaagagcaccgctgcaggagcccctttccgctcaattccagttcgagatacaattggggatctaccagctgtgaaaaatggcgccggcaaaccaacaattcaggtataccctacatatcgcactagcttcactcgccaagttctcctgtccttaagctgccgctttatgtcagttgaataaactttgtatgatgtgctacagtacggaagcggtcctgtgtcttggttccagaagaagattagaagcgacatggcttcactgaatgaccacatatctaaagagatgaatgagctgaacctcataagatgcaagcacattccaaagcgcccaggttgcgactggcatgacctgccagatgaaaaggtactaacatttggccctctaattaacttctcctgcctcctgttttatttttaaactctgtaaacaccaattactgttcattgactgtgcaagtacaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccaggtacacataccaattttcacaccccatacattcactgctgcaacaggttaatgatgcttaactaatcatcaagtcattgactaacccaaacaaacaaattttcaggaagttttatccttcaaagtaaatttagtactacattttgtctcaatcagcactgtagcagtagatttagttctttaaccataaatcaatggatatattgtcatctctcttttcggcagaactgctttgtccattccttcttgaacctgttcaaacatgcattcattctaccgagatgccattattgcatctgcaactttgttgccctttttctgaatcttctgatctgtttctgaatcttctgatctgttcctacatgacactgtcaccattgtatgcacgcagggcttccccgatagctaccgtttcgctggcaacatccagaacaagcacaggcagatcgggaatgccgtgccaccgccccttgcctatgccctcgggaggaagctcaagcaagccatcgacgccaagcgttgagtggcttttaacttcactgcatcgccctcattttttggtcggtccaaataggtttaactaagcattacagttttctatattttgtgagcaattggactcctaaaattaattctgggatggttacatggattaccttttgtatatctaacttgctggtaggactctgataccatcaagatattggttcatagaactatagaagttcagaagagaatcatagcactgggggggggggggatagaaagcttttgtaaacagtacaactcttattaatatgactgcaatatgatgaggattagcataatcagaattaattctcgttttccagagttgtgtattggcaaactggcaatatcagcttttgtgctaggcaaacatgtccctgcttcaaggtcagttgccacttgataatatacagctttcttacacagctaattttttcaaaataaatccttttcttgacctgttggtttattcatatgaacattcgatgtattgcattttgatcttgatgttatgttcagttcacaacttgatttttctttctttctttttattttgagaagggaaggatggatggcttacagttaggcaggctgacaattttcctccaaagcaacttgaaatcatcataatcagcccaaaaaattcacccaaatgagcatactacatcaaacaaatgtaaaactcccttgaaaaatgaaaacgaaaattctatacacaacattgcaagctacagaaatccaagaacacaagcacaagatcagaatcacatcaagaatcctcttagaagaagaaaaaaaaacaccttcgtctcatctcatttcagtgtgttgatgcttcttcatcttgggagcgcgtagccgccataggagctccccatgaaggacgatccgtcgtacgcgtccctctcgtcgaggtacacgttcatccggaacgcggcgtgcgcgccgatggcggcggcggcgaggacgagcgagacgtgctggacta

SEQ ID NO: 953 - DNA, 12623 bp, Oryza sativa
gcctccccgtccccgcccaccaccacctcctcgcgcttcagggaaggcgccgccgccgccgccgccggcgggacggtgccgtagcgcgaccatgaggcggtggaggcggccatggcgaaggcgaaccctaggctgcgatcggagtggatctaggaggccgcggattctagctggaggagacgaggaggggaaatgatttggaagctgtttttttttctttgaataaagaactaaagatccaaattgcaattggggatttgcgagttggagggggtttatttatttaaggagtagctcgatcggcatcaagtgggaaagtggcttgttgttgttgtatcgtcggcagatgaaatcgggcggaattaatgtgtgcttcaagtgcgatggaccgtgaatgtgtctatcaagaggacatatggcgtgttagcgttgagcatctactcatgtcacatgcaacaccatgtctcttagaaagccgggtttcaaaattctatattttcttaaagttaataaaaaccttattgatctcaatcaattatattaaggtgataaaattactccgagaacactttctatctctgcatagctaaaatgcacataaccaaaacatacacccacacaacaaaagaaagagatcatatggagtattaaggatcataaaaaattatgtatttaaaaagtgttcaataaatcggtcaattcttttaataaaaaaattaacatagtaacattacttttttaattatgtcggtttttgtcgtgaaatcacttaggagctataattgttcggtggtcgcgttcacatcttgtgaaagattcgtgtctctcaaattctagttaaagtttactcatataaatttcatatagaacaatttaattttccataggaacaggaaaaaccgtagcatacgaaatagtactaggaccttgtctgtttttcgtcgagttgttgtcaagcctatatcatcacagtgcatttgctaacgaggatctgaacactcattccatacacaccgaatatccaaggcatcactcttagtacacaccacgaaatgcctcaaaaattatccacaggaatcctattttctccaggcaatataaacagttaaacacgttgtggcattttatatttttttcagcacagtttgtttgcttgacagcgccaatcatgtccggccatggcaccctaatgttgggtgattccggacaagagagaaacgtccaccaccactaccattttggattttgtacacttgcacgttgaactgatcttcatctttcccgtgtcccaaccgatgtaccaacacacatccatccatccagatctctgcagatcagattggacagcagcaacagaagaagggatcgaggcacgcttttcgcagcctcatcacgccgcgaaatgggcgaggatgacacacacaccatgtgcgtgccggccccgtcacccaaacgccgtccaaagagatgtagaaagacggccccgagcccacgatgctatagtaatactttgaccatttgtttaatagatgacgctgttgattttttctcatatgtttgaccatttatcttatttaaaaattttacgtaattataatttattttgttatgagttgttttatcactcatagtactttaagtgtgatttatatcttttacatttacataaaatttttgaataagatgaatggtcaaacatgtgaaaaaaagtcaacggcgtcatctattaaaaaatggagggagtactgctcctttcgtccaaaaatataatactccatctgttctaaattaatgatctctttaagatttatcacaatagagtaatacttgttccctcaatcacttttaattcaaaaatttctcttttctaccctcaatcatcctctcacatccaaccacacataatttaacaaaggacggtataatttctttcttaaaccttaatccatactaaacactttagaacgacatctaacatggaacgaggtagtacttatttttctcatcaaaactaaggagtaattaacccatctaccatgtaacaaaagcaatgaacggtagtattgtatacacatgtatcatgtatgtaatcaataagtagtagtaaaataacttcttgggttccaatcaacaatttaatttagcacataaaaattacaaatatatcttaaacttttgaaaaaaccaagaaataaaatagatattgtacttttggatagagagattaacaaaccatgcaaaacgtgccgagatcgcttgtcattttttttggttcaaaaggctgcctcgacttgttcgccgctgatacttcaaattttggggtatttatcgtgattttctaatctcaattacaagctcacacgtctagccatacatagtgatatacttaatactccctccgtaggaacatataagtactcatagagattaaggatgaaaagaaaaaaaatacgatgtctcttttaaaactatagggtttgggaaagttgggcgatgattgatggtaagattatttagtaaaaaaataaaatagaaggtaggtggtaggtgaagtaatacctataaatatttgtattcgccgttaaatattaaaacctctaaaatgtcaaaatgcttatatttaaaatcagggtagtctaacaagaaaatgtcgtctagtaggccagccgaaaaccctaggtgtttctcaaattgagacacattccaagttaacatatgagcttcactattcgaatcctgaacttgatactattcgaatcctgaacttgatgacaaaaatcaacaaaccctagagaatttgaccttacattaatctactggacttcttcaaattgttaaccacttcaagacaatcagaaacaaccttacgccgtcggaatccagagtctaaagccgacgaaattgcctcattgcaagccaaatcaggattcagtgaacttatttgcatgaaagccaaatttgggcctttttgcttgcctgcgttttattgggctccaaattttctacagcacatctccaagcctctcaggccttttctggccaacgctcaaatctcggcctaatctctaaaagatgggccgtaatttcggccttccaaaacgacctcgaagtttattgaacagaaagttgaaagttaaggtccgttcagattgtagccaaaataaacctagcaagatggtaatattatcaaaattttgacatgatttcttatttatttagcaaatttagcaacaaactaaacgtagatatttttttgataactttgctaaaaaaatggtatggttgaaaatgacgtcaaagtgaacagatccttattttaattgaactattcgtactaagataagctgtattgttcaacaaattaatgggagacctacactttgattgattgttattgtatcctacaacgtgtaagtgctctatgttttttttcctccactacctggggtatatttatgggttcaaattatgccatgtattcaatcatatcatcagttaaaaggaggttggcttcgataaaaaaaatggagaatttcatatggaattgtttgtgactgacactggtggagatgacggctggaatcgaacagcaagccgatgatatagtatttccaccaaacaaaaacaaatgaaatttctgttgacttccaaaatgttgatccattcatctgccagtgagctggcaaaaaaaatacagccaaagcgacttattcaattcagtttttatttctcccaaaaataatgccttactgaattttagtgtctaagacttgcagtcataatcctataaataaaacagctataatggtttttaaaggaaaatgtttatgagctcatcaacttctttcaagtccctgtacttgataatgagcataaaatacttgaaactgcagaaaagtttagttccatgtccacacttcagtttcaatgttaacaaaaaaaaatataaaagcaaagtcaaatagcatccagaccgtccatcctaccgacggctgtgatcacttgatcaggagcagtctcgttgactttgctaaaattttattccaatggtgttcctcctctcactcccagatggaattctatactccccgaattacttcctgcacaagtgaaggacccaatgagatttcatttgccatcatataatggtagtattctcctcctcctctataaaatctcaccaagatcttattcataaactttttcctacgccaccatttcttgcaatcttgcagcttttcatctcttgttcctcctagattttcatagagaaatctgtttcatccaatcttacaaagctccttttttttttcttttttcattttcttggtcaaatttgttcttcatctttgatcaattcagttactatttactacctatgatctgctcatttctgctagaattcattgatttctcagctgaaaaacactcactgttccattgcaacaccaagggtgcttgaattttactcggttttcgccatggatggggtggaggaggcgaacatggcggcggtggagagctcgaagaagctcgtggccatcctgtccaagtccggcgacccgttccggctgatggcggccgtcgcggagaccgacgaggcggtgtcaaggttcggcaaggtggtcaccatcctcagcaacagggtcggccatgcgagggcgaggcttggcaagaggaggagctcgccgccggttgatccgggctgcctcatggaccacccgttggcggcggcggcgagctctcctgctcccagcaatggccgcctccatttcagtagtagtgctgctactgcgtcgccgtctccggcaacggcggcggcggcttcctccgccgcgaacgtcacgccggcggtggttgaccggagcttgtttcttgagacgacgctcttggatttgaacagtcgcggcgctcctgctccagctgcatccatggcggcggctgccaagaacagctcgaagcttgcacctgcacccatggtgaacagctcctcctccgcaaatcacatccagttccagcagccgatgaagagctttcagttcgagcagacgccgatcagcgacaagttccacatcgagatgccgagaggcgtcggcggcggcggagggaaggaggtgatcagcttcagcttcgacaactcggtgtgcacctcgtcggcggcgacctccttcttcacctccatcagcagccagctcatcagcatgtccgacgccgccaccaactccgccgcggctgcggcggcgccgacgaccaagaagccgtcgtcgtgcgccaggaaggccaccgccgacgacgacgccggcggcaaatgccattgcccaaagaagaagtccgtgtcaatctcgccaccgtttctcggccatttctgccatgatcttgaccgtgttcttgcttccgatttcttcgcaggaaacccagggagaagaaggtggtcaccgtgccggcgatcagcgacaaggtcgccgatataccttcggacaattattcttggagaaaatatggtcagaaaccaatcaaaggctctcctcatccaaggtagtaaatctcactactaagaacaattaatcatctcaaaattcagtcatagcttcataatactcgttcatctcagttactgctactgatcaacttctttgcaattccaattactatgatcagtttcaacttaagacaagaataaccatctcattatcatctttaaaagacaatagctaatgatcaacttatctgtcatgcctattaatacggccacttccaactgatctgcaatctgtaccctgtactctgcttaatcatgatcaaatgttcagatgaaaaaaattagacaaatttgatgagattgattgtgtttgggtttgatgcaggggatactacaggtgcagcagcaagaaggattgcccggcgaggaagcacgtcgagaggtgtcgcagcgacccggcgatgctgctcgtcacctacgagaacgaacacaaccacgcgcagccgctcgatctctccgtagtgcagcaagccaccgctaatccccagacctgatgatccttagcttaatcaccatccgtgtatctatcagcatcactgcaaatgcaaatgcaaatgcaaatataggattctggaaatctgaacttgtccatgaacagctacttggtaatatcaaatttgtgactagcttgttatgtttgatcatgtacgagtagtagctctaaaaacgtataaatgcggacgctcatataaaagtgcacactcacaattatgaacacacatacatatatacagattaacgaagccaccaaatacgtctatcatgtttaagtcttaacagtttctaccacatcaaaaccagctgagttacgctcagttcgcactcactgatttctctttctggaagttgcaacgcacaattcgtcaattcctagtgtgtctctttccgtctgatgtgtagatgtcaagcatgagtgtggttcgaggggaatgaacagatctaaactgctgaatcattgcaaattctagatgcaaacatcaatgattagtgtggctaattgcatttcgtttctgagagatcaacgtgcggttaagcgcgtttcttgggcccttattgtactctgccaccaaccgattcatgtgatctgtttgttactgatgagtcacgataacactgacacttcggtgttttgagaaatgtgtttttctgccgattcctagagaaaacgaaccgtttctcgtcaaattcttgcaaattttatttgaaacttaacccttaaccgaattataaatgtagatagctggatactatcgcattctgaataatacaacggtgctgggtggttgcatggcaagcattggatagccttaatctaatttgcccaatagacttctatatttttttcaatacaggttatacagcatatagattataaaaaaaaacacaagtgaatcacattgcagccgcaaaccggccctaaatagctagattaatatccaaatcaagatactaaacacttgctcatgctaaattccaaccctagatcaactaggttcatcatgtgaggtgatctacctggagctgcttatgacacccacaagagaaactagctggaaacattgacaaaatccaatttaattccatccaggcatggtgttttcacagatgaaacatatatattcagttaaacaaaaagcagatgacagagatgctaatctgtctcgatcagtctctgacaaaaccacatgaagggaaatcaaatcaacaaagtcattaaggcattaaatgcacctcccacaaagagcgccgataattagtggtgctaagcatgtgcacccgtgcaacttagcttatcaattggcaggactgatcgagctggccaaacaattatttcggctaggattaagcttaattatattttagttgtttgtttaactggaactcgtgcgtgctcatgtgattgattttctgcgagctcaaatctcttccagggtgaacaaatctaaatctagccttgttaaataggagtacttatatatcagacaagttcagagctaatgcgacgtccatatgggcttcgaaatatgattagttgatgtgttccttaatgttctttatttagctcagttgctttaccctcgactttttatgccttgattaccttgatgagaagcatatgggcttcgaaatatgattagttgatgtgttctgtgcttaatgttctttatttagcttagttgctttaccctcaacattttatgccttgattaccttgatgagaactgctcagatatgaacttgctcaggatataaactgtgcctatatacggtatagcaacaatcatggcctttggacaatttgaaatgggccttcatattatgcttacacccaagtttcagcatgttttccagtgtatcagtgcaagaattgagtgttcttgataaatttttgcaacccttaggcctacagtacgttgcagttgcagatccgagagcgaacaagcacgatcttcaggacaagctaataagggcatgtttttcacagctcaagaacaatcttcaggacaagctactaagggcatggttggcacagtttcacagaaaaggagtaaaggaagtgctctcagaaaatgaattggcatagctctagctccagcctcacctgtcctgaagctggaacccaaccaaaagaaacggtttcagctccaccaaaaaaaaagggttaagtagactggggtgctctagattcagagagctccacaactgcactccaaacacaacttcaagattaaacttaagagttgaaatcctaccaaccaagccctcaagtaaattctatccaccagaatcattggttcatgccataggtaggttaacacctcatcatcagggatgacagaacactggttcagttcaacggatgataattgcaatagaaataacatgtttggatataacttcaaaatatctggggaaataacatcagattaaccaaggttcaaaaagtggctgctcggtggacacgctattaataaagtactttggagttccttgttcgacagctcaagctacatactggaagcgcaaacagctgcagatgatctctcacttgagagggataaaccgtgaggagtgggtagcaccaataccaggcctaccgtgcttgactggcttgtacgagatggagaactctgcgaggtagtggccaatcatctcaggcttgatctcaacctggttgaaggtcttgccgttgtagacaccgacgatgcttccgatcatctcaggcacaatgatcatgttcctgaggtgggtcctcacaggctctggcttctcaccagcaggtgcatcctttttctgtttgcaagaattttacaagagaacagaagattagcaacctactagttaagtttgcgtgcaaagcgaacataaagacaagatgattgtctgaaaaatggcataaaagaaccagtaaaggcagagaggattggaggaaccaaaaaaaaaagaatgcactaatagaactcaatataccccacactcatacaagcttcacccagatactttgctgaaccagccagagagtaaaaagaccagagttagctaaattttttaatctaccagcaagaaccacattctagcaaaaatatccacaaaagcaacagttcttatatagactttatacatcacacctacataactcactacaaagtaacttccagcttcatagaaacctagtctgaagacagtaccttcaaaattactgccctgatagaataacgacacgccaactaacatttttcagaaccaaaagggtaaaaagactaactaagctagcaagcatggaaatgtgagacccaaatagcaaggaaacagtaataaatactccctccgttccatattactttttggattgaaatttgacagtttatagaaacatgttttccacaacaccaaactagtttcatcaagtccaccatttcccaaaacatgtctatagtatatttgctttgttttgggaatattgctaattttttctacaaacccaacacatcctgtaatatatagaacaaagggagtacaccgcgacaaataacctaaaaccccatgatttggtggtattaataattcactaagaaaatatcagaaaccagactttgtggagtgcaggaaaaaaataaagcagacaagccagaacaattaatgtgaaaacaatacgtaacacaaaaatactgcgttcctccaactgacaaactaaaaacaaaaaaaatacccacagcataacctataataaaactgagacactaaaaattgtggcaaaactactgccaacatgttaagttgccacaaacaagctctgggtagatttaaagcactggaatgaaccatgttataggtttcaacatttccagtgcaaatacacaaaacaaattaatgtcagcgcattaacagaaagtgaataataaatatatacaaatcatatatcaaacatgtaaccaaaaaaagtgttgttctgcatcagttattcattgctaaatgctaaaagcaagtccagaggcatacattatggtaaataacaattccaacctctaaagactgcatcaaatcagccttacatttccaaaggcaaatttgcattgaattgtaaaacctaaatgccgacccaccacagcattcttttgagcgagtgcagtattaaaacaggcagttagtagcactacggtacgaaatctaaagagacgcacaatcaagttacagatccccaaaatataaaaatagcaagataaatacttaacacataagatctgtatcgattccacattttaacaaactttccatcaactcagaacaaatgactgatgagtatatcaacactcaccgccttgcggagcttcttgatgagcgccatgggcttcctcttcaggcccctctggaacctatcgaaaccaaaaggcacacaacacatcagatcaaagccacccaaccacaaacaattgcaagcattccagcgacgattcaaccttctgcgggcgcgcgcggggaagagctggacgaggtcgtcggtggacatgtcgaggagcgcgtcgaggtccacgccgcggtagctgtacttgcggaacgtcctcttcttcggcgctccggccgcggccacctccgcctcgacctcgacatccgcctaccaccaccacccaaaaaaaaaaaaaacaccaccacgcgcggcgtcaggcatcacgagcgaacgcgccgacacgcggctagggttgcgggagaggcggcgactcaccattgttgaaggggttggggagagctggagctcgaggcgaggggtcggaggcgcgagctgcttggatgaggaggaggagacggcggcggcggcggttagggtttgggggaagagctctcggaagcttatatagtggttggtggtgcgcgtcaagggctgtttgagtgggctaggcccacgtgttccggcccggcctggcctggcccatttcgacgctgtaacgaggccttccgctgcaagcctgcagactcgggcccagagtgaacgctgccgctcgtggtcagcggcgttgtgttgacattttgcttttctatttgaaaaaagaagacgaattgcatggtttgctttgtgcactggacggttgcgtcagctagattccgtactttaaaatactgtgtaaatggatggattaacatccaatccggttacttgcagaaaagaaagttgcgaccctggtttcacaataccagcagattcaatctcttgactatggtatgtatgcaaaatagtatattatggataagtggatttttatatgaaacagtgcagtccaggtagaattcatgtgtagaccatcgttccaaatctggcatggatgtgaatggcgtggaaatggatgctaggttcctcttaccatttttggcgtggtaaccacgagataaaccgtggttttaaaaattgaaaagattaccgtgcatggtaaccgcgataactgcgcggttttgtaaaccctgtttaggtctcaaattcagcatcgcttcctaaccgttgccagcacctccaacaagccctatgtccgctcctcgtcttgctcattaaaagagcgtcgggtctgactttaggttggatccttcctctccagttgccactagcacagccaccaagcttgtcattgtcgtactagctagagccacctcccaatccacatggttcgatttaggcctataaaccgacgatttagcagccactgcccctagggtcattgccactaccatgccgaaaagcaccgccacaatagtcatcaccctcaccgtcacacagtcagatatggatgaaaagtttccactagtagccactgctcctagggccatcacctgtaccaccaccatcattgtccacaccaacacgccgtaaagacaatactgtcccatcatcactcagtcaaatctaggtgtagaacccccattggtagtcattgtccctaggctcaccactatcagggagccacacaaaaccgcgcgattaccatgcacggtaaccttttcagtttttaaaaccacggtatctctcggggttaccgcgcggtttcgcgataaccaccttgccgtgggggtccaataaccacgccaaaaacggtaagggaaccctagggccaacactgatgagcatgttgctatgtcgagacaaccttgttatcgtccatgtacccttgcaacctaatctgggcactgctctgtccactcctcagtgccgagaagcctaccaacgcaaccacttgcgccgccatgcgactagatctaggcacgaagacccaaaattcgacaaccaccacctcaggctccactgagacatccaccaagaagcctagccaacattgttcttaccgttgtacggacgcacgacaactggtttaaacggcggccgcactaccagaaaactaattttcccaagcggccaaaactaattttcgcaggcagaaggaaggtccgcctgcaacacaacgtcgattttcgcagtcggggcaacggtccgcctgcgaaaatgcaaaaaaacgaacaaaaaaaatcgccgcacgcggctcgccgccgccggcacgcctcgccctcctccccggccggatctgagaggggaggggaggggagt

SEQ ID NO: 954 - DNA, 14711 bp, Oryza sativa
gaatgagacttagaaaaaaactactccagcctagtctattaatattgctcctcattttcacaggcggaccatataaggtgcgcctgcgaaaatcattttcgtaggcgccgcttaagtggtccgcgtgcgaaaatagattttcgtaggcggacagcgaacatcaccccaatttatatttttgtaggcggtcatttgtcttcaaaaatcagatccgactgcgaaaataagacccccaacgttagggaaaatgttttttctagtagtgccggtgaggcggaaggcgttggagatggtaaactataacaaatgaaagtgcttctgtttatagcagaaagtgcagtcggtattattaccccaaaacgcgattaatttactttgtggtaacaaaaaaagagagaagaatttactcgatcggtccttttccaagtctatcgcgtgatcgactgtaaacaacaaatccacaatcacatccaatccaaggctgtagaagtaagaaatgtaggccgtagaaacgcagcaaccaacacggctaagatacatacatgatacacatgtggccatgggtagagcaggctagcaagcagttctatgaaccaacccgacatgcacggcagcaaaccgagcaagacgcagctagtggttctccctgcgaaagcggcactggtttttgctatcagatgcatcgcagttgtgcaaacaagtcaccgtttcatcagttgcgtcatgtcagaaaagaaaacaagtttatcccatcataactaggtataacaaatctaaccttttttttaacaaaggtacaatctatcattaacaggctataacactctctttgtttagactaacaagccagtttatgagcccgccgctgagcgctcgaggtagccaagcctgccaccgttggccagtgagagagaggagaggactggaggtgagagagagatagaaagaagataaggatgatacttgaaaattttttaaacattgaaatggaataaggaggtaagttcgacttctgggtgggtccttaagagattcgtctgcgaaaatagactcattttctatacgggtacgctgagaggttcgtctaaaaaatcgatttttacatacgggtctcttaaaaagccatatgcgataatagatgtcgatctttatatacgtgactaattataatctacatgccatctaaaggggtctcggtcagttaacccgtttcgtagtacgtcgaatctaaatgaaagaaacaaccctcacaaataacaagaggtagttgacagatttctcaactattaggaggtagccggtcactattacacgattgattttcctggacgcccactctttttgtttccatgcggtccgtaagtggaaccgcatggaaaaatagggaaccggcgctggggtatcggccgcatgggaaaattgattttcccgtgcaggcgtcctatcccaaccgcacgggatattcctccctcctttccctcccatccacttcaaatttttcatatctcctcctttttcccttttattctctctcaaccactctcacctaaccaggtccgtaccttatctcttgtcaatcggctcccacctctctctctctaccttatctcttctcaaccttttttcaacccctgaaccggtcggcttcccctcctcctccccctcccctgggagaggcggcagctaggcgaggcggtggccgggcgcggcggcggcctgggcgaggcggccaagccgaggtggcggctgggcgaggcggcggccgggcacagcggcggcctggggctccttgacgctcccaccccgctcgtcgctaactacgttctccaccaacctgcggccaccaccaccaccagacgttccaccgactcggtggcgtctttcctgtccggcatggccacgctcggtgccaagctggtcacggtggtcgaggaggaaggcgaagcggaggaggacgacggcgacttggccggcgacgctgcagcggccgggcgcggcggggagcagcgaggcgctggtgcccaggcgatttttccttttttttttggttccgtgcaggcggtataacacaaccgcacgggataatcgattatcccgtgcggtcggtccacccgcgcgcgaaaatactgattttcgtagacagccggctgcagcgggccggacaaccgcacgaaaaaaatcaaaatgctcgtatgaaaaaatcttatctgtagtagtggttgttcttcgtcgcatgctaaataatggtattatatatgttaaatcaaattataaccgagtctctgtccctttgttcttcgtcaacaacgtctaataatgatcaacgaagacgatatggaagtggcggatccagcatgggggcgacggggtctcgagcccccactactggcgtgaagactacgagagaccccacgaagaccccactaaaattttttaccatatgtagataaaaggagggactgtaattttatctagtttgttcagactccactgctatttatttctggatccgtcacttcatatggtggagactagcaggaggaaaaaaaatctcatgcggccatgccagatgctctgtacatgcatgacatacatacataacccgagagagataaaggtgtagtagttctcttttgcgcacagccactcaacttccaccggtgatacggggtggggcaaaattgatcgaaaccaaaagaacgaaccgaaaagatttaagtctaaaaaaataggtcccgactaatcaaattttatttggtcatcatccttcatcctcggaaagattgagtctaaaaagttaggtctcgactaatcgaattttatttggtcatcatcctcggttaaccaaacaaaatttctcggtatctgccattgcctaccatccagagtgtcctggttgatttagcgattgatttctattagagatgggctgcttctgcctgtcggctgccgtacgtcccgacgcccgacggtctgaccgcgacgagtcaccgacgattacatccatggattcatgcaatttatacatgtactctagtctagtccagtccagccctgggatataaatccagtgcataactgcttgttttagctgtgattcgtgtgaatctttgtatcctaaaactgtcatatgcaactaatttggtcacaaccgagaccgaattgattgatctcgattattttgtaatgtaatttggtcttcagttttggataatcgaaatttcctaaaagacgaaagaccaaccccaagatgatgctatcagctatccattgtcagtagcagatccaggaacttttctaagcctgagaagcatgacgacggataacaagtatatgcaaagattatccacatatgcaatgtttatatatagaacacacacgagagaagatgtgctcgcaattgatgccactgttactgcatgatgtcgaaccatccgttgaatgaaccaaaatgggcctcattaggcacaacgcgtccagactcgatcatctgccaagctaatgccagcttgtgcgctagcttgttttcctgtgaaacccatggatttgcctatagcatcaccggtggagcaaagcaaaagctccatagctatccggtgctgttgggccctaattctacccttgtccactaccacgacacaagtttatcgatttatcccatgaaaaacacaacacatcgaggcctagaggttggcgatgggtgggcgacgggaaaggcaggcgacgccagtaatggagtggcggaggaagaggagtgaagtcttttatccactcatatggatgtccaccatgggccgggttagatgtcacgcgaatgcactaagattggtgcgtacacatatactccctctgtactcataaaggaagtcgtttaggacaatgtttaagtcaaaccttgggaatataaatcatgaataactctcaagttgttgagtttgaaaatgtaaaaattatatgaatagatttgttttgaaaaatactttcataaaagtatacatatatcacttttcaataaatatttttatagaaacaagaaattaaagttgtgttttggagaccgtgtcgctgtcctaaatgacttcctttatgagtatggagggagtactccacacgaggaagatgccatgcactcggcggtcgtgggtgctagccccgatcctcagagtcctctacttgttttattttagataatgaattttcattaatccggtctctatatccatgaagaatatactcggccaaaaaaataataatacaagtgcacttagactcataccttaacaagaggagaacacacaactaagagaaaaaattacaaccctggcaaacacatgtttccagacatacttttatgaaacggccaaatttgacgagtgaaagtcatctagacgctgctgcctctagtgcatcttcgttgtgaacagttggtaccatcttcatctgtttcgggtgagctgatgccatgcgccaccggatagcccatctttatctgtcgtcatccaatcagaactagcctgacgagacgcgagtcgacgggatacactttcgctttattagattgctaggtctccgctgcccatagggccgtcactgtcgtaaggatcctcttctgcctcccagactcccagcccgccaccacccctagggccgccacctctgctagagtccacatatttttgtcgaaatctcagtcctccaccactgtcgctgaggataacctcttccaccaggaatcccatgcctccgccgcccttagggttgccaccgctaatgggatccacctctgcctcttcctccccaagaaccttgtgccaacgcacaggccaccgccaccgccgccaaggagatcctttccgcctgtcttggggaggtccccactgcctgtgggactacctccgcctaaaccaccttctccatgccgaggattggccgtcaaagctcaggccgctgccgtcctccgccacccctgccatcggtcgaaggggcgccgctgccgactcctcgctagtcgccgctacccgtcgccctcccaccacttccgctgtcgtcaccaacaaccacagccaagcgtaggcttggtcgcctccgccgtccatgctctccttcgcaccgctctaaccaagcagcaacgaccaggacgagaaggcacatatccaagtgagggaacgccagatctggcctcatcagctcgtgtcgcgcctcgccgactgccacaatgcctgtatctttcagaaggaattttaccatcattgatacctcctagtacctgccagtacactatgtatctgaaccatccgtttgatttgatctaacggttcataaagaacggtaccaggaggtactgcctagtgagaaacgaaggttggttcaagtactaactgtgaaagggcagctatgtaattggagtaagaacttatctctcccatccctctctgttctctcttccctaccgaccaaacagcccgtggtggctctcgttgaggtcatggccgatggaaggggccatctatacgagaagaggatgatggtgtccaagtcgtctgatgttgcaaggggcttcatgtcacctcccgctagagatccaagtgccatgatgtcctctttatctcttccacctgatccatctcacccgcctgcaaatggaggccaagcaataagttgccctagtgagctcccttacatgcaacgagctactacccccatagtatccacagttatctgaatccgaatgtagcaacaaccatgctaaaaaacgatgattcggcagatatctctttcttgtaataacgctatagtagtctcttttacttgatataatataatcagctctgttgcgcaaaaaggaatatgagaatttaccgcctccttaaaatttttataaatctattgtaaaccacatatccaaaatcacatccaagattgtagtaccaagcgataacgacataacatatataggccacataaatacataatataagcaataacatgagtcactaacatgtaggcccattaaatatatggtccatatcggcagctcaaaattagaggttcgcactgtagaaaatctgttcacggacacgtgtcgaaagttagaggattgtaccgtagaaaatccgtttacggacacgtgtcaagtgtcgaccacaacatatgtacagtcatcgtgccattggtagcaacgctagcagcagtcctatgaacacgacatggaccggtagcaaaccgagcaaacggtgtagtactacatatatgtcgttctccctgccaaaagcaacacgtagtcacattgctgcagttgccctaatgccgcgatcagatgcaatgcaaaccagcccccgaaaaaaaaagttacaaaccaaagtatatcccagataggagtacgtcgcaagctgaatggacatttacatttctgggtaacatagaatacagatagcttaatcatcatgttcggtcgatgtcgctggaccctgttactgaaagcggcctcttccaaaaaaaaaaaaaaagaactttcgatcgaagcgtgcagcttcaattgctcattttgctcgacgagaagagaaaaaaaatggagattggaacgatgtattatgagtatccgcgaccacgagcgctgcgacatgcttcgaaatggcccctttgacatcgcgtgtgcaggagccttttacgtgcagatggggttcaccaagtgtgtagtaattaatttcggtactgaattccgaatccataaggaagaatttaaagaaactaaccctcacaaggaacagcaatatagtattcagatagattttccagcaaggagccagcagcagctcgtcaattacaggctaaattatggctttattatgctgcatctttaactaattaccaagtgcctctctgtacttttgctcttcgtcatcgtctaataatgaccaacaggagcagaaaaaaggagagaaatatcccatgctctgtagatgatgcatatataaacctgagagataataataaaggagtagttcttcttttgctcacagccactcgccttcactgcaggtgatgctatcggctatatcccactgtcacggttgcaaaaactttcctgcgacgaaaacacgaccttttccggtttaaagatgcgaattttctcgctcagattggtgataatttaactttctcgtcgcaaaacgagattgttaatttgcgcgtgcagtagcatcagtttgagctgatttggccgtaattgcagccgaattttgggcatatttgtatcacatattttaggacatacatgtttgtgtgtgcagttcagttgctgctgtttgggcgatggatttgagatgctaaaaatgggtttaagttcgggagaaacacgacgaagtgagggtgcccaggtagaaaagctagggtggtttggaacgcggtcaacctcatgtttagtgctgtcctcgctagcagccaattcatatcccgtgcagtacaaaactaaattcacaattcgaaataattcatccttgaattccatcatatcagcgagtgaaattcatatttagcaccatggcgatagtcagatggccaaccataggtttcgtgaattaaaccacagcatatcatacgggtgagctgatggtacacctgtattgccctaataccatcttgctgtatatctgttcatcgatcttgatccaaatatgatttaaccaactcgaatctgcagatcaagataaggtttatttggttttgaaaacgccaagaaatgagtctatccatatgcgtgtccagttcttggtcgcccagacccacgatgaaccgagaccatgcagctaaccgatcctgggttcggtagacaaacaagtttcgaacaggtttgagttttttctgaacttgatgtccatctttgacacgttggaaacatcggtttgatttcattttgaagcaaaagtttacaattcgttagacgttctatgtgttggaattccaatttgaccagctcatgccaacacataagaggagtactgcaccttgtgcctactttgacctcttcctgcgcaaatcgattcgtcaggacagtaacgaaatctctcaaaaagttcaaaccaactcgtaattccatcacgaatccgacgcagaattcaaactgcggtgagaaaccgacggataaatatgagcaaaatttggatacatgaagaacaggcaaactcgtatcacctggtaggcagctatgctttccccaacggcagcaacgagcttttgattactcccgtgcagattaatccggtttccgacgtgctaatgcaaatgcagctgcagggtcgcccccgagatgaccggagccaccggcggaggccatttctccggcgagacggccggcggccgcgccgccgcgggggccaaacccggggcgaactcgcacaccggcgccgagagtgctccgaagggtgtgtcagttgcgccgcgttcaatccccccgtagaccatcgaaacggcggcggatcggcgaggttccaggctcgccggattcccttgctagcatgctacatcttgaccccggctagccggaatgttcgccggagcaccaccgctcgccggccggaaatcccctccaaactcacacaaatccgccgcccagaccagtccggctttgccgatcaatatctcccagaatacccaaccaaatcgaacaaatttacactcgtttgaaagccatgctccgtgcctacaatctggaaaaaaacccattcaaattggtcgatccaattcggagaaaatcgggtgcaaatccggaggagaagcacacttctggatgggtggggatgaggccgggcggccaatccaacttgaggggggcagcaatccgtggcacgggatgaggggtgcacacgaccgttggatgggttcggatcgggcggctgagattcaatgtggggcgcgtggggtggcgatccgtggggaggccgtttcggccaatcagagcgcggcgttggcgtctccccgtcatcgcgaggcatcccactatataaccaccgattcctccgccccgacctcctcacccacccaccggcgagcagctgctccgacaagcgctctctctctctctcaactccggcgaggctcacgcgcgctccgaagcttcggatagcggcagtagtcagtgcattgatggcgaccgacgtggcagcgactgagcccgaggtggcggcggaggaggctgcggccgccgcgcctgagaccacggccaccgccggggattccaagccggcgaaggaggccaaggccaagaaggccgccgcgccgaggaaggcacgctccaccgccacccacccgccgtacgccgaggtaagctttgattcgttgctgctgtttgctgtgtgttctgtggctggatctgacgtggtggttggtcggtgctcgtgcagatgatctcggaggcgatcgcgacgctgaaggagaggaccgggtcgagccagtacgcgatcggcaagttcctcgaggacaagcacaaggaccacctgccatccaacttccgcaagcagctgctcgtccagatcaagaagctcgtcgccgccggcaagctgaccaaggtcaagaactcctacaagttgccgccgacgcgcgcgccggccgcggccaagcccaaggcgaagcccgccgccgccgcaaagccgaagccgaagccgaaggccgcagctaagcccaaggcggctgccaagccgaaggccaaggctccagccaagtccaaggccgccgcgaagcttaaggcggctgccaagccagccgcgaagccgaaggcggcggctaagcccaagtctccggctaagccagccgccaagcccaaggctgcccccaaggctaaagccaagccggccgcgaagccgaaagccaaggcggctcccaagccgaaggcggcagccgtgacgaagacgaaggcgacctcggctcccgcccggaggccggcgaaggcggcgaagacgtcagccaaggacacgcccagcaagaaggcggcgccggcggccaagaagcccgccgccgcggcgaagaaggcgcccgccaagaaggccgcgccggcgaagaaggcggccgctccggcgaggaaggtgcccgcccggaaggcgaagaagtagagctctctctccggcgagcgagcaatctagggcttcatggttgttttcttagctgtttttttttctcttctctttgttgttagttgcgaggaggggtcaggggtactagcttgtaaatttgatatcgcggcgggggtacactggtcatttcgtacccaggtggtggtgcgcgacgatgatgacgacgacgacgagacagtttgtttttagggcaatgtatttctgagtagattggtggagtttttattgtggtaacaatcttgtgatatttgtcgaaatcactttagctaagtaattaattatgcagtaattttacttactgtattggcttgaccacaccctgtattcctctgaattttcagatctggaaattgaaatgaaatataggatttgtgacttggcgtgtgatttgggttcaaaacaagcatgttattgcaccgatcgtacgctgttccaaatttcaggtcgcgtgtggtaccgaactattgttcactttatgagctgtaaaaaaataaattcggtcttaaatctggatgtatctgttgtcaaatttgaatattcaatcaatgcaagtatccaaactgatattaggccccactaatttcgcttatccatttggtttatgggccttcctagtgttatcgggctttgaaacttcaaaaggcccgggcaaatttgaaacttcgagaagagagagagacgcttgtgggctgggctgcctgacaggtagcatacgtggccagccgtttcgttggacacgtggcagtctcgtcctaacggacacacgtggatgccatggacgccgcgggaggccgcctcgatttttgaaaaattgtccggaaatgtaggggtcggaaagtaagattcgctgtacataaccgccagtgtccagtgacctggaactatttggatgcgcgctccgtttggtttgaatttttttttttcacttttgaccctcttccgggcttctgctactttctctgtcctttgctttctctcttgcaagttgtgaaacttgcaattgcaatgctgctctctgtgaccttctctgctactctctcccgctgtctggcttggcctaggaggatcaacggtgtggccttttggctggcacacagaaacttgcttgttccgttaaccaaaacaagccgtttgcgtgcgtgttcgttcaatcccatgttggcattcacaggcttgtttgtttcatagcgatttttaggctatgcctcccgacacggaaaacaaaacacacgattgtagcgagattaattaagtattagccaaaaatacttaaaaaatatattaatatgatttttttaaagtaactttcatataaaaaaacttttgcaaaaaatacaccgtctagcggtttgaaaaacgtatgcgcagaaaacgcgggaagtgggttaggaaagatgggataataacagagccttatacctgtttattttcgttttgttttttttttttgcaaatggtaaggatgtggactagtaagtgatatttttttggcatttattaattatttttgcatggttagattttttttctctctccctaccacactcctgccgtacctgtatatttcatgtgactgcatctttcgtagcagtaacctttttgttatctcatgccagtagccagtgtatatctacatgactaatgaaaatattgtaggtgtaatgtgaatactcaatggctgtaagcagggtttcatttaccgccggggccgcggttaccgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaaacgcggtaaccgcggtaaccgcgcggtttaccgcggtaaatgcaaccctggctgtaagcctgtaacgcctaacgaccaaggcaatctaaatctaaagaaaaggttcagaacaaatggcccagtccagaccatccattggcaaagccatctttacacatcatctcccagcccaccaagcaactggcccgttaggccgtcacctctgtccaggcctccaacccaaccacaggcctagcagtagccagatcaggtttgtttgacagaacttcaactctaaatttaacttgaaaagctggtttagagtggagtcgtggagcagttaaaacacaacttcattatttttgtgagatcactctctagctccgcttccaatcagtgatgctgaaactattggttgagctaactacaagagaggtagagctgaagctagagctctgctaaattgaccctttattaatcctagtagtcactagtcaacggaagaaaaatgcttagccaatggctaatactcccttagtgacagcacgttacatatcgaaagcacttttggtatccttaattttgcggctaattcggtcggcgtgaaaggcctacggcggcgcctaatgccagacacacgtacgcgtgctgacatatagagtacatgataattaaactattaatatgatattaaaccactcttcgtttggaaatctcaaatcctgctttatgagacttcatctgtaagctctacaagatgatctcgaaacctgatttacttggagaaagataaagcgctaattggatttggtatcaagatatcatgatacagatgcattagctacccttttgcttacatgcatgaagggctgcctttcgtgctaatcaaagaagatacaccatcatctaaggtttttattatctctcttaagatgattatgttagacaacactactgtagaaaaatcattatatactaatacttctatcacatacgtcttttagtcagtgacacatgcgactaaagtaaattagctaggcttatatgttagtgacttaaagacttaaagttatatagtgacttaagtcaaaggattcttgtcagttttttctactactctgtaataatgtatcctgatggagattatttttgcagctctcattttatagcagtgcaggattgaatccttttgttaattagtaggcactcactgatcactaatcgtcactgctatatgtgtactactaatgtaggagtacatcggttagttgttggtgattagaatttagaagtagagcactctaccaaacacgtcgtggacccaaccaaacagcggcattaaaatgcttgatcactctggaaaaaccggccaatcgagaggtgagctgctgtgaggccaacggttgaccagccgaattgtcaggtagaagcatccgatgttagagctaagggtgtggtgtgacaggtcgcctccacattgtctccccagctatgaggttttggatcttctatgccaattattgcaaaggttcattgtatcagtgctgctatcactcacctaaattttatgtattagccttgacagtatgtagataacatgttgaatggtaaatatgagggatcaaattgacactatatatttgaatagcattctgggtgtgttcggctgcaagtttctaacagctgctgaactgcatgcgtgtatgcggctgcggcgcacagccaaattgcactagccacagctgcaactgcagccgaaaaatggctgccgaacacaccctctatagtttgctagccatgtctcctgcatttagacaattagccgtataacaaaataaccaattcataagagccgtatttgtatgatagaaatttcttgaattcgccttttggtgacatcgagttcatcaaaagaaattcaacacaaaccaaacaaaatatcagatcgaatagggtagcttcattttctcgaaatgcaaaatactatattatatatgtattagcataaattaaaaatgtccaacgatgaacatttctctgcgataaaaacatgtgaatgttgcagagcataacctgtgcttttttgctggcacaaagaggagaggagcccttgatgccaacgcctcatttaagcaaaagacaatcttgatcccggaccaatcaaatcatcaagccaagaaaaatggttgatgctcagcctaacttgtcaactggtttttcagagagagaacatggatggatagtggatttcttattgattgttgatcccacgtgaatagatagtagaggaaaggtaccaaagagaaaggtaggtttaaacacatctgtgatgtggtatttcttagcgttggtaatctaaaataagtgtaattttacaccgttcatacccaacgtttgattgttcgtcttatttaatttttttttacgattagtatttttattagtattagatgataaaacatgaatagtaatatatgcgtgactaatttcttttaattttttttataaatttttgaaataagacagacgatcaaacattggacacggatacctacagctgcacttattttagaacggaggtagcatgtactctagagtagtactataattttttgagctatagtactgtggctgtgtttagatcaaagttaactttggatccaaacttctaactttttctatcatattaatatctcatacacacaattttttagtcacgtcataccaat

SEQ ID NO: 955 - DNA, 30860 bp, Oryza sativa
tcacgtcataccaatttcaaccaaaacttccaactctagaagcaactaaccacagcctgtattagtttttcttacattttttcagctgataaattttgattttgaacggcaccgaacgcagcaaatggcatatgaatctgtgaccgtgagctgggttccaccacttacacgtgggccctccccccttggccacgcacacggcacacctggggactctgaagaaactctcggcccctaccctctcgcacgagggagccacgcacattttcacacttcactctctctctctctctctctctcgtgcgccgcgccgcgccgcgcggcgagggtggtggtgggtgagcggcgagccgagccgggccacgggcggcgccgcgggaggcgtcccggcgagcggaggggaggggggcatccgagcgctgggggaggtagctcagcgggaacgggaacggggcgatcccccccggcgttctcctccccggtctctcctgtagctagctagctagccatggcggcgaatggcgagggtggcggcgacccggcggcgcggaggcggtgggatctgacgaacaagggtgccgagagcatgtaatggcagtggcaccagctgcatttcggtttgtttgtttattatttttttttttttttgggggggggggggggtttggctcgtggtgtggcgatgttcatggagcaatgttggtggcggagttcatcttccagctgggctgctggatctgctcgatttgtgcttggtttatgcgagtttttggtgatttcagatgggttttttccccttggtctacacggggcagctagggtttcgttacctggagaagatagattggccttagatactgttgttgttgttgttgttgctggtataaatctcaatacggtagggtgggagacggatttctgtaagaaatgagcttttccggaggcaaacgaaagagggatttcaatattaactagtggaataaaaaaaaattccctgttggggaggaaggatggggtagatttataggcatatcatgcattattgtcaaggtcattgcagtgaatttatgtgtgaactcgtattttaatgactcaacctttcttcttcttgagcatgctgaaccattcaaggattactgtgagaaatttctgatggatatgactttgaactttcctgcccaatttcatatgtactgtgtcacatccctgatacatttttaattgcagctgctgattctaagattttgagacattgcctgactcttagtgggcttgctgttaggattgtgctggttgactttgtgtggagatatcttatgatctgctgatgcacaattgtgatatggccattttttatgcaaagctttcgacttttgtttagattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaatggtgaaagaggctgtggaaatgtccacagacgaagaatcagacggtgtcgttatatgtccaccagatggcaacaatgatgatcgagaggaagccattagtagtaataatcatgataattgccaggaaggcgaagtcacttgtgttaaagacccggttatagacagtgaaacccaggaagacaagtgtgtgaaccaagattcagttaagttgatagatcaagagaagtctggtccacccaaatcaccatctaaacctggcatttctgggtcagataggtccaaacgtactgttcctcaaccatttgccctttcttctcaaagaaaatctcatggaggaaatagtaaggcggctcatccatctggcaatggagaaaattctggtgataagagcaactcctctccagcaagtttgacaaagaaggtatgactattgtcatatatacagtattatccatatatcatgatgctaccaatatcatttgactcttgttctggtttttattattgcttaccattttatgtttctttttattttttgtattctcaccctaaatcatatcatgtatcttagtactgcctaggttgtctcactgagtatatcatgttcaaggctctaagctgcctttagatatcaaatttattagattgatgagccccattatatgttgaaggtttgttttgcaagtaaacatcgtaagcttgttctgtgaagtgtgcctaaacctatttggtggcatacctgtcttcttagtaccagactaccagttgatgtatctatttgcctgaaaatgttatgttgtaagcctaccagagatagctggttctgttgacacaactgataattattgcagactgcaccgattactcccaagaagattgcacagcctgatcatatgcttcaccatcaagaggaggactcctgctctgtgacttcttcgtatccttcttctatctaataaaaatacaccgtgtttctattttttttgggttgtactgtgatgatgttttctgcctttatttcttgtgaagatgtttctaaaatattgcatgagaaaattcatttcacataatgatcagatatttggttttcaattctagagtgatgactggaaaaaaaatcgatgttaaaaatgattagttctgttaaccttaattggttttcagttgatttgatattattctttgtagtgaaaacattgccaaggtgatgttctttctactcattgtttgaaactattgtatacaatttggcccctttttttttcctgagctgtgtaaagaaccacaacttcaacaagagctggcaaaaccaaggcaactgttggtgttgccccttcatttgtatgtgctgatcgtgctgacaagagaaaggaggtgaatatgtagtttgattgcattatttcaagatggcctcttaaatgtgtttgttatttacaaatagcgatggcattttcttttctctaaaaatagctggtgctcatagtgattgctgtttcttcagttctacacaaaattagaagagaaacacaaggccttggaagctgagaagaatgaggccgaggccccggaaaaaggtatgaatttccttgtgggggagaattgaattgtaggatacttaagttttgtttggtctgtgctattttactgggtctgttaaacatggttttaattcggtaatagctaaatttactctacgcttctgtgattctccttaattaatgcttatgaaatatttgtctcaacattcttcgcccagattcagccattatctctttttttttcatataatatattttggttcttagatatatcatggagagaggagtaatacaacgcctaagatttatgtgctaggcagaacatttgaatatgatactttttgttgcccaaatctttctataagatgttcatgttgatggacaactcctggcaactatttatttaccaatttacctcaacattcatgttcatttttttttgtgtaggaagagcaagaaacagccttaaaacaactaagaaagtccttagtcatcagggcaaagcccatgccaagcttctaccaagaaggacctcctccaagggctgaacttaagaaggtagttctgaatttctgatgttttgtgtttcttttggaaacatgtacttgtgattgtcagtcttggcaatgtggagatatattgctaacttctaggaggagattgttggttcactggaatgagaggagtccttaatttacttattttcactgaacaacatatttgccattttgcccaaaatgccaaaactagttagatgtacagtgataacacaagaaagctacatttgagaaagcttttccttctttacaaggaatatatacaaatctatattatttcttgcatcatgtatcttaagcacagttttaatttccataattgatgattctactggtgggcaatatgacattcacttgtctttgttctttgaaggtccctccaactcgtgctaaatcaccaaagtttacaaggaggaggagctgcagtgatgcaccgccgacgccagaggcagcaaataccaccgcagcatctagtcgatcacatcgtcacagcattgcgaaccctaaagatgctaacagagtacaatgctcaccaaaaaatggcgtcgctgccaaaactagagctgtcaaacctgtgagctgaaggccctctggagattctagatcagccaagtgttgcgaatgtcgctgtacaaacctaactttagccgtctctcggtttcatggcattttgcatttgatttatacttcctgtcaccaaaagaaggccacagtgccgaggccggtgtgcttgcagctgaaccctttcatttcttttcttcttttcgcgttgctgtgtaagaactctgttgctgggaccatgtactgtgttccttgttgtaaatggtcgagggtttctgtcagaactcagaaggaagacactctgcccttttaaagcccttgatgaaccgttgcaatgttttgcttgatatttacctgggtttgcagatcctctagcattctagatccctgtcaaaattctatgctcccatcctgtgaagcgtttggttcatggtgtaattatcatttgccctaaatcaaatttaacaaggtgggggtcatttcattacacagctgacggctcatcgtctgcaacatttgagagatgaacgaatgaattttctgagtattgccgtatcggatagacagattttaccatgaggtggagtgatttaatttaatttaaccaatagctagtcgttattggcatcatttttgatgaaaattttatgacaattttcttgtctagataatgctcaggagtcgctgacacatcgatcggaggccgcttaagaggataatctaatctgacgaagttataataaccaaatcgggcccacgcgccagcgtcaagagtgcaaagttttacctgtgttgggtccggccggtgtgctggacatttcagccactactgtcaccaaacctggctactggggtacttaactgtccatgatcaccatatttttcccccaaagaatataatcatgccaactttagctctccttgcaaaatgtaaatctaccgacatgtttcattttaaatttgatcgttacctgtttgaactgcatgaattttcagttgaaatggaccaatatcaatatttccagggttgatattgttaaaggggagatgaagtataactgacgcaaggcatacattgtttgcagctaaacagccttttctgcttgctatttaattcataaaacaaaggaaatgataaagaaaataaaactagatgcgaaatatgacctctttttagttggaaactgtgaaagctatctgtttcagattgaaaagaaaagatcaacattaacatgtctcttcttttattcccttcaatcttctgttctcttccagcctgtaatgacgagttctgagaggctccccatctcgaattcatgctccatttgacaactctttctatgccctttttattttttttttgataaagaatgtagttattgatgcaaagtaaatttcttattttatgatttgtctattggtacctttggtagttgacgagtagtgctgcaaggacaaggaaaaggggagatctgaggagcagtttcttctttcctcattcctctctcctaccctagaacaagaaatgatccttgatcccttctaaaattcagacgcaggtatgctagatgagtcattttatttctcttcctttagtcaccgaggcaattggagaattcttgtttagtttgatttgctttacatttccgactagattttgttctgtgaacatgggaggcttgggctatgcaatgggttcctcatgtgggttttttgtgctaatttttgtagatgattttgaaagttaaaattgtccgcattcttgctatcttgcctgcttactggaagttggtcataattcgtccgtaattttggaccgttcagagttgtaagttgtggaaatagtacaagataatttactgaaattttactttgggaaatttgatattgaggaaattctcttgttctgctgcacagctgcaaccctaattcttgctaaaacccttgaccctgattctctctacaaaatggtagtttactgggatatatcaatctttagccgaactttttagtgatataacctcatactttgctgctctcatgcaaaatattatctttcaggaaatataaattcagtgacaaattttcatccaaaattgacattaatggctccaagaactagtactgttataacctggagatatcagcagctctttgttgtactatcttcagtaatcctggaatgggttttgatgcttcttctgctttttgaggggctactatcctatctcgttacgacattcgcaagcctttgcaagctccaccctccatgcccaatgtgcacaaggctagatcatgtctttggcatggcgcaaccaggcttctaccgtgaccttatgtgcaattctcacaaggcagaagcatcatcatgggcattctgccacattcaccaaaagcttgtagatgtccacagcatgtgtgagtcctgccttctttcatttgccaccaacaagaagtcgaaccttgcgacataccggtccctggcggggaagctcggtgtcggcatcggcaatgaaggtttcaggcctagcttcagtttggacaattcatctgaagcatcagttatcaaggaagatattactaatattttgtgttcatgttgctcaagcccattgaaagtgaaatcatatccttctatggttcttcagaacatagctagtgccattgacactgaggtgaatactagacatgtctcaagagatcagcttattgaggagatcagtcttgtcaggtatagtgagctgaagacttctgactctgaatcagagccctggcaacatggtggtgttgctagcttgctggatgatgcagttgataatttgaaggaagattttactttgagccatccaaaaacaaaatttgcaggtgttattcctacagatgacattgcacaggatcaagtggctaagaactctgacttgatacaactccagaatggtggttctgacagtaagaattctcaagtttcagcagagttgtaccacttcagagctgatggcaatgcagatcttcagtcaactgacttttccagcaaaactgttcagcatcctaccgaagattcagacacaacaggtttgcactatcctctccaaatgttaaaaaaaaaaacattgttggattaactattcacttgcttagagtattgacactggtttttcttttcttaagtagataaatctgaagatgatgtttggcacaatgctcttgattccatcagtgaattatcagtgactgataagcctgccgaaaccagtaccgcggagaatgaaccgaaagctgaatttaccgatagaactgcaatgaaggattctttcaaagctcatgaagatctgcagttactgttgtcacaagtttctccaaatgatgccatcaatatccctggtgtacaagagcaagccatactgaacaatatcactagagcactctctcttgacaggaattattcaggtagtatttctgagagcatggccattgatgaagctgaagaacattgtacagttgatcaactgaagaagcaaatcgaattggaccggaagtcgataagtcttctctggaaagagctagaagaagagaggaatgcttcagccattgccacaaaccaaaccatgtccatgatcaccaggctacaagaagagaaagcagcaatgcagatggaaaccttgcagtatcagaggatgatggaagagcaaagccagtacgaccgtgaggatcttcagaagatggctgccatggtgcaagagctcgaagccgagatcgaaggctacaagaccaagctgagagaccaatcgctcgttaacgagatacgcgacgcgatgcgcatttcacgttcagaggaatgtgagactagcatgtcaagaacagctcgatcgctctcattgttcgaagacgagaaggcgtatatatcaaaacacctgaagaaactaagacagaatctccaccaattctcaaacaacggcaagttcatcgacccgaaaaagattgacgacaaagaagacacatttgatgtcacaaacagtgaggatgtataccaagatgctgatgaagattcagaaatgaccaattcagagaattcagagatgaccaatgtgataagaaatggtcgcaacttcaggtacttatctaatggtacagagggattgacaaatggtaaagatgatcctgagggtcagtactatgcaatggtcagtgagaatgacttggttaattttgaagatgagatctctgaactcactgcaaagctgaaggcactggaagaagatcgtagcttcctagagcacagcataaactcgctgagaaatggccaagaaggcaaggagctgatccatggcatcgcttgcagcctcagagagctccggaagatggggatcacttggaaggattgtgattagctgaagcttcatcagaggatacacgtttgacagaggtaatgcagattcagttaggtagaagttcacaagtactgatctatataaattcatggcacattatacaatgattgttccttaattgatttctttatctctctcatgattgacatggatcacttatcatctcaatggcctcttattatttatctgttagcttatcagtcgcacagacaaaatttaaaatttcaaacttaatttatttacagttgattttcgagtctttcgtcgtagtctatttttcacctctgacttttaaacaactaacatcatgaatatagaagttttacacataaattatttttagttgattcttcttttttttacaatttatcagctgtagcttgaccgatcacttatcatctctaattgacagttgaccacgtggctgcaggatgtaaactgtaaagagtgatggattaagctgctgactgtatatgtgctaatgtgcatgtgcacacggcggttgctgtcatgtcatgcggtggtggtaggttttgggccgttgcaagtgcgccgtgctcttcgcgtggagtgttccttgtacaaatgcagtgtggattttttgagtgctcagaattgaccaatatgcatacacaccttttctcagtgcttgcttaatttgcagttttgcacatctttcatgtatttctttttatacttttaagtgggattgtcagcttgtctgtatatattgtcaaacaatccagcatttcatctcgacaagtcgacgacaggttgagtcaatcaggccaaaatgtcaaagaatcgactgcaaaaatttgctcatgcattgcatcgttaaacctttttcttttgtgattgtaccgatgacgcatacgcacacacaccactaacacacgctcaaagagacggaggcgaagacattatacatgccagttgtttcctgggtcctgtttttatttttctttcttggggctttttgcccttcgacagtataatgttgttttgaaaccgactcgatttggttggctttcttttctcgttcttggttggatgaggtgcttccctggctgctgcgacattgtaatgtcgttgtaacatttttaccgtattttttcctctaaattttattgaaattggtcggccaacctttggttggcccggtagaaaaaaaacgactcgactttctctcttaatacaattcggttggtcgattttcggctgaccgggcataccatcttgtcgaaacttaattttggcatgcagctaaggtagccggctagccgcaccggtcggtttcagcgcgtgtgacacgcagattcaggctacagatcgaagagctctgaagtctctgaatctgacactcacgctgaccagattaaccgaaagagagcaatgtgttaggcgagttgcatgatccaatcgatcgatccaattctacctgataaacaagcggccacgcgtacgtaacgtacatctctctttctctcaggtggactccaaatctatctccaattggcctagcttccaaagtgcgtgcatagcttaccgtttctctgaaaactcttgccgacaacgtcttctcttccagcttcaatcccactgacaatcacacacacgacaatgcacgcacgcgcacaacgatgagagagaaattagagagatggatagagagagagagagagagagattgacacgtgagaaaaggaaaggaatgagaattcaccacgcattacattagtttccttgctgtttcttctcgctctgaagaagaagaagaagatttgctgaattagtcgcatcctgtggagtgttcgtccagcatccaagggaatgatcggctgctagcgatagtcaaaccacgatccaattacgtctctctcatttccaaatgaggcacgctcgatcgtgcattcatgtgcccgtacacctgcgtgcgtgtatatatatacacgcacaagaactgaagaacacaacaaaaaaggcactgcaaatcttgttcagataacagcaagtatatattcagattgttcatagttcatttattgttcataattcagataacagcaagtatatatatacagatacagatagttcatagtcgattgatcgatcgaccatgaggcatgttactttcttcgcggcggttcttgttgccatcttcctcacctccggtggcgggaggatgagcagcacggcggcgcggccgacggcggtgggcggcgccggcgcgccgccggccgccgtggcggtggagctggccggcaccggcaccggcaccaacgcgtcgtcgcagccgtcgaactgcacctacggcaacaacgtcggcggccagtgccctcccactcccggcgctggccattagcaagagcagtgcacgtcgctgccatcaaatcgtgcagctgagctgcgtaattacgattagatattgtattaatcttgtgaatttttttttcatccgatcatgtagtattaatctttcctgtagcttgaaggtgattgcatgatcaattgagtctgtaattctgttggtttggttgtatttttttttaacttttttaggtaaaaagtcgggtgaattgatcacctgtttaatatactgtaattatctgttgcatggttaaacagcagtaattgcttcgtgcaagttcatttcgccggtttggattaaatgattaattacttcgaccaagatcaattcgctttaaatgattaattagatcaaagatcaagatatcacgattcacaaggccgagcccatggagagattcagctgggccatgggcttttttggtccatatggtgacagcttttgcgtcccttaatttgcagctcgctctgtcgaataatttcaacgtagttgtctgttactctgctagtctgcttaactgcagtatcagtttactttactacttgtcgtttatactataattttgctaattacagtgtcaccttatcttgtttggtaacaattcgtcagtcaagaatggcaagtactcctatttgtgaacggactgagtcataggaaatgaagcagactatcttttttttaacagattcatcaggtttcagtcgtgagaatctgtcagctagtttctgttgtgaaatatgaaatgtagaggacacatatatagtatttcttttcttgtactgctcattgcgtacatgtgcagctaacaactcagccgttcagaggagaggatggataaacaattcgtgcatatatacccaacaaaccattgctttactaaagcttaattataaacattaagcattagttgcgaacctgttttgatcatagcaatcatttgcgttttgatcatagcaatcatttgctcgaacagaagtagttagagcatctctaacaggctctccaaatctgactctccaaatatttatttggccatctctccatctaatttgacaactcaaactcttttttactccaacagcctccccatctatcatctccattacaagtttatgacaaatgggacccatatgtcagcctcaactacccttcttccatactgattctttttccccacctatactacatttcctttcttccttccgtactactgccccttccccgcaccctctacctcggtgcggcgacggcgacggcgacggcgacgacgacttgcgtgcgcgcaaggcgcgggcgggcgaggcgacggcgactcgcgtgcgcgtgaggcgatggcgaacggcagcgacgcctcgtgggagcccaaggcgacggcgggcacgtgaggcgggcccgcgaacaacagcgaacgtcgagcggagatggcaccgagccggcgggatgcatcacgcggatccgctcctcaccggcctcccttgccgtcgggccctctcccccgcaaacgatggcgatggtggcggcggcaaatggcaacgacgacggcggccccgggaggcataggcagaggcagcggaggccgccgctgccccagaatccaccccgccagcaaaatatgcacgaggtaggaggccgcgcggcggaggtcgccccctcctcccgaatccacgccgtgctgcccgaatcccccctccccccgagtcgaggtcgggtggaaccggaggcctccagacgacggcaatggatggcgacggtgcagacgacggcggcggcggctggcgatggagaccttggcagcaatggaagatggtgtcctcgatgacgatggtggcgtcggtgcttctcacactgactaggggcatgggaacagagaaaagggcaaatgagtgtctgacagcatggggcccacggttggtaacctggtttggccagccgtggaggatggccaaatttggctagttgggaagccagcttggccagccaaatggcttgccattcgtttagcaaggctgttggagtgtatattttcatcaaaatagctaaattttagcttggagagtctattagagagtctgttggagatgctcttactacttactactggctagtactccgtattacatatgccaagagagaatcgttcatcagcaggcgaggaaacacaatgcatgaagagtgtttgtgcttgtgaactatatgcttttttttcgggaatacgcaaaaggtttgcgcactttttatattaagagaaatgaaatttatacaaatggcaaacaaagaagagagatagggaaaaaagggggaaagggaaaaaaagacttaagcctactctcgctaatacaatgtgacgactgaacgaccaaacacgctaactagggagcactggtgacaggggattggactataagctttgatgagttagtttttgtttgagatgttgtttgtttttaattcgactagagccatgtgagaatactctacctccaagagaacacgagattttgtttccatgcatgcatggacaccattaacatccacacaacagcttattacataattcaatcatattaagttagacacgggagcgaagaagaattacgcattcgattgattcgaatcactagttgttcatggaatcagaaaacaagaccgacgaacagctgaacatcgatcatgcatgtttcttgcagaatattacaagaatgcaagagcacatgaatcaatcaaatatcccgaaactgatcgaaactactcgaattgatcacaaaatcaactcgatcgcacaaagaatttgatccgctacgtactactacaaactaatcttgctcttcttgcgattttcgcggctgcgctacgccgcgcgctcgacgccgtagaggatgaagcccgcgccgtcgaacgccaccctggccgccgccgccgcctgctgcttcgtgctcgcgcacggcgacgcggccgcgccggtagacgagccggcattgtcggcgccgaacgaggaggagcgagaagacgaggcggtggcagcggaggcgctcctcttgtcgccggacgcggcggtcgtcgccgtcgccgtcggcgggggcttgtagtacatgcgcgccgtctgggggcagtgcgagtaggccctgacggcgaccctcgcggtcatgcccagcaggtccccgtacgccgcgtacttccccatcgccatggatggagctcgacgcgatcctcctcctcctcctccggcaagaacaagaacaaagaaccagagcaagatcggctccaagaaccgcggacaagcggatgatcccctctctctctctctctctctctctctctctcgcgatcaagctagcgatcgaattggaaggattcctgtgtcgcgagctcggattctcctccttggcaatggatgtgtagggtttgggggatcggtgtatttgtagccggtggggagttcgattcggagtccgattcggacaaggatgatcttgctcttaccagccgcggcgcgtggacgccacgggaattttcccgggtgtcatgggcaaaaatctgggaataatgtccgattcgaggcccattatccagctcggcccacgaagacacgaggcccattcgatctctcgtcttccccctacaaggcccaccaaagtccatcaaagtccacgcctcgctcggcttgggctcgctatcgcgttgagtcgagtctgagccaccgccggaggagaggaggggggccgagcggcggagcgcgcaagggtttgggagccgccgccggcgaccttggccggagcgcaaaagactgaggaggcgtggtcggggcttgcctgctgccggcggccggcgaccggcgaccaacggccaggacaggtctaaaattttactgcctcacttgaatatttcgattactgaatctgcagagaggaagcgtattattccctctttttagctggatcgagtgggttaaagcaattacgatagtaaaaaagagaggagggttaggatgcagtttttaggggatcgaatacactgtggaacagaatgctgcattttgctctatctgtttattactagtacttgttgaaggatggaattgtaggttttcccctttataaattggatagaggacttatgcggattaccatatgttgaattattgtgcaagattttttttgttaattgttcaaaaccattgaaatattgggtgcctctaatagtggaggatagatcattctgttacaggcaggtcttctgtaggcttaggtttgggggtcctctactttgttctgggcttgtggctgtgtagtaatgctagttgctaggtgcctgaccatatgcttatcaccttagaagaaaagctgcttcaattctaaattctaacaaggtaattagtggtaaatcatacttattccattcaaagggctgtgaccttttgaagtcactcggtctgagatgaaaacccagagaaatattatgaatgaatcctgacctgttctgagaacaacatcagcctttgttttgggatgtacttaagaggaaagcaaatttttggcctttagatttaattctgttctatcatctatctgatgacaaatcaacttagtatgattttcttttatttgcagctgtcctcaaatccatccctacattccaccaatgtatttaagctgttgaccacttgcacttgcacttgctctctgcctaaaatttgatgtataggctttatataagatggtatattgataataaactactgtttactaatcaactactaggctcctagcatgctttgatgtgtatttgccggcacccctatcaacatgcttgtgacacttttatttaatgttaacccgtttctcttttccaacagcttgtgcttatactgtcctgatggaaaccgacagaagccagcctgctccaattgacccaagaagagctcgctttccttgttgtatagtatggacaccattaccgttaatctcatggttgatcccctttatcggtcacattggcatctgcagagaagatggtgtaattttggattttgctgggcccaattttgtatcagttgataacttcgcgtttggagcagttgcacgatatattcaagtaaacagtgatgaggttagtacttagtattatgtggttaatatcactctcattgccgcctcctagtgacaccttatcaacatgtaatgtataattattgaatactttaatcatgtatagcactcaccaaacattaatctcttgtaatctgcagtgctataagcttcttgaacctgaaggagcatcaacatgggatgacgcgctgaggaaaggcgtgcaggagttccagcacaggggctacagcctgttcacctgcaactgccactccttcgtcgtgaacaatctgaaccgtctgttctactccggccatgacaaatggaatgtggtcagcctcgctgctgtgatgttcttacggggtcgctgggtgagcacagcgtcggtggtgaagacttttttcccatttgcactggtgatcaccatcggcactctccttggcggcgcgacattcctgatcggcttgcttgctttcgctgcggtgatgactggctggttccttgtgggcacctactgcatcaagagccttgtagagttgtagctggagtagtatattggattgtacttggttttgggtctccttgtgatcaaagggtgcatacttctaatttttatagttgcttgtaaggtttatttttgactggagagatctatgaactggaatataatttgtagcttgatgaactggtcatcgatccagacggttaattcttgactggagagacctatgaactgcagtagaatttgtggtttgatgaactgctcatcaatccagatggttgcggcatgaattgcgttttgttccatgctcaggaagtcagtacgaaatggtgtttgtcttcaattgcattaactatgtttacaagtctattacccatgctcctctacaatggagtatatttcgcaagcagcagatcaaattctatactgactcgtcttttcgcttatacttatacttatacttatacttatcagctaaaattttaattttcaactttaaaattggagttgattttaggaattttttttatcgtagtttattttctagtctttgtttttatatcattaggaacacgtatataaaagttttattcccatattattttttatttgcaaatatgccgtttcgcttacatgcttataatcagccaaacaatggcgcccgtagaatcggaaacttttcaatgcttcatttgcaggaaacacttcagttctaacctattttcgtaggggacggttcaattcctgcaatatttggaaaaaaaatatcgagccatttaaaaccataactatcaaattatgcctatcaaatcaacctatgaactccctttttggcttttgcttgaagggccgctttatattggtgttagaacatgcctgattgttttggtttgaagtcaaatcattgacagtatcgatgttcaatttgatgctttctatgttgtacttgaaatttagctctaaattgaccttaaaccaaatacaactctatcctaccaagaactcgataataccaaaacttatctagattttaacacggccaacattttagtagggtattacaacaaagctgaaaatccagatatcctccactgagtcacagttccactctcagcctgtccttatccaagaaccatctagaagctctcgcgccgaccgtaacaaatggacggccaggatgaactccaccccagccgatccaacggctgaggacgcgccaagccaccgatccagtgggctcccgtcgcggcgcgtccgatccgaccggtggccgtgttcgcgtccgaggaaaccagaaaaggaagagagtgaaagcaggcggaggaggagaaaaagggaggaggatgagaggagcgcgtaaagcatttcggctcaaaggggaaataaaaaggggaagattttttttgcatctcatcctctcgctctagccgtctctcgccgctcccccccctttccaggctccaatcccgccgccgcgtaggatggccaagacgcggcagccgcagaagcgggtgctggagtcgttcaccatcaaggggcccgacggggtcatcaagcgtgaggacccctttcttgatccttttatctatttatctaggtttttgttgttttgggggaaattttggtgcgtgtataggttagcttggcttcgattatagatcttaaatctaggtttttggtggtagaatctatactttcatccaaaggtaccaaatagtgttagcggagtggtagcggattgatatcggggtagcggcgagattgcgggcggtatcgcggacgctacattcctatagcggttttgatatcggtatagcggattgattgcgggtggtatcgcggacgctacattcctatagcggtattaatatcgctatagtggatagattgcgggtggtatcgcagacgctacattcctatagaggtattgatatcggtatagcggatagattgcgggggacatcatggatgctacattcctatatagtggtattgatattggtatagatggaagttctatctcaagtttgaacctataaaatgttagatcttctttagttttaggacaacctgcaaaaagaagtctatgtgctgattaggacggtagctctgtgtacagggccggttctatattttcgaaggtcctaggcaaactctgtgctacgggccctaaggatttttttacttgtaaccatgtattctctaaaataacatgattaataatacgtagttgaaaattgtaatttggtattttattctcgataaatagtgttgatagtataatgggcttagttttaaaaaacatagtacaatagacaactaaaagaaacccgtgcaaaaacgaagtagtataaatagctcaaataggataaaataaataacaaaaagaacaaaacaaaaccgaaacataattttaggaataaatagatgcaaatgaaaattgagaagatcagaagaagtgaaaaccttatccgagtcacgatgagacaatcgggcaaggcatgggccatgggcgtcgggcgtgagagcatccggctggctgctgccacgatgttgccggactctagatcgtgaagtcacggtcgtgctgtggcgccgtcacctgtcggccatcgcgatcaggagagaaaacgctgaggatctagaacgaagtaatgaaccgacgcgtcacggtttcgcccttgatcgatggtttgggctcgatcctcgattgcgtgcgtggcgtgcctccctccctgccaatcgacgtggcaacgacatcactgcaattgggctaaccggctaactaggtcatcctgggatgctgatggactatgatggtgatgggccctctaccggcctgggccctaggcggtcgcacaacctgcctaggcccagagcctgccttgtctgtgtatcacaaagcttagatttttgtgtttaactatacttgtttacgttattgatttgcgtgatcagacacatttcttgataaccttgttctacctatttgcttatgtaacatctgattgtatggaagaattaagttgatggaggtagtcttgattatgtataagcttccacgtagcaatggtgtactcctggttataaatccaagtttcttgttgggttaaccaagttagcattttggtttggagtgagatgaagactgaagttatttatttccctgcaaaatttaaattttaaatacaaaaaagttcttgcaagttaaaatttatggtggaattcaagcaaggtaatcaatatcgagatgctaggtaggatcgttttttattcgtagtatcatagtattgggatactaccatactatcaagatactatcagattttagaaagtacatattttatataaatatataatatgttgtataaactaaagcatataatattggttttgataaatttaattggtttttatgtaaacttgagcatatttattcacattattttaaataatattttgtaggatcgtagaatcaagatactacctaagatttcgtagcatcgtggaaatgaatagtaagatcgaaatactatgaaaattaggatactggtgggatcggtatcgtttcggcttggtaggatcgtagtatctaagatactaggatatggatcggaatactgacaaccttgctgtgaagtaccgacagttaattctgcaaaatcaactcagcattcaacttcattcgatattaagcacactcatcttggctacttgttatcttatataactattggtatttttttttgtcgaaaggcacttcttgtacttttatgtaattgctttgattcagtatgaacagtttctagtgttgtcaggaatgttttccaatattagcaaattaatgtaatttgtgaggtacaacaattattaggaaataatattggcatagtcttttagtgattatgttgtatgtctgttccagctggggatactgtgctaatgatggcacctgactcatcaaagaaaccatatgtggcaagggttgaggaaattgaggcaacaggacctcaagcctctcaagtgaagatcaaggtgcggtggtactaccgcccagaagagtccattggtggccggcggccattccatggttcgaaggaagtatttctttctgaccactatgattcgcagagtgctgacaccatagagggcaagtgttatgtccacacctttcgagattacaccaagcttcgatctgtcagcgctgaggacttcttttgccgctttgagtacaaatctgccacaggcagctttgtgcctgaccgtatagctgtgtaagaatccaaaccttcaaattcgttagacatgattccgtacttattactactagtatattctagcatcattagaaagaactattgacactcaggatatttcagcaaactgttcatctgttgtgatcttgttgactgctatatggtttatggctttctttagaaagttaacatatgattttcttctgaatttttcctagctttgatagttttcagattgtctccctctatccaatgctaatgtctgggatctttctaccaccttgttgctctgattacaccattcacaatttcttgaaatatgttgccctgtcgattcttatcctagcagtcccattggggtcacagtctgtcttgaaaccgttattttctgcagttctgctagattattcagtgctgttcattagcgcctgtttgaattgggagaatgcagttacaagatctacctattcagattgcacatatcatatatttgctctcacgtattggtaggcaatcaatcggcgtagtggttgaaggcttgggcatttctttacccttttaaatgagtgaagttttcaacctgtagtgacaaacttgacatacctctcctgtttgctagtatgacacatgctcaattcttcaattgcaaaaataatttatttgatctgttgttgattgacataacaggttttgcaaatgtgagatgccatacaatcctgataaccttatgatccaatgtgaggattgctctgactggtgagatacagctgacgcattcaactagtttctgtatttttgaatgttaccaaacctgagaaaatctttacattaactgcaatcagtaaagctaggtgtatgtcttgctagaaacctgtttcttattagtagtgaagaagctaagcttcacatgtgcaaaccatatattctacagaaaaacctataaggatttctgcaggctagaatagctccactaaagtcaatacttgtggaacattagaaaaaagaacagtattgctcctcacaagtataatggtccattgtggacagtatggcgcatgctgtaattcatttatggctgttttatgtcaagtatgtgtacggactacagaagtaatggaactcataaagtcaaagtgaaatgaacaaaaggaaaactgaggaactatatccaatatacacctgagaaacctcttgagtttacacttagcaatttcatagtatcttgttgaagttctaaaatattttcctgcaggtttcatccttcctgtgttgaaataaccatcaaagaagcgaagaaactagagcatttttactgtaaaagctgtattgctgaaaatggaaaggatctacaaaagtccaatggtgctactgtgcaatctgaagaaaaggtaaactgagtaatctgatgaaaactttggcgcgtcaccaacagtactgatgaatatctatagttctgatcatctaattctaattgaagttgaaccagagggcgccttacatatatgatgtatgtcaggaggttgcagtgaacataacccatgtcagatgtttaaaatttgcacaaaattgacaatgccactgaagtggatcaattcatatcatacaattttacaaatgcaatcttcctcatttctgccaatgtttgctcatccatatgctcctgcttgcatcaggtgcagtccaaacgacggcggaggtgatgccatggagacagaatctcaatacctccaaagtggatgtaacaattctgtggggagcaaagcctcatcactcctctagatcttctctcttctcttcctgtgcaaggctgcttgcagccagtgaccagtgtactgtgtacatatttaccagtgttttctttttgcatcgtttgcatggtcgtcgtagcgtcgtcgcatgtactagcttggagtcagtcagtcagttagctcgagcaaagggatcaaactccctcttggtcataaactcataagcgatgatgatagatgaaactgggcactacctaccgtggttgtgttgttgtccatcaataataccttgacgacttgctacctgcctctctgttcgtcgtctccatgttcgttcttttttttccctttcttttttactttgagaggttcatcagttcatgttcgttctgtttcctggttttgatatttgaaaagttgtatttgaaagaaaaaattgacccgaaaaaggtctccaatgttaggtaaatgggcgattaccagctcttcttgcccctactttgatgtgtaatattgattttgcccctgtttttttagggttttcgtttttacccctacttttttaaatgaatcaaccgtttgcccctattatgttaattcttgttaacggtgttaaaatgtggggggtaaaaggacaaatatacccttagacatttttccgtacttttggcataatcaaaatataaatctattgatgccatactatagcagtaatttaattgtccaaatttgtgaaagtgtgccaaaatttgggtcaaatttgaaagtggtacaaaaataccggaaaatatctaagggtatacttgtctttttacctcacatttaacactgctagcaagattatcggaataggggcaaacgtttgttttgtttaaaaaaataggggcaaaaacgaaaaccctaaaaaacataggcaaaatcaatattgaacattgaaataggggcaaaaacgaaattgcctcaaaattctagggatacacgaaggccaaaaattctaaatttacattagatatctgttttgaatggcgattaaggtcctgttcttttctccgatgaagatttagattttcgtggcacgctttttaaactgctaaacggtgcgtttcgtgcgaaaactttctatatgaaaattgctctaaaatatcatattaatctatttttcaagtttgtaataatgaaaactcaatcaatcatacgtgaataccacctcattttatgtaaaaaaacttaatcttaatcttcaggagaaaagattaccacctaagggatgcggttcgatcaagattcaagagcaagacatgaaatgaggaagccgatatagacttaccccaaacacaaattgcgcgctccacggcctatattcggcccaacctgctgccgggcccgccgctctcttcatgctgggccgagccgacaggccaactccacggcccattaggccgacgtcctcctcgcagccacgcgctacgcctccgcggcttatcgtctcgctccaccgggcacaccgccgcgccaccgccagtgagccagcgacgccaccgcgccgcgcgccatgccgctcctcctccacccgcgcttcccctcctcccacgccgcggcatgcgcccaccgcgccgccgccgcccaccgcgacgcgcggcccgcgcttcgcctccccgagctacacgcgacgaggcggaggcggaacaacgtcgcgtgccgcgcgaccagggccagggaggcgccgccgcagcagcagaatacggcggcggcgctgtccaaggaggcgcacaagtacttcgaccacgccgtggtcaccgtccgcgcgggcgacggcggccacggcgccgtcctcgccatgccggcctccccctcgacggacgcccccaaatccccccgccgcaggtcggacaagggcaagaggagcggcgtgaagaaggtgtcgtacaagaggaactacgacgggtcggtggcgctgccgatgggcggccacggcggcgatgtggtggtgtacgccgacgaggcggaggagacgctgctccggttccacgagaaggcccgatactgcgccaagaggggaggcaacgtgggcgccaccggaaccctgagctcgcggatgcacaatggcttcgccggggagacgctcaggatacccgtgcctgtaggtttgtagattttggtggtgttggaaatgcatagcattttgctctgtgatggtaaagtcttcttcggttaatatctgccgcatcgaatttgcaggtactgttgtgaagcgcaagaaaggcgctgttcttgctgatttggctcatcccggtgatgaagttattgttgctaggggtggacaaggcggggtgagttgctagttgttcaccatcgttatgcttattcaagaggagggctgaattcgtagttcaaattcccaaattttttgctgtgcttagcgaacatttctatcgattgatgtctttaatcttttgagttgcgtttataatttggagatggcacaagtcagaaccatgctaagatctttcaatggtgcttaataagctttcgctaccatgctaagatttttcaatgtttatttctacacaaaggtgtaaactgggcggtagccatcccatatgaacattttgagatgtactagtttcaattctagtaaactccccacaaaaaaaaaaatctagtaaactgccaaaacatctgctgaattctatatcaaatattataacttgatttttgccagtcgttaataaatatagttggtacttgacagaactgtatctgacctcgagcagttctttagaaacttcattgttctattagggcagttaactgaagcatggtaatcatgatgattcattggcgtacataacttagttgactgatcttataaattgttacttcctacaactaaagtacacctactacttttacaaatatttatgcactgaatgatactgtcatgactttacagtcgggctttatttttgcagataagcttgatcgatgtgcctgagtacagaaggaggaaagccatggttttatcacctaatatcatgcgtgatgttagtgacagggtaatttgttaccttatgatacaccgggatttgaattgatggtagctttaatgttgtttcaccgatagcctgttttagttggatcgttaaagtttttgtgaaggattagctggagcaaatagtttcatgtttctgttaatgtagtttccacatagatacttgtataatgggtctatcagagaaaatagtgcaatttgcaagctagttgacttgattgtgttcagtttcttggctccttgcacactgcagctacttgcattcttgattcttgcgatggcattaagctatgttcaagtttgtcaaaacttccacgacatatactagtgaatgaatgatagtgagaagacattaatagattctcaagcactaacgccaacaatcatgtgcagattatttaacagtactgaactgctggtatccatcgctctgtgattgtatcagcatgatggtttttgataatccaaaggatttcaaacgattacatgcatttgaattccatagctttcattttcttttttcatcatattttttattcgctctgtccttttcttgttgtgtaggtgttaattcatggtcagcctggtgaggaagtaagcttggagttaatcttaagggtggttgcagacgttggtcttgtggtatgtgtgtctctattctatatttctcatggttttggtcttgcttcacagttttgggaacaagaaagtgttcagatcattcctagtagtttatatatcgtacacaagaatcttgctcaaaataatgtaccatacataagaaaatttcaagatattggaagaatttggtttggaaaggtctacgttgtgattatcatacatgggtttagatgctttacattcctttttttaggctttatttatgctatttcattgcagtcgccattgtttgcatgatgtcttacatgcattttcagggacttccaaatgctggaaagtcaacacttctatcagcaataacacttgcaagaccagacattgctgattatccattcactacattaatgccaaatcttggtcgtcttggtggagatcctgctctaggggcgttgcagttttcctcagaggcaacattggcagacttgccaggtctcattgagggtgctcatctgggcaaggtgctcttttacttttatgcactttgcttatttcatacaaaatgtttctttgcaatagccatgttgcttcccctcattattttctttggcatcatcacttgacttaatattacattgcagggtcttggtcgcaatttcttgagacatttaaggagaactagagtaatcgtccatgttgttgatgctgctgctgatgaccctgtggatgattataagattgttagagaagtaagaagttccttcattcataatagctcttttgttttttttttttttgaacagtcgtgcacactatgccagagaagtttgatagtcctttatattagttgggtagaatcttatcagccatttgtatatgggtagttagtcagtataattgaatatttgtctatgttttgtttctcaagtcaagatgtgtgttgaatggtgaatgtctatttacaggaactcaggatgtataacccccaatatctggagagaccttacgttgtggttctgaataagattgatcttcctaaggtattgtaccttaagcctgtggttttctatttctactataatcccttgatgaaaattttgcctcttggcatgctcggttttcatactgtttacgctttgctttttatcccacttgtaggcccaagacaggctatcttcactggcttttgagatatcctcaataggctgtgaagaatgtgatggtaacaatacaagcgaagacagtttaaacggaaatacaggcgaacataatacctcatcagagactaaagttgaaggtggtgaaaaggaacttcgggactatccaagacctcaagctgttgttggtgcaagtgtactgtatgtctcttcagttgaccaaactacatgcatgttctttttactcgaaaaccgttttacatccctcacatgatcttactatcattccctttgaactcacggtcgtggttctgcaggaagcacatcggaatcgatgagatgctaaaggagattagggcagccctgagaaaatgttttgatcacaggttacctgagccatgaatggaagtcagccagcataccagaggctagtacgaagaccatagacaagttctcaagtagcagagacagatcgagctcggctcttgcaaggacaacagggttcccttggtttgcagcaatttcgacggttgatgaagcatgaaaatgaccatcagaaagtgtgatgatatgggagtttatcagtatgagaagatgctattcgttaaaaaaaattattcgttcaaaaatgtatgagaagatggtacgaaatgccagtcagcagacgcgtgtgaataggaaaggatagttctgtgtgttgttagacccttttgtgtacgatccaattggcacgtaatgaagcaagcagctttgatgcatatactccatcgccttttctctgcttgaatctgcttcatactctctgttctctcatgtctgaagtctgaacttactgctgcctacggagaattccgttatctgtttgttggcttataagccgaaaccgagcttcgcccccacgccccgcgctggtgaacaactgaacatgagattggttgagaaggtggggagaatgagggggagggaggaagaagacaggggcaatttggtcctataatattaagagaatacaatgaaggggtatgtagtggcatatcttcaatatttgtgaaattataatggcataattacaaataagtgaatagtaatattatattttaaaaccataaaatttataattgcatggattcaattaacccaatacaatacgacttcgtttccgactaacacgaacggccacgttattcatagcgatcgatcgattgatcgaggagtttgaggggggaataacggggaggagcatcgatctcgatcgccggcgaccatggcggcggcgcttgttcgctctttggcgagcaggagtaggatcggcacccggcgctctcacccagctacagcctaagccggcggccaccgtcatctcgccaaggttgcttagccatggcgggctcctccgccgggaagccctgccgccgccgctctcgccgtatcgcttcttctcttccggcggtttcgagtcacctcgcacggtatgccttcttctcgttgatatatctcccaattgatcgagataagtcgatgctttatacgtttggattattttctgttcctccaaaaaaatataatgtgtctaccaatctgcgattctgagcttcttcccccaaaatcagattccttgctaatcataaataaaactatgaacttttcttaactaatatgtgtggttgaatatgttcaagtcttcttctctacgacatacaattcattatagtgcccgtgcataagacattcacattgttatcagaagtaggctattttggtaaaacaagatatgttaaagattggccttttatagggtatttgatatttccgttatgttactatggtgcgtgcgttcgttcgttttttgttgcatgacctcgacatgaacttaaattccccacgaccacacacacacacacattaaataatgctttttttttcgaaaatacgcaaaaagattgtgcacctttgtattaagagaaataaaacttacagagagcaaaacaatggaaagaacaaaccgaaagccagaacataaggtgggaaataaaaaagaaaaacatggaaagcttaagcctattctcgtgaaaacagaaggaatgacctagcaacctagagaactaagctagcagcgcctgcgaccaaggtcgggcaaacttccagaggacagtttcctgcgccattgccgcaaccactttgggccacgttcgattgcattgattgaacacctgattgttcatctccttctaaatgtacaaagccccaagggtcacaatcgtgtcgaagccacggcgctgttccttttggactttgaagtggctagagcattattttgatggcatattatctgtccaacccagttcaaatgaagtcttgtcacagcaatctaccaggaaatagtttttttttaaaaaaaatcagccaagaaatgagaatacccagaagtgtagccttgttctttgttcaagggaaactgcttgttcataacccataattcaagtgattcttcttgtatgttcagggtccctcgccttctagtacagaacctggtacggacacagagtcttgtaccaataagcaagggccagtggctgctgaagagaataataaaaaatgttgtccaagaaagcaagcttcaatggcacttgggacggaaattgaagagaggaagaaggagcttctcaagctaatgttgcagatgaagaatattccacattgtgatgagtgttttccgaataaggaggagcagtggattcgttttcttcaaggatcgcaagctagcgagcaacaacggcagccagcgtaagtgggcagtacatttcgaacatagtaaatttgttccatgccatcacatagtagtaacgcaagcagagtgcagttcgaaaagtgctccctccattttaaaatgtatgacgccgttgacttttcgtacacgtttgatcattcatcaataaaatataattttaacttatatttttacatattcatactaaatttttgaataaaacgaatgatcaaacgttgtgggaaaaatcaacggcgtcatacattttgaaatgaggtagtatcattgattgtttatcttcctggtggcattttgcaacttcttgacagttgcggtaaccattagaaaatagtgttagtttgtattacttgctgatctaacatactaatccatcatttttataatttctgacatgtaggtttggaaaatctgtggatgtcttggtgatcgtattatatgtcttgaatatcggattcatgctcagggactaagattcttttgagg

SEQ ID NO: 956 - DNA, 517 bp, Oryza sativa
cctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaacc

SEQ ID NO: 957 - DNA, 648 bp, Oryza sativa
gttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatg

SEQ ID NO: 958 - DNA, 692 bp, Oryza sativa
catcagtgaaacttgagagattaaattagctattcacccaaaaaagtatacttaattctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggt

SEQ ID NO: 959 - DNA, 12690 bp, Oryza sativa
caaaacgagcccgcacaagtggtcacatactatggcaaaagcgctgcaaattgaatggccaaacacaacggtaggtgctactgggtttgcaaacatgggagttggaccatccggtacagttgtaggggaggatgcaacaccgagtaacagtgcattagatgagggtcagtgggtaccccggcaactcattcaggctacgactaactactctcctacaattatcaaacaaccaggaagatccctgaggtttcgtgcaggcttgcgcgtgaatagcttcgcgttaaacgagtcatcacgagggcgcgcagtggtatctcctggggctggctactttcgtgatcaagaacccgtctccatgattgctccaaggtctatgccttctgaagttcaaataaaaggttacaacttagaacagatggatcagaaacaagcaaatgtttcataacagagtagagaaggtatggtgttctcacctgaataggaaggtagagcttgaactcaggtggcagctcctcctctgagtagaggcggtcagcaaagtaaattctacgaagtctgcaattcgcgtgaacttgcactcggagtgtctcaacataatttgtgccataggctctttttgtcagatcagagagattcaactgaatgttgttccagccgtcttctagcttcaatggcattgtgcatatatatggcttcactctagtgacagactggaaaatagtaacggttacaagtcaatatgcattacatgtagaaacaaaaaagtagaaacccaactttagacctttcaaattccaagaagagcagaaacaaaagatgccataaaactacctttaataagaaggccatgtcaaacattacatatgctattgcacctgatgcggtacaaaaatataaaaatgggaactgaaacatggcaaattgcgtacaagactacaaccacatcataagactagtgaaaaacaatgcaagcatgacacatgttcatgagactcatgtgctgattgctgactgggcgaagcaagaaactgatatctatctcagtatgagcctgacaaattcaaatctagaaaatgtattatttttcttatttccgagtggttaaataaacaactcttctaatatgaattccactgttcaaatgaataaacagagtataaaacattaacttcaagtctgaactagaatgttgcaggtaaaggatcacttctagtcaacctacgtctcactaagcccttttaaataccatgagaggacaattaacaaatttgaacaaaagcatttcatactttcaagttatgaagcagaacaacatgatgaaagttttagactttcagtgcttgtagatacgcaatgcctacagagagaaaaatgaattccagattatacatacttgaaaatttgatgctctaaatcggcggcggacattcttatcgtccaaaacttggatctcaaatgtgaagtacttcttaagattcttcacgattaaagcaagaaatggaagtttaattccaagagtagcagcaggatcagccgggcaggtaatgtaagtcgattgcacatttgttccaataatttcaagtacattagactggatatcctcatcctgaggccttttgatgtgcccatctacaactgcataatagacaaggcgttaaacaagtaaacatagaatagaattcttcactgaaaggtaaataaccagatcagcatgtttgacaaacaagattatagtaaagcttttaataatcaattttggtggcatagactacagctgaagcacacttagtttatgttttccacccttacttggataaataaacagtgtatcaataactacccctactaaaattcccacagagaccatgtgaagttaagctatgcacgtgaatggttttgagaaagggtcaacagtagtcccaaatgtgataatggaaacacattttcgtttctgaacaaggttcaataaaagaggaggggggggggcaagcaactcagatttagttaaacagttaagctggctctgtagattatacaacacatattcaatgcatatgtcacaaaccaaatatagagtcaagggaattgcccatgtgcagatctggctctggcaacaatcagaagcagatatctttagatcgtgacagataagtcctgaatatcagacaatgctctgtctacagtatagcatgagtaaaagactgaagttaaggagaatccaagtataaacaataatgcaccttccttatcccatatctgcaaaggcttggtcctgaccaaatgacaacagtaaagaatgagatatccaacagttcagaaaatgtatgatataaaaaatgcgagtagatcaccgcactgcatacccaaggctgtaaagaattgatagaaacccagactgaaatgtattcttgaacattttcccagagtttccaagtccaaacaaatgagaacacctctctgcaattcaaagtttgtctgtgtcagctaggaacatccaaatgcatgaacactataaatcgcagcagtacagtggagcactttcgttctgctcatcccctagcattttctatctttcataaattaacaggcaggcaattcattgcatcaaacaatccaaattttgaataaaacaatataatcgcagcccctcttctatttagcatctctcctctaattccccatcaaacaatcagaaaagctctcaaacatacaactatcatcggctcacattaaaaacgtcacgaaaatctaaattcagaaaacatgacctaaccattgcacctaacttaaaattctaggggctgtgcatcatccctgaactgtcctcccaaccccaagccctagttgcgctcaaaaccccacggagaatcgctaacccaatcaaatcgggtgaaattttctccaaaaacgtaaaagagtgccgtatacgcggattcatctcgagtttcatcagctcgcgaaagtagaacaaaaaaaagagagtagaggatcgcaccctcgatccggaggtagctcgtcaactgcgaggaggaactggccgacccgaggtgggggaggcaagggaagtggcggaggggagccggagatcgaagcggcggcgcggggggcggggttttccggcagcggcaggtcggccttccagtcttccaattctccagatgcttcgggaggcaacagaagtaagagttttttgggttgggccggcttatatcaacccgtgggccgagtaggtcaccggtgaaccacgcaacatacgatactgggctttcagtaggacggccggccggcccatgatttttttaaaagctactgggcttaaaatggacggtccatgagagtaaaaaataaaaatatggcttcgcccggactcgaaccggagaccttcagtgtgttagactgacgtgataaccaactacaccacgaaaccattgctgattgtgaattaaacaacataaattttgtcatatgctgagttttgtcaaaaaacttcctacaaaaatatatttttttctaaattttttcgttttaaaatcagtgtttgtcaatttgtaatgaacatccttaatctgatcatgggtttattttgattctcgaatagcacaaaagtttagaactacaaccatccccaaattctttagacaaactgtacactatctcagcaatccactactactgagaaaacttccgatagccttttttttttccttttgggatggggggttacgttctagttcgggacatggacagacagaatagcacaatcagcttattgactctgaaacaaactgaacacctttcatatttgagcggggcatatacagataacagagtccacttattgacaaataataacaagatgcacactacgtactgtccatcaatcacagaaaatcaaattcacacttaaaattttccattcaagaatagttgataacaaggagcttcaaagcattcaggccatcagcagcagcagcagcaacattcctccagcacgcagcagcagcaaagaatggccaacctaataaaaagaaaacagagattaagcaattttaagctaggaaccctactcacagcagtcttctcaatataaaatgcctcatctattaattatcattctgttaaaaccctttatcaaacataaaaaagtatcaacttaaacaggtacatttggttaaaagaaaactacacaggtatatcaaaaacgaattctggaaccttacaaatggcatcttttggtgcgcggaagtgattgatacaaaatgaatactcccaccgtcgcagaatatatgacggaacatgtatgacttgtttgtcttcttgggatgggtgaggtgtaggcccagactataatagggctaagggatagtagtggtagtccatatagtttagtggcaaaagctaccttttacatgtcatatgtttctagatttgggacaatgtttgaactctaaaattcactacgttttgggacggagggagtattagctaattgtatgtttcatgtatacattattattcctataatcatacaaaaatattcaccataccgggagagcagggcagagcctttttagggccaagcttggccatggcaagttgctaaataagtgattagttttaccatgtagattaatcaatggaatcaatgtaaatactaattggccttctcttctcaagttatctaagcatgtttattagatagccctttgcaacaacctgcaagctccaccaatgcaagagaggacatggagaagagttatcctgttcagtgggaagtcacggtgattcttctgaggtgggttttggaaggcggtttttatctagttggagggttagatggatgaatatccctcttaaaaaaatagagatagagacggaagataaaaataaaccagcttcatgaaattgtcacagtccaaggtcaactattgtctgcatcatgaaggagtatgtacaacttcgaaggacatacaagaagtatttcagatcatatgtgatccaatcagctcagcattcagcaatacattttttatggtgcagaacctcagtactcaagaaagcaatttattaatcttgtgatcctgcccatgacaccatatactgaatattcttttggcctataattaacacttcatcaaagtacagtacagctgagctagcatgattttatttatattgcacagttttcatcgaaaagttatctttgaggagaaattttaattgattccgatgtttaaagtattaactatccaaagatgcacaagcaatatataattctataatggatataccatggtagagatgttgttgtttggagattttacatggtcatcaaggaggtaccagccgatatcgtaaaatcagtcattcatttaagtttttttttaatataagtctattcataatcagattgctgagctaagtctatgttttacatttgttccagatcttcattctttgaaacatttttttttttagaaatttcattctgtgaaacaaatttaccaaagacagcaacacacaatgaacttgtagttcacagagcaatagagcatccatgattaacaacgcatacgagcaccgaaagtataaagtattcacacgaaattggcaagaaatgaaaaggagtaaagctttgaattaccatcctctgaggaagccaaggcagcagtcatcgtcgtggtggccatggtggtggtggccgtggtggtgatggtcctcgtggtggtggtggtgaccatggtggtggtggggatcatgcgggggcgggtagtagtatggcggctgctgcccctcgctgaagtagccctggtaccccggaggaggctggttcggcggcgggtagtactgcgtaggtgggtactgcccgccggacggtggcggcgggtatggctgcgagtaccctgcatccacagaaacaaacagcccaagaatcgatcagagaaatcacggaagaacgaccctaaaaatcgatcagataatcgggcacgaattcggcgacacccgatgctgcgccgtcacagattcagatttcggacacgcatccaaatcaacccagaacagaatggggatcctgaacagggggaggctgagatcaagaaagcccctgccgccgccgcagtgtgattatcccggtccggcgagggatggatccgggggaggagggaaggggggaattgcctggaggagggtagccgtcctgaggaggcggcactttctggtagctcatcgtctcctcgtcgccgtcaacgtcgtcgtcgtcggcggcggtggttgcttgccttgcaggctccgatctccccgtggactccggcgagcggattcgtatctgtggtattatacgacgacgacgcatcgcgatgtcaacgagtattccgggatggttgggccggaccggcggtggtggaggcccaacaagtgggctgctccgctcggggcagcgagaaaggaataagttcaccaaagatccctcaatcacttgagtgcgagtttaaaaaccatccttgaaccacaatagtacaatacttcttccgtttcataatataagactttctaacattatccatattaatatagatattaatgaatctatatatatatatatatatatatatgtctaatatatatgaatgtggacaatacttcctccgtttcacaatgcaagactttctagcattatccatattcatatagatattaatgaatctaaatatatatatgtctaatatatatgaatgtgggcaatgctagaaagtcttacattgtgaaacggagggaccacatgtaacccatcaaaaatcttgtgttggctacgagaagaaacacaataaggtgtcgggtggctgcatcgagggcaacagcgacgtgcgacgcgaggccaagtcctacgttcacatccgtagccgttgcttcaccgagaacgccttctacttgaggaagcgacactccgccaaggaaaaccaggttaacacctccacctacgtcgggctggagtgattgcttgcgcgggagtgggaggacgcgttgctgctcggcaagtgtgtcgctggccacatcgcactgtcggattatgccgatgctcaccacgcaccgcccttctctccgttggtcgtcgctctagagatggggagagagagaggaagagaggaggaagaaagaaccggtcgctggcatgttagacccgtgtggtcccacactaattcagctcaccatgtcagccaaactagatataatattaccctaagaccttggttaatacggttttgtaagttaacggatacattatatctggcattatggttaaggaagtaatacaaactcgacgtcaagatgagggatataaagcgaacttatttccagcgagaaaggagcccatgcgtacgcgtgcgcccatgtctggcccaatatgaagaaatcaaaggagaaaatggtggatgtggtttaagagacaaaagctggaatagctcagttgggtagagcgtgtggctgttaaccacaaggtcggaggttcaagccctccttctaacgcatttattttttaatttatgcttgactttaaattattttttttaaaaaaatctgtagtgcaatgcttgaataaaatcaaatttatgcttgaatttaaatcagatattatattttttttaatttatgcttgaatttaaattatttttttttaaaaaaaatctgtagtgcaatgtttgaataaaatcaaattcatgcttgaatgtaaattagattttttttaaaaaaaattatgctttatgcttgaatttaaattagttttttaaaaaaattatgctttatgcttgaatttaaattagcttttttaaaaaatcttagtgcaatgcttgaataaaatcaaagattcttgtatctgaagtttatatccgctgcttgaatttaaactcaaagtttttttaaactgcagtgcttttaatttatgctttatgcttgaatttaaattagatttttttaaaaatctgtagtgcaatgcttgaataaaatcaaagatccttgtatctgaagtttatatccgctgcttgaatttaaactcaaagtttttttttaactgcagtgcttgtagtgcaatgcttgaataaaattcaaagattcttgtatctgtagtttatatccactgcttgaatttaaactcaaatttttttttaactgcagtgcttgtagtgcaatgcttgaataaaattcaaagattcttgtatctgaagtttatatccactgcttgaatttaaactcaaagttttttttaactgcagtgcttgaatttaaattcaaagatttatttctttatttatctgcagtgcttgaatttaaattcaaaggtttttttatctgtagtgattgcatttaaattcaaagcttttttttatctgcagtgcaatgcttgaataaaattcaaagttttttttaactgcagtgcttgaatttaaatgcaaagatttatttctttatttatctgcagtgcttgaatttaaattcaaagttttttttatctgtagtgattgcatttaaattcaaagctttttttatctacagtgcaatgcttgaataaaattcaaagattcttgtatatgtagcatgtgttttttatctgcagtgccagaatttaaattcaaagctttttttatctgtagtgcaatgcttgaaaaaaattcaaagattcttgtatctgtaagtttttacccgtgttaatttaaactagtgtagtttctctactttatttatagatggttcctctgtcttctctactctatcatgtttgtgcgatagtaaaaacccgtgttaatttaaactagtgtagtttctctactttatttatagatggttcctctatcttctctactctatcatgtttgtgcgatagtaaaaatgtgtgcctatatgcacataaagcatgaaaatgtaaaggaaaatactacgtgctacacttaagatcattcctagaagatacttcatcccatcctccatcatgaaaatagcttacttgagaagaaaaccaggctccagcaaatactccacccgatggtccaaaaatagcatgtgcaccatcttgcaagctcccgctcccaccttcctttccaacgttttttttatgaagactacgttagaggtggggatagattatgtgttggccctgattccgtgctcgtgccaactcctgccgtcagccacctacgcctgcctgctccgagatctaccgcctgctcccacccttgcccaatgcgccatgtggctcccgtcgtcggccgtctgcacctgccaacgcctagccactcgcctctcctcctcggctatatgcaatatgccgttacaacttagtctttgaaaaaataccaatccgttggaaatatagcaattaaaaaattacctatcaaaaatatatccattcaaatagagtcatttatttaaaacaatccactacaaataacactgttaaattttagtcattcaaaatttagctattacgaaaaaaatagtacaaatgtatgggtagttgaaagatgttaatataagagagtgtgatatgaaggatgtagtatggatgatcggttggagtgaaaagggatacagagtgagaatcttttttagatgaccatccaaataagtatatggaggatcagatttggatgaaccactaaggatgctctaaattatatcttcacctagagttcagataacacagattgacgtcgtaatacccatacccccataattattgccctacaaccctagggtttgtgatatcacgggtgtttgtgtaaccctctcgattttataggtaaccttaacctcttggttttcacagcaagtgccataccgccgagtaacctctttcctaaatgctgaacaaacccttgttttgagtcaattatataacacataaatctctagaattgcttggtatatgtttgcatatcatcaacagaagttcaaaaaacataaatgcaaggaaattttacggtccttgagaggaacattttcttttttgcgaaaatatggtaatataacctcggaccataagaaaatcactactactaataaatataacttgtgatatgtgacagtttcgtctcccaaataatttaacgactataattaaccatataaaccatgagaaaatttctaaatttatatgtggcattgcttcaacactgcaaaggtgactgctgttcgcactttgcaaggctgcaatgctgcctaatgcctatgttgtactagaacggataagagccgcccagactagccaaggagactgcctgtaagatctcatgcagagcaagcgaagcgatcaaccgatcaagcaatgctcaaaccatgctgctaattaagctacacctctctctccaagaggccacaggcaagtcatccttggctatctagacagactcttatcatatttcatctctctcctcttgtgtgtgtttgggctctgtttgtgtgaaaaaaacactgcaagttcatggccaatttatagcaatctgaagcaggagagacagccatgaatggaagaagctaacggagctatctatctatctatctcgacagggagagaagggtccatgcagcttcgaataatttgatccactctcctgatctccttaacagattacaaggattggattcggttcaagccctgaaggcgccttttcaatcttgcccaatttggaaagcggggaatatatgcacggtccgtgcatatcctggcaaggatcactcgttgacattttgcaacgaatataatgttcaggattggcactcgaaatgcccttcaagatctgaataagatcaggttttgttgacatgcttgtagaagtagtggggatggttgttattgagaacagattctctatgttctgacttttggtggtctaagtgcagaggatgagcattcaagaggttctttcgaaccgtttgattgaaatccaatggttgtgttcaagtgatgccgtactttagctgctgtttcttgcagtaaactgctgcttcagagctcagacaaaaaaaaaacagtagtcatttctgctgtgatgcagaattttttttaactaacaattttggtacctcgacacctcgtgatatctctcaatgactgtaaaatctctccaaccatgagagtgatccgtatccgacctccttgaattgcccgctgtcaatgttcaatccaatgttcagggaccatttcttggtatgtgaaggaaacgcaaagacatcgagatgaaagttttgagttttgagttaaaagttgtttaaatttgagatgaaagttttgacaattgggctgaaagttttaagtttgagttaaaagtttttgactaaaaaaataactagttgcacatattgtgactaatttgcgagaccaatctttagcctaattgctccatgttttgacaatatggtgctacagtaaatatttgctaaagatggattaactaggtttaatatattcatattgcggtttactgacagattctgtaattagttttttcattagtgcccaaacaccacatacgataccctatataatacctgatgtgacacgtcaaaactttacaccatggatctaaacgcccccatagttgattctcactacttcatggttagagatcttcttttgtgcttcgaattaattgtcgagggagcccccatagttgattctcactacttcatggttagagatcttcttttgtgcttcgaattaattgtcgagggagcccccatagttgattctcactacttcatggttagagatttctcttgtgcgtggaattaattgtcgagggaacataccttttacaacgcaagtgtgtatgtgccctatatttggatgcatttgatgaattattgaaattcgtgatgtactaaaaggaggaatataatattgtgatttgttgaaatctatgctacatacacaaatctcaaagcaaacaagacaataggggtataggcgtacatgcatttacattgtaagggcctatttagtttccaattttttttttccaaaaacatcacatcgaatctttagagatatgtatggagcattaaatgtagatgaaaaaaactaattgtacatttatgatgaaaatcgcgagacgaatcttttgagtctaattagtccatgattagccataagtgttacagtaacccatatgagctaatggtggattaattaggctcaaaagattcgtctcgcagtttccaggcgagttatgaaattagttttttccttcgtgtccaaaaaccccttccaacatctggtcaaacattcgatgtgacatcataaaattttcatttcaccaactgccctaaattgacttctccatgatcgaggcgtactaaggtgttctttataaatcttttgatagttttgctttggcgtaacacaagtttcagtgtctatgagatgacacaggaggactaactgactaaggcccgatttagttcccaaaattttttcccaggaacatcacattgaacatttagacacatgtatgcatggagcattaaataaagataaaaccaaaacttattgttcagtttgcatggaaacatgcatatgaatcttttgagcctcattagtccatgattagtcataagtgctacaataacctacatgtgctaatgccggattaattaggctcaaaagattcgtctcgcggtttccaggcgagttat

SEQ ID NO: 960 - DNA, 2873 bp, Oryza sativa
tttgatgcagtactaggaacaaactaaggcctggtttagtcctcaacttttttctttaaacttccaacttttccatcacatcgttccaatttcaatcaaacttttaattttagcgttaactaaacacaccctaaacgaagtttcccattgaacagaggaattaaacagtgtggtaactaacaaattaagcagagaacaacacattctgtctctctgtaagtgcatcctcctactctcctaggctctatctagcagatgcaccagtgcataagctgcagcctgcaggagtggctgtcgtcagagcatcgatcgatcactagctttgtctgttcgtcttcgtccacaggcagttcaggaagcacgcaccgctgtagtcttgatcttgcctgcctgcacacatcaaataagaaccaaagcaattcagcaaagtatattagtattatacgtagttacgtacagagagagcatctgaattttaattatgaaattaacgagaatgtcccgatcatgcaaagtgcaatgcaattcagatattctccctgaatacatttgttggttaatctcgcgcggtttgtcagaagctgatcttgtcatgctctctgaattctctgtcaggctggactgatcagttgatcacggccgctatgtttatgtgtggcactgaagtggacaagcatcaaacatcaactaatctctacaggatctgtgactaataagagatcattaagaagagatgagccaggcatgaaggatgagagccgctcaggctagccaaggagactgcctgtgagatcacatatgcagaaagcagctagaaatgcatcttcttctactgcacatgagcagagacacaggcaagtcatccttggctaccagatgcgagctctcatcgccatgcgaggcctctcttcttcttcttcttcttcttcttcttcttcttcttcttcttcttcttcttcttcttcttcttcttctacctctcgatcgatctccagctaagctatagctgctagctcgctgagaaactttcctgatttgggctggcaagatctccgtccgttgcccgatttataccctgcaaaagttgacactgaaagcgatcgcagttgcagaattaaagagaaattggattggatgagctgaccaccgaccgatctgctatccgatccgatcctgcgagcccattttggtctctttttttccattatcggaaagggcgcaggatatgttcctcgttatctttcccgccatttcctgcggcccatcatgctaccattgctaagctacccccacctttgattcgaaatgttggagttgttgtaaatcaacgcgttcattagcggatcacggatccgtttcctgtccctcagctcccataacagtagacgtgtgagatgatatagaacatccgtgcccttccctttgccctcagaaaacattgtagaaatagacaatgaacacatatgtagggtggagctctcttttcattataaatcttatctggagtacaaatcaaccttagatatctcactctgtccctgtatatatagggaggtcttaggaggaaatagatcttatctatacttcggtttagattataatacaagaaaggatattatctcattgggagataatattccataacaggagcaacgtatgtggatagttgtgttttcaaatttcaagtggcaaggaagtggtgattatgtgtcgacatttttgaaaaaagtagggtgaatagtcaaagtggtcctccaagtttcatgcgaggctcggtttagttcttgatgttctaatctgtccatattagtccttcaagtttttattttaatttaaacttatccttaaactcacataaccaacaactctattgataaatgacaattatactccctcattcacatatataagagaaaaaattgcgtgcaatgaattctttttatagataatggatagcaatttatgtaaaacaaaaataaattatgtacttgcaagtgtatacgatagccattagactaagtttcatatgcacatgttgaaataatgggaagtaaaaatgttgtttatttatcttggttttcacttttctagtttatagttgcatacaaattacaggcaaaagagacattttctaacagaattgttgactagaaatagccatatggcatattaactattaagtgagcctaaggatgattttaagccaaaacaaatacttagaggatatatgtggacaaaataaaacctgaagaaccaaattgagccttcggtgaaacttgagagattaaattagctattcacccaaaaaagtatacttaattttccttatatttcgtaaaagtaatcaaaatagaagccgagatcttggctttctaagagtgagtgaaatttgtaggtattttgaggagactggaagctacacagtcccaaacttttataaacgaaatttcttcccattattttgctttggcaaaaacaggggaatttttttcaaaaatgggatttggatgtcaccagtgacctcaattgatcattccctcatcctttagtcaagcccataatcccttgtcgctgccactgctagatcttgttcaatcattggaatctaatattttctttcttttcccaaagcatttccgtgcagacttttcgctgggccgtttgtgtttttctttttctttattttctttatactttttataatttctcttcttattatgaagacttgggccgttagtgatcttcttaactgggctcctgggccgtcaatccgtcaggcccaaaaaaaactgatatgggccaagagaacctactgggccccgccttaagcagctcggcggaagaaaaaaaagcgcgagatattttgcgccacc

SEQ ID NO: 961 - DNA, 4277 bp, Oryza sativa
cgtgcgggcgccgctctgcgcccggtgcaaggcgcgccccgcggcggcgcgtgtcgccgccgtcgctggagctggaggatacggcggcggcggggaggccaggttcctttgcgccgggtgcgccgacgacgacggtgcggaggcggcgagggtgcccgtggtggggttctccggatgccccggggccgccgagctcgccgcgtcgtgggggctcgacctcggcggcggcggcggaagagatgaattcgaggaggatccgttcttccccgaggccggttacccaatgctggcggcggatcgcgtgctgcgggacatgtacgtgccctgcgacccgccgccggaggtcgccgccggcggacgcggacggcggctcaaaggggactcgctctgccaccagctcgccgagctggcgcggcgtgagatggaatccgcgccggcgcaggcgaactcgggatcgatctccccatcagctcgccggggctctgccgctgcaatccgccatgaggctgcggcagcggcggcggcgcaaagggccacattgccgtacaagtccacgccggtgacggaggcggcgggctgcggcgatgtcggcaacggcgagcagttcaccgacgacaacgaactcgtgtggcagcgcaccgcgccctccgatccgccatgccaggtagtgacaaagagactgtgtttttttgcttccattatttcaacagtttattacaagtgatagcatggtctcattctcatactctgattgtcaaattctcaacatgcttacaatttcttctaattatttgataaccaagttcctccttgattatcatcaaatttttttctctgattgttctgtggtatggtgtcaaaaagctgtgttttctgatttttctctgtaataagttagcattagtagtagtaaacttgtaacccacaaaataaaaatgggatatgtgatcagaggatgaactgaaaacttggcatggaagcaaaataatgtgttcatgctgatccacagtttgtgctccgaccattttctcaagcccaaatgtgcctgttgcctgttgatattagctgcattagtattacctaagagagattctttttttttttggtaagatcacttctagcctggaaattttattttatatgactattatgttatagtcatgggtctaattaccagacagccagagaaagcagattcttcttgtgtcaatcactatgtgcttattttcatgggaaaaaagaggagttagacaacttgaaatcagagtttgttattggcatgacagatatgggattttaatctaggaaaatcaagggaccatgatgagcactctgcacttgaacttcatttcggcccaaaagatggaggctttatgatcaaaagttataatgacatgattgaggaagtttcctctagctcaaggaaagatcttcaatatatttatgactcgacatactcttttgccacggaagatattgtgtcggccaatatctaccagttgactccaaaacaggtaatccacatttcaatctttttgctattcacagatgaaatttctgtatattttcatgcttgtgtgatatttacgaactctaaaattatactgaaatataagtgaagtactgtgcgcatagggatgtatcactgtcccattcatgtgcagtgctcttgttcatatgtttagaggttcgtgctcttgatcttagatatataataatatatatacacctttgcggtctgattatatatagctgctcattgatgttaaggcacagtccataaatgtttcagacttttttatcaatcaaccttatcgtctaaaggattgatattgacagagtagaccatgtgctccgatctgatctaagatattatctggatgctgtcaccactatgggccatcatgcacatactcatcatatcctttgctcttggtccgtttagcaatgtaaacctcatgctcttcaatgtgacactgacagccaacttaatctgtgaaaagtttacaccgttgagaaacccatcgattgatcctgttgttgacagtggcaattgagttactcaagtcactattcttgcacctattttcagctgagcactgccacatccggcaacaggcgacacaagaacgagcaacacggattgacaaatgacgggccatcatcttcgaggatcgttgacgtcgatagaactctgaactcttctcctgaagaagttgcagcagttcttgccggggagaactgtatcactgatcaaactgtaactggagctgatcagaggaattccctgaagatcgacagcaaaacgatcgccatgaacagggacaacgcgatgcaacggtatagagaaaagagaaagactcgcaggcatggttttcactagcctttttttctgaccatgtttggacagaagctgcttaacctgccattgatcatctcctttctcactgtttcgtggtgaatttggttatttgttgatgcaggtatgacaagcacatccggtacgagtcgaggaagatgagagccgacacgaggacgcgggtgaaagggcgcttcgtcagggccactgacatcttcaacgtcggtggcggcgacggcggctgaaaatgtgcttgcgatgtctgaaatccagcgacatcctcaacaacgtcagttcagtggggattattgctgggggaatggagatgctgcatcaccaacactttttgtgaatagcctgaactgaaacttgtttcctggagtagtagaatacatacgatatcacatccatgatcttgtattgttgtatttttttttttgagggattgtttttttttaatgacaagttttttttgaatgactttttgagggattgttgtatggttattattccactcagaagtttttgcagcccctgaaaatgtggcaagttatgtaggacctgtttgtaattttgttgccactttcaaccccactaaactttagtagggtagcaaactaaacattatcttataaatacaattgtattaatatttggtagttacggaacttttctctcacaaattgtttatgtcagttagaattggcgacaaagcgaagcagcccgtagtatgggcctccctaagtgtgcaagcggctacccgtgaaaatccacttataagcaaaactaacctatgaacttacttatttttacctataagtaggttcgcgggtaatgcacttgaacccccctcgtcgttttgagttctgacaggtgggtcctaggctcctaacgcccttcagcgatgctgctgaccgttggatccaactgatcggcccaggattgagatgcgagcgtagctggactatgcttgtaggcaagtaccagcccaaataagaaattgcgacgttccgacccaactagaacgtacgtggcaatctcgttccggcccaatcgtaatgggcctcacgcacgtaatgttactgttcaggcccaacaagatatccggctcaggtcgttcggccaactcatcgaacggatagaaattgcagagagggtgacatcttcttcagagtttggttcagactcccatcgcaatcacaaagtgtttctgacgtctccagctttgttgattgtgatcagttcatgggttatacgcttttgctgtaaaacgactatgtgtgttgatcaatagtaatattgttctgtttgaaaataaaaataaaaaacaattttgggagaagaagatgccaattcatctgtcaggttaactcaacttcattacttcactcaatcggcaactgcttgattacccatctctctacgttgactctgccaccaaaatccaaaaaaagaaagagagagatcggtttatgtggcttgcgtgcatcctgcaaacagtgatgcacgtacttgctcactttcacaatttttttgggagcaattatttgatatttttttccctttgattttcaatgaatttctgtacagaaaacctacaacacggcatcctgtggagacgggatcccctcttcctacctcactcctctcctcctacctcactctcctctcccaaatcacacggcgttgcaggcctccccgtcgcctcctcttacttcactcttctcccctaaattagacggcactgcaaccctccctgtcgccgtcgcccactgctcaccagagccggcggccgccgccgcgagggaggccgcaacggcgaggagctcagcagcgagcgcggtgagcaagagggagagtgggagcggggtgcggtggagccggaacggggtgcggttgcggcggcatcctccatggc

SEQ ID NO: 962 - DNA, 11583 bp, Oryza sativa
gggcgacgacgccggcgaggtattacccgagcgcgcgataacaaggagaatatttggcggtgaggtagctgctacttcggcgatgacgccggctaggtaaggtagccactgctccgccgacgataccgagcacacagtggctaggtattgagacaaatcacgtgttctgtggggtgctcctttatgctgtcattgcttttttaattatcccgtgagtacactatttccacggtattccgtggggtagcagcccccatttctgtatatgcagacattttgcacctaatacagtctagttctagttgagatgttcaagtcagtatttctatatactcttaactgtttgattgattcatcgttctctcatttgacttcattgctagcgtgcgtccatattctatatacttagtatatagttattatcccactaaatatagtttcatatataatactatttatctcttctctcattaattcacatcatctcaattatttatagtttttgataatagatttatgctttaaattgtctcttatttcttctttcttaattatttttagatcaaaattgataagtgttaattagacataaaatatattcatctcgcactatatttgcaaccatatacaaattatgtaaaacatacgaagcatccttttggtttcaataaacatattatgtcttatctgtatataccgtgtaacttaattttttcgtagcaacgtgacgagatattcacctagttatatatatacggcatatactccctccatactaataaaggaagtcatttaggacaatatttaaattaaatcttaggaatataaattatgaataactctcaagttgttaagtttgaaaatgtaaaaattatatgtatagatttgtcttgaaaaatactttcatataagtatacatacattactttttaatgaatatttttataggaataagaagtcaaagttgtgttttgaataccgtgtcgctgttctaaatgatggccattacgagtatttacgagtatggcgggagtactagtacagcacagtgctgtcagtgcactaggccggtttacttttctctaatcttcttcctcttctccagccacacggcgacacgacacgtacgttgcaagcgagtgcgcgcgcgcgcgagtgatcaaggagaagaccagaggcgccgccgtcaccgtacgtcgagccagccgcgcaaccacccatgccgatgccggcgacggtggcggcagcgccgcggcccctcctgcccggcctgccacgccgcgggacggcgccgccgcgggggcggtggagcgcgtccgcggcgtcggcggcgtcgcggggcgtggccgctaaggcggcgaggagaggggtgagggagtacgtggaggcggcgcgggagatggtgcggcggccggacggcggcccggcgaggtggttctcgccgctggagtgcggcggcggcggagggcggctgcccggcgcgcccacgatgctctacttgcccggtatgagcctctctctgaaaaaaaaaagaaaaataatttcctttttttaatcatgtgtgtctgcatattccttttttttttgtcaaataaataagtaaaacatgtgtttgaatactgtttatcttgtgaaactctgacaaagcatgatattgaatagtaccaagtgggtgtgttgaaaatgaaaatttgtttgaacagtacccccttttttttccctgaatttttatttcaattttgacaccatttaatcatgcaagattttctagtctgaaaccagagggttgtagggtaggcctgaaagcaggaccaaccacctttggcaattggcaatatttaagctcatcaagatcagtgcagcagcactaatttagacaacatgtcggcgattcggtgactcacccagatcatgccaaacaaaattttctaattgctcgcatgaagatctgcaatgctgaaaccataaacaataaaagcagtttgacaagccactacgaaaactcccagtaggccaatattagtagaatggggaaagggactggctttcttgaccagctcagttgtttactggtggttgatggccattggaagtggctggattagatggatggacagataatcagagactcactgttaatctgactgtttgatgcagcagacatgcttgcaaagtctggattcaggcttaggatcattgggttagagatttggtttttaaagtattcaagtatagtactgaaaatttgtgttttaaaaaaggtatagtactgaaagtcttatcccagtggaaatgcaacctactgcattatgggttggattgtcagaatatatgttcatacctttcattactttggttccaaccatttgagaaacacaagaaaaattaaaaatgggtaaccgttttcggtctttggtcttgcaggaattgatggagttggcttaggactgatccggcatcatgagagattagcaaagtaatgacaattttatgtataatgtatggctgttttatcttcactaccgctggtaattaattctgctttgcaggatgtttgatatgtggtgcttacatatacctgttgaagattgtacgtcctttgaaggtacactttcttgatgtctacttctcataaatgaagtagtgtctacttcccatatgctcctaattataattcaaagaatggacagaaatgctcatgtgcttgtagtttaagaagtataagtatataaaccttaatgatcttgaacttatcgtaatttcctgtaagaatatgatgcataagaaaccatgtttttagctcattttttggactaaacttatatagtttgtaaaaactctgaaactgtagtaatgaatacaggactagttgagtatgtggagagtgcagtgaaatcagagggccagagagcaagagacagaccagtctatctagtcggagaatccgttggagcatgcattgctcttgccgtggcggcgcgaaatccagatatcgatttggtattgatcctagtcaacccaggtcttgctgccattagccatagttttctgttctttctctgtttatcttctttcagtgacaagtgattactgacttatcttctgttgtatggttttcttgcaggaacatctttccataagtctcagctgcagtctctctcagtcttcttggatttggtccctgaaccgttccatttaaccacaccgcagttgctgaatttcctgacaggttcggttaacttctctatgagaatatttatgacttgtttgatggataaatgattttattttactcaactggggaagaagtataattgcatgtttagctcacttttctgcactttgagcctttatgaaattaatgagtagactcatttgaagccaagctcacccatcgcttcgcctatagctgattataagatgtaatgcttattagtgaccaaaaaatgtttttaggcaacttcatgaagataccgtcgactattgttgggcgtggtttttcatttcaagaagctggtcaagcactatcagagatcaccactagtctattgccttctcttatggtgagactcgaatctaaccattgctccaatttctttgtcagttcatgtctgaatcatcataatactaattttatgcccttgtttatgcagtctttgcttgatgttctgccaaaggaatctattgtttggaagttgaaaatgctgagaacagcgtcatcatttgtcaattcccgtttgcatgcagttaaagcgcagactttggtgcttgctaggtatgtttagctcctgataacttttatcatgtccttgcaattagcaatgtgcacattgctcttgatgctgtctttccatggattatatgatattaagtaatactgaaacttatggtcctccttcggactggatctgaagattctattctccttttcttttccagttggaatgatgaactgctaccaagccgagaagaagctgaaaggctacgtgacgctctagagaaatgcagaatccgtaatttcaaagacaacggtcacaaaatattgctggtatgaaagctcatgtttctctgcattacatattccaggcgtcttagaaaatgtattgatgttaagatctcactggtccaaggaagagaaaaagtgttttttatttgtcaattcaattttcaagtctgttcttgtcctacacatcgagcaaattccatccgtagtccaaattgcttagataactatgtccatccttgccatgtccatgttaagcttaagcctactttgacactattttcatctttggcatgtccatgttaactccttaaaatattggataggaagctgaatttgatctggcaacggccatcaaaggagctgggtactatcgccgctcgttggagacggactttgtttcggactatctgccactgactcctgatgaatttcagaaggcaactgatcacatcaggtaccatctctcaaaacaacttaagcttggtcaattcagaatccatgcaattcccctttacagggagcaaatttcctactgttggagtaataactaacaaattgtcacatgaaactgaacattttctactggatttctgaaactttcaggatgttgcagtacatagcaaacccagtgatgctatcaacactgcctgatggaaagattgtgaggggtttgtcaggcctacccaagcaaggtcctgcagtgattgttgggtaccacatgctgttggggtttgagctcggacctctggtgaccggagtgctgagaagctctgggatccacatcagaggcttggctcatcccttcatgtttgacaagaagaaggagaagatcatgccggatccgtcctactacgatatgcatcggatcatgggcgccgtgcctgtcaccgcaggcaatttttacaagcttctcgcggagaagcacttcgtgttgctgtacccgggaggcgcgcgagaagcgcttcatagaaaggtagcaacagttttggcagatggatcatagagccagtgttatcatgaaatcagtttgaatttggcagatagatcatagagtcagtgataccatgaaatcaatctgaatttggcatatagaacctgtgagatcatgaaatcaatctactgactagaggattggctgttcttcagggagaggagtataagttgttttggccagagcagtctgaatttgtgaggatggcatcaaggtttggagcaacaataataccatttggagtagttggagaagatgatatatgtgatgtgagtgcattcttactattaactaccaattattaatagatgcaaatctcctttgctgtctacatttttttttgcgaggaacctttgctgtctacatgtttggtctaaggatagataattatgctttacactatatattctaactgtaatcactaggattgacaagatttggcaggaaattttcccttccatgggaatttagttcctataggtgctcagagtaaaaaagttggcacctttttgccttgttttctggttattctattgtctaatgacagatgtaccacctcagatgttgttagactacgacgatcttatgaagattccattctatgacatccttgacaggatgctaaatgaagatggtgtgaaactaaggtatatatgctgcccatacgcccatacacaaaagtcaaaagagtttggatttaatttaattatagtgtttgtttttatgatgtctccagaattctttggaagaaaaaatgatctgatctcagtttacctcttggtttcataggactgattctaccggagaattaaaatatcaaagaatccatccagtagtggctgccccaaagataccagggaggttttatttcatctttgggaagccaattgaaacaagaggtacatctctaaagaactacgcaagtaaatctccaattaatatacctgtcgcacgcactgtctcatgacaagttaaacacgcttactttcttttggcaatctgaagataagctactaggctagaacacatgaagtgatgaagatgtttttccgagacctgatttttgcttgttttcatagggagagaaaaggaactaagagacaaagagaacgcccaacacctctacctgaatgttaagtccgaagttgagagctgcatgaagtatctaaaggagaaaagagagaaggacccttacaggaatatactcgccaggcttctctatcagatggttcatggtcttgatgcagaagttcccacatttgatccgtgagaactaagatggtcacttgcagaattagataggagtacattcaagtcaattgtttatattgtttcatgcatttttgtttcacatagttatcagtttttttctctcagcaattctgcttgtcaatttgacggcaatattcagaccatagaggttaataaaattcagtttacaatctttgttccattttgtgagtttttgctggggaaaaaactatgaggaattttacaatccttgagaaagtaccttgagatacctaaattttacattaaaatttttggtacctcgaggtacttaatacctagaggtatcaaatttacctcttggtaccttctcaaggatggtaaaattaccaaaaaaaaactatacattcatgacagagatgacaacatcaccatgtatggtgaaaacattatttagagactatgcacaagattctgaacgaaatgaggtatttcattggaagattttagtcctatacaaatgggtgaatgtttatgaacacaagggattgatggacgggttaatgagggtatgatatatacagatttcatgtgaagtgcgcgagtaaatatcagttgcttatgtcgaagtacttgggatcagcagggaagtcgtgctcgacccgcagctgcagggaaaaaaaatgtcctttagagaaaacagagttgagggaaaataaatatataaataaataaacaaataaactaactctcctctagaaagggcacaagaaagtcttttttttcttgggaacatgcgaaagagttatgcatcatagtattaggataaggaaaacagttctgagaaactttatctatatgaaatactgaaacctacatgctatctatgttattggtcagaattactgaaacctacatgctagcaatgctattggtcagaattacttaagcctactgatgtagaaagaaacaagaacagggtagctgctgtagggctgcatacctcgccttcatctgcatctgagtgtctttgaggaaagacaactctaacatcattgtagagatagaatcgtctgtgttcctcaggccctgaactatggttgtatggttctgatgatacatcagatttgctacgctgcatagatcttgacggtttcttggcaaatgggctcagaaatcgtaggtgcaaagcataacgaagagcacctccagctggatcattgatcttggacgatctacagcagtatttcttttcacctaagggaaatgtgtctgattgacaacagcaaacattggtactactgccattttctgaagtttctagagagctagagtcatttgattctctaatgtcacactccatagagcaacatgtcatgttcttgcggccgcccttttccgagtcatcgatcaagttgcagttctgccctggtctacagcctgcatagtcaacaacaatttgtcagtatttataaactctaaaatttggatttagctatcacaggtaatggctacattacattcagaaaatagagtgccgcattctctaagttcactcccaaactggactgactcgacctttgtttcattggccttgcttccttctttcttttgattagagggagaaacagggaacagagtgaccttttgccgcatgaaagtctgtcccattttacaataacagaaataagatgacctcaggagaaaaaaaataaagaaataaaacgataaaatctgaaccgtaaacgtagacatcttatgtttgttccttctaaacagacaataccgtacgtgcatctggcattacttttgaatggcatctttcatgcacgatgagatagttcttatcctgccaagtgaagcagtactgttccaagcagggttcaagaaaccatttaggacaaataagtgttagagtatatggtagttactagttagagtcatattatgataggattgatttgtgtagactccttccatatctgtaatccttccttatctcctccccatgtactcctatatataccggccccctgaggctcaatactatcgtcccatgttacgcagtattcccctctcctatactatccaacaataagaaccattccactgcccgttctcccttttttttttttgctggtaactgcttaagaacaccagaaatccctccaaactttgcaaaccagtcaaaaaatatattgcgaatagcaaaattgtgcggctagaaaaatcacatgtacccggtggtgtggctacaaacaggatcattaattactaaatgcttagtgttgcttcagtacaaactaatagatgacttctatttttccacttctattatcacctccaggtaagaccaatggcatgaaatggtcagacctttacaaccagaaataagaagttcatggatggtgtaaagcacatctatgtgtccagcatgaattagatggctggcagcattgtccatataggcaattataaatatgccatcataggaactccaagacaatgcagaaacatttgcagttaccaccagcgtataagtctatgaggcaaaaagaaaagtaatataacaattctcaatttctcataccttggttccagcaggcatgtcactcaaatcatagttgcagaagaaggtatgtagcggtgtcttctctgggttactgacaacctgtcaaagtcaagagttatgcttctggtgaaatagacacatcatcgaagcatatgacaattcaacaaatcttttaaaagactaaataatggaagaaccatttgagaataagcaattaagtccaaagaaagctatccatgacaggagggcataaaatgagacatgatgcagagtagtaaaagtatcattacaaatatagcttccccagtacccataatggtatgagagtaaatatcccatgataaataactagacttgtggtgcataattggtacatgcatatgcatgtcgcccacatgcatatgcactaacatatatacacaccaatgcatcatgaacaatcgagcaaaatacagtgaattaatgcaaatctcaaagtcaagaatatggtaccagctgcacacgccctttaactgggatacgtaaccgactcttcgctgatcgtgaatcatgattactcaggcttcttttgagctttgggcttttgctactgctcataggcagcctccccacaagatcgatcgatgaatagtagagtaaggagctgttctcatcaatgctggtagctgaaaatggaagcttctgagttgggggagagaagttaccaccagtcacattcaggacagcaaggaaaccgtcaatattctgcactttaggagaaatatcaactggcatcactcgaaaaatatcaacttatggtacaccactaaaagctaaattaggagcgtataaattctacggacctgattgtcttttccacaggaatagcgaccagataaaagagattcctcaaaagagccaattaacgaccttcgtacaggaaggagaccaatactccgaatacatccaatgcgtggggatacagaggcagattccgggccccagttttgagattttctatctgaactcttcttagggatcctcatatcaaagtcatcatgtaagatattagttttttcaaacgcatctcttatccttgacctaccatgaccttctgaatacccttcacaggttgaaccttcagtttctctcaatgattctccatgagatcctacagtatttgttccatgcatccatgttgggccaagaggagacagattaagcagaggaggatgtgccaattttgcaagtggaacagcaacactttcaagagcttccaggtgatctgaacaaggaaatgactccctgctctcaagcaaaggaccatcagtgaatgtactaccactaaatttatcgacaccctgctctgtactccagttggagtatctcgaagctggccatgtaggtgcctcaaaagaatcaagaattgcagtatttgcctttttacgatcttgaaagccagaagtataaagtctcctagcacaatcagaatgctgaattttggcatcaccagaaccaatattcagggcatcacctcggaaatgtccagggagcgcattgttcaaaggcgacaacacccttttcctcgcatgaggcccatgctgttcaatcaatgaatggcaattatcaataactaaaggtgaatccgtattgtcagctaccatcgtatcaggacctccagtggaattagcaaaacctgattcaaagccaacaatcctcattgcaggcatctgaacatttgatcccaatttagggcctgatctggaacctacatcccctgtatcaggttttagaccttggaagcctgcaggcccataagcagcatggctggctctaaaattgccatcaaatccattcaaagaatctaaaacatcatttctcttgaaatcactgatgtatgagcatggagatgccctgttacttgagctttctgcaggaagcttacccaaatgacaggtgctattccccgcaaaatgaggacgaacaataagagatgcactcattgtaggaagcacttcctccttgattgcaggaacctgaggcaaacccatctcactagagttactccagcaaaaggaaaccaattttcctcttgcccacactttgttcctattcagattttaccatgatccatttcagcctcttattttcagcaacaaagtctctagcaattgttccagtaataatcagctaaactatgatgacacaagaaggctaaaactacaatgtggcttctgaatcgaaccccatcagcactaatgatttcaccatcccaccaccaatcatgttccaatagttactgcaacaattggagatgaagcacaatttggagcctgaacaagcaacaaggaacctgggatgaaccattccaatagatcagatcagagtcctgcaagcacaaatcggaggatgtcaccgcacactgttaaataagcttttcaataatttctctagcacaatgaacatgacagcattaactatcaaccacaaaagagcaaacaggctatcagcatatcaacatgatgcaatgcagagcaaaaaataagacatccatttcacatcaacattgagttgtggcgcaatgaagatttgataaatgaggcatcaatgcgctaaccataaagttatcccaagctcctaagaagtgctacagaactacattgtctgaaatctaccgctgttcatacaaaatcccttggcagctatcacccgacgcgccccaaatcggacaaatcaaccgcaatcccagagcgatcgcggcgtcgatgatcagaacacacgaagaaacagaatcgcatctacccc

SEQ ID NO: 963 - DNA, 27968 bp, Oryza sativa
caccatctcaaaacaaaacagaaaagcgcaaacgaatggccatcgcgaaccaaaatcacgaaatcgggcgcaaaaaaacaacaatcgtggctcccaataaccgccaaatcgcgcggtttgccatctctacaatctgaggggggcgagctcgatccgatcatctccacaaaaaaaaaatcacgcgggggtctcatctcatctcatctgcctagagaggcaaaattaccagcagcaagcggaatgggccatttcctgccgcgagaatctctctctctctcgctcgccctcctcccctggatttcgcttgcgcgtcttctcttctcctcctcctcgtgatggtggattggtggtggtgttcttctctctcctatcttcgcttctcccttctcatggttaaataggcggattccatggattttctctcccctccggcaatttttctttttttttttaactgaaggtctccttttgaagcagtatttttgtttttgttttttttttttttttgcgatcctgaccgtagataaagagagatggagggccctgatttttgatatttgtgaaggttaggtctgattgaagttatcatgaatttatagatatagggggcacctaatggtaattttttgatgtagaagttgaaccaatgagcgatagatatctcactgttggattgagttattaagaggatttagatcggatcgtgtgaaattgagatattagaccgacgatttgagacatagcaatgtagcaatactggtaatatatactacctcctgaaatatagctatcagtaatccacattggtagttctagatggtgtcaaatccactcctagatagctagtacatttttttggaaaggtatattagtatctactaaacttatttgcttgtctaattacaactagacaaccaagcatcatcatccttgaatcacaaaaaattgaagcagagttcaaattggagctagtttgcgacgcatgaattttacagttttttcaataaacatcccaaggaagtgttcatattctctttgtttttggacgaacagagaacaaccgtgtatttcaagtggatttggtatactatacatagatgctgggttttttaatttattattatataaagaaaaatatactccctccgtactcgtaaaggaagtcgttttggatagcgacacggtcttcaaaacacaactttgacttattatttctataaaaatatttattgaaaagtgatatatgtatacttttatgaaagtatttttcaagacaaatctattcatatattttttacattttcaaactcaacaacttgagagttattcatgatttatattcccaatgtttgttttcaaccttgtcctaaacgactttatttacgagtacggagggagtattccaaactgtggaagagctacattaggttaggaggtgctcatgaattcggtctaattttttttacaacttatagtttatctattttcatcgtatatgtgcatccaattgggttcaaattcaaacacacgtatcaacctaaactcagttcaaactagagtaaaatacgtgagtcccactttgctgtttcattctagctctgtcccgatttcaaatggacatgctaggcagcctaacctgatgcacaagtctcagtatgcaatgtagtaccaaacttataagagaaaatcaagcaggatggaatcccgtacagttctttagaagcatacatacataaaaaaaaaaaagaaagaagcacggctaatctccctagtctaaaaaaaatctaacatagataaaaatgtgacttcatttaaaacaacaaatctgaataaaagattatccaattcgttattttaggtggattaacgaattattttttaagacggagggattacgtcgctgctgccgctgccgcatcattcatacagtacgttgttgggtggctgctcaatgcttctggtcctccccaacccaacttttggcatgaaagaaaaagggagagcagccgtactggctgcacagggaaaaccaatggaaaaggaacgtcaaagatgtgcaggcgcagccaatgcaaggccaccgaccaggcacgtgaaaaccaaaggcttttctttttgtgtttttcgttgcgtgcctcggcagctacgtctctccggtctctccctgccgctgacgccgtcggttctttgtccagattggcaaaagaaggcaaagatatgcttcactcttttttttttactcggcatcaaagacatcatcaattgatgagattgcagtgaccagttgaacatcttcaattcagttcacattaatatcaccaaccctgttaagactgtgttctttggtttggttagagattgagagaagatttaacttattttccacgtgtacgattctcaaactactaaacagttcgtttttaaaaaaactttatatataaaagtcagtttaaaaatcatacaaatccattttcccaaatttaaaataattagtactaaattaattatgtactaatggttcgtctgattttacgtatcttcacaatcttcttctttcctcccctctcaattttctttgtttaacgttgattagttcaattttgaactacttatataaaagggtggtaatatttctcaaaaaaacttttattattggtattgtttgggtaactttttttcaaagctatttgttaacatcatgatatgcattttatccttataatcgtctatttataattgagtgttcatttgggttgaatggaatgcaatactgaatataattatgcaagtgtacaaatgaatgaattaactattataaagttaaaaatgaatttaaaccaatattataagaatttcatatataatatatttctaaatcataccgtttaagtgtttaacagatcaggaagcgtgatgccattccattctcctaaaacgaacaacccaagctgccaagcttggtcttggacagcttcatgtaattcagttttgctctgaataataatctttttgatcaattcagtcagtccactcctcctgccatttgtaacaactagaataaaaacaaatagctggaaataaccctgtctgagaagcaaacagattgaattaaaaccatcaaatacagatccaagattgtcaggtagttccagcttctgatctagcattgtccttggcgttcatgattgaggcatgtgacagctacacaattgcttgctggtccatgtactgaccgcacctgttagactttacaattaattgatcgtttcttcaaatacgacccagttgaagaaactacacctttcgtacttctgaagctattcatcggtacaacctggtacgtcccatgtcgtaatgtgatcaatctaactgacagtacagaattatggagttaacttcagcttagaaaaagtactgcacatggtaaatgttgattttgttcaggttctacgctattgattttgcaaccagaaatgttggtgcagaatacactcaaaagtataacaaactgcctgtatatttggacagaagtagattaactctcatgaaacatcttcattctcttgccacagccaattattgcccagcagttcacacagatggtaaagattgtcataaggtgataaatgatacatgcagattccatgaataacagcactagtgtttttcttttttggcaaaattgactccctcatgttaaaaattaagatggaggatgcttacatgagcagtggaaaacaggtggcattcaagtcatctcaagggcacaacaaacaaatcttacatcaattaatcggagagaaaaatggagattttattccacaactcgttatttgcacaattacatcttaaccatgggggatacaaacgaaacaccaactaatttgcaatattggccgagttcacatactaatatgtacaatattcttccatggcgagatagctgagccccttgataaataaactttcacctcaacaccaaatattctgccaagggaaggtaattgagaaaaaggattagtctgatatagagccattgtattacatgtcacaacaataaaatgaaggtgcttgacaaactaccttctacttggacctgttctagttcatcttaactctcaaaaggaactaaaatcacttgaaataatgccataatacatttgtatccacatctattaatgtatgtgtgcatatacatccatattgtgttatgcggccagtagtgatggcaaccaaataaatgcaaatgaaaaaacttctatagtccaaacagcatcactgatgttttcgccctcatgtatgatagtaagctccgaactaacacagaaaaaaaaaatcttcaaggggtaacccaaacttgatgttcttacatgaactactaaggatggactaaaaacaataaattgcttataaggaagtttctaccaaaattggcgttgtattacagaaaactagactcaccctatgttttgctaactgactcggtagctcctgacaatggccgatgatcctccaacgatgtttgtgctgaaggaagactagaaaggctcattctggcaggccctttatcctgaagatcttctgtctctttaccatctgaaatacctgatgttctcatgcccctagaaggtatcgaaaaactgcgggatataggcccaggtggtgtcggtaaaggtgatgcagtttggggagcacttggtggtgtttgcctcggcctaaaatgatcctggcctctgggtgccaaaggagcagaatttggcaccaacggtgcagagtgggcgactaaactgggaaatgttgtatgttttgatgcattagcaggtggccgaggaagctcatgaagctccttgattttaggtgaggacaacagtggtggcgaggtattgggagaaactctgacatgtattgacggctgatgtgaagagctgtgcctaggtggtacagaaacaacatcaatattctctgttgaccttgacctgggaacaataggaccagaaaaggatcctctcttcacctttttgttgtcagaagccttcgagtcatgataaccaggtaaagagagatcacccaaagggagcacaagcattgtcctggtgtctgtagtattggtattgctctctttcaaaactgaatgtgcattagataatctggtaggacttggtagcttattgtctctcaaatctcccacatttgtacttggctggagtggagatgaatagaatgcacctttgtttccaagaggagatccactagtaggatttgctgtaactgtctgagaggtgtctctaacatcatttggagtaggcaaaacataagtatatagcttcctcgtagcagaacgccgcaactcttttattctctctgctgcctcaagttttttttcaggaaaaagtggggctgactgacttccagatctctgcctttcaccaggaaaagaggaatactctgctttgcttctgtcaagaagttcctgcaaatccagaaaattaaggcctccaaagacatgaaaagaaaaacatgattgtaaagaaacaggtatattttgggacaagaaaaggaagccaactaaaaaaggaaaagaaatgcgtagccgtatacaaattcaacttaacaaattaagtacatggaagcacaatgtcttgtaattgaacatatggaatgccatttatctgcttagatctttctttcctaacagatggaataacgatataccattcttactggttatgtcatcataattattcagtttgtactttgtagtagctatggaattttgaaaatgtaacatcatttcttaaaaaggtgagaaatacaaagtcatgcattaaactcattaaagcaatgcaactttacacctgcgcggtgaactatgattgctaatagtaagagaccatgcaaaattctagagtatccttctgtaggatagttaattatgctcaaattaaaatccacattgttacctctgtagggctcctggaagcatgaccagcttctgtgccttccttattttctccataatcaaaggataaatcttcatgactgtcattgtaatcatcctcattttcttcatccacagagtaatcctcctcgtcaagtgcactgaactgatggtcaatgtgttgctgctcagcagcaagcctaacatgtggctctacagcctcaagagatttgagcccctttctgaataaatttagctggttggagtaaaatataaacaaatttacacaaaattagcttttgtacagattgccacagaaaaaaaaaaggaagtggggtatttccaaatgacagaatgtgcacctgagcagcatggtgccgagcagcttgtgtgaaaagacttctgaactgtccttgcttcaatgactttaaccggaatagaaaaagagttgcttcttcttgataatcgtcctgagcttgtttcaattgctctgacgcaccaatgtcacttttggcattcttagatcttcccttttctttctgtgcattcagcagaaattcgaacaactctctgaaagaagcatttggaaactcaaaaattgtgtcaacagggaaaaatataagccacattctgtacagtcagcataccttttttcatcacactggtgcttcatttcctgtaataaaaaaacactattgcttaattgcagttctgagtggaataaatcatagttatctattgaacagttcactacgattaggtaatcaagcatcaaatacataataaatactcaaaaaataagaacaaatgcaacaagaagaacatgacaaaacaaagctgtgaagtgttaatctgcataggagtagacaaaacaaaaaaaatatgtatactatattttaagtaaatgaatgctccctttaaacagggattgtactgaatggcaaaaggaaaaaaacacacacgcacacacacaatttcagattatcatgtatatccattggagttgcaatgagtttatgtaaaaccacatttgaatgatcagcaatacactttataataaaatgtaacccaaattaatgaagtggactacagagttgatttgagttccttcatgccacagaccagtgtttactagccaaacttttgtttttagcgagttcatgtattgtacatatgatcagcagggtaaaaagggcagggggggaaatagtaaaacgacatagaacaaggaaggaataggccccagagaaaagagcatgagcataagagggaatatgcacaaaaaattgtacataatggctaaaattattagaatgggagaacatacctctacagtttgaagttcattgagaagggactgtgatggagtggtgatggtattaagaacatgcacacgctgggaaaaatatagtgacttgattagcagtagaagattatggtaaataagtgactccaccgataaacaacttaaaacttacataactatctacaagcttccgcagttcaaactgggcctttccaagcaacagcaaaactttatctgggggatactgttcaatgtaagcattaagcagcaaagtgtataataggcaaaagttacatggaatgatcaataacattaagatggcctcattatcctatttttattcattttcctcacaatttgagatagtgactatcaactagcagatgagaatgggcacaaacaacttcccttggctcaatttgtcgttttcatgaagagcttaatttgcaagatatgtgtttatgcaagggagtgagaaccattaatcacaacagaacataattaccattaatcccgtccttgtttggtgtgactcttttaagtaaacaagtccccatttcctgcagtgcttctgagaactctgcatgcatgaaaggataaaatgatcattgatatgcaaaaaagagtcaagacacctatatttctagctgctataaccttataaacaattagcataagaactaataaagctgctagcatatgaaaaaagagcaaatgaactgaggctatacacgagaagaattggtgaacaactcataaaacacctaagtttctgcaccctctgtagtctgtactttagattaaaactatgaaatattcgtcttaaatgctttctcgattaaccaagaaacattgaggttttttatccatttgaaaatgggcagttgttagttctattgcagggcatgtgtaaaatgaaatggcaacaatacacaaaaaaatatttttacaggattgaacacatacttaactgatctcaaaagacaaaatgtactattggggaataaacataccatatgcactatttgcaatcgctgctgcaacagaaagcagattgtcataacagctcctcatatctgccatatcctgttgaaagtgaaattgcagtttaaaacaaatttagtaagaacctaacaagggaaagttttaacagaggaaacttggtggaatctggattaagctctactgttggttaaaaaaaaagcatgcttctcatatgtcaccactgtttgcacctattccaaaaaccaccctcctccagcattttgattttcaacaattagaaaaggacactaggtaatggtgagcagcgactcccttgtcatatccaattagatttgataagactaaactgtagtaaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgatggtagtgcaactaaacttctaaattgttttgatctttctttttttttgctaactccatactcaagagtagaagatcaaaggaatgtttctctcaaattacatgaaactctgctcgttaaggcaaatgtgagcagataagactgcgaaattcgagtgttcccagtgtccacccaggaaacaaacagttcaagcacaccgcgccatggaacttactccatacgtctgcctcctcaacaatctccctacagaacatggagcacagatccgaacacatcatcccatagtactccatcggcaacgaaaattcccaaaaacaatttgcacaaacaaacaaccaatcgggattcgggaaccgatttcgcggactcccaagagccagccaaccacacgcacagagaagcggagaaccgctcccgcagagagagatctccacacgccaagtctcactcactcacacgcacgctcacccacgcgcccacacggagaacgggaggtacggagcaggtgccccctcacctgcgaggcggcgaggagctcgttcgcggcggcggcggcggccggggagtggcccccgcggcggtccacccgctgctcgtggcgctgcagcgcgaagccccgcagcttccgcagcgacgacttcatctcctccctccctccctcacctacccgagcgtccggatcacgccgcgcgccgccgtgccgagctccagatcgccgccaattccggtggaggaaaccgaaccctgattccgagcgaaaccctagcttagctacaccaccactcctcactgagagagatgagagagagagagagaaggaaatggggaattcttttttttttttttgcctctttctttccgggctcgagtgcgagtggcgtactgttgcgctttctttaatcccctaatggcgcgccgtgtttatggtgacttaattaaggagtaattgtaggcaagactgccaaaccatgcttggcacagctttagattttagattcacgctgaatttgaatttgaagtttgtttgtttaattatagtgatttaaatatgtattttatttaaagtagaaataaaatgattgatacaaatgttatcaagtgattgcaaattttatattcatgaatttgtgaagcgaggaatatctagctttggaaattcttagatgtgaacaggacattaattagtgcctcgtttttttttattttagtattttcgattgctttgtctgtttatttaagctgccccggtctttgtttggtcaaagagagagcaatcggtggacaaaaggaaagcggttggttttggttatgccttgcttgcacacattcctgctcggtttggtagtacaaataataatatttctaatcctttttatatataataatagggatgatttggctttggtatttgcactttaatcttttttctaattggactgttcttttctttgctgctttattaatgtcttttctttctttagttgttgcttgttgcagtccatggtccagtcaaagggagagatttggaaaaaagggcaaaaaagatgagatagtactactaagaaaaatacattttctgcacgaccgcaagtgtgcgtggatcaaccaagtacctttttccagctgaattttattgctgttttcttatttaatactccctccgtttctaaatattcgacgccgttgactttttaaaatatgtttgaccgttcgtcttattaaaaaaataagtaattattaattattttcttatcatttgattcattgttaaatatacttatatgtatacatatagttttacatatttcacagataagacgaacagtcaaacatgtgctaaaaatcaacattgccaaatatttaaaaacggagggagtataatgtaatggaacgtgattttctgttaggtgatgagagatgttacaataattgttatagcgattgatggttacgtgcaccagatccgtgatcaattagcacggaccgtttgaccaaaaaatcatttaggtcttcctagttagctgtaccgttgtactaaaaagaaaaggttgtcactattataccagcaattcggtggggatcacatcgttagtaattgcggcgatacaagattggattggagataacggctaattaagtcgattttgggaaaagattaaaaaaaaacttgaaaactaattgatcagagagaggcatcgacatcaacagcgagaggttttagacagttcaaaatgttgactatcgtgagagtttagaccccggattttgggcgaatagcaacatgcgacatgcgcaatcgttgtcttaagttgggattattcattgccctcgttgtcttttgcaacaaatgtgtccatcaagagctcagatttttctttcatttatgtaactagcgccagtgtgtactgtgaaccaatcaccataagctgcataattctcgcatacacaccaaaaaaaaagagggaaatttgggtcaccaccaacgaacgcagtgatgcaactgcagctaaaagaataggtgggggtcatggaaatatcttgcaaaattagctcgctttgagtttgggcaattgttggacaccattatgaatcatatgttggccggacgggaaaagaaagatgatgtaaaagaggtctctcctatcaggcagttgctgccatgggcaccgctctgtagcacgcacgcttcgctgcacggacaatatcgtcaacctgcaagcacaacaataacgtcgttaatataaatgaagataaagaaatgatcagcatagttgatccatataagggataataaatgatgcaggtccatgcatttcacaattgcatagcctcgtagatccagtttaaaactgtaggtacagctaaaaacaaaaaaacatgcaagcggagtttagacttcacatttcatttacattaaaggtatatttaataatattgctagtgcagaaatcaaatgtgattctgaaccagtgtctaaagagtaccgcaagtacttccaccattctgcaaaccataaagagtcgaagaaatgctgatgaccaccctgatcacagtggtcacccggaacacacaaaccgacaataggacagaattaccaacttcttaatagtgagcacctccagggataactgggtggcagacaacatccaccagaaagtcttaactaaaagccatagtacagttaggtaatatcccatgacaagtgtgccatatgctttccagcttatgatcaaatatctattgctcaagttgttgagtggaaagggcaatcaaggaaatacttctatttatgagtgtgtatgcacgtatagcaacctctacattatacactataaaaactacaataggtcaatagccccacacttttttccttactctactgaaacattgctcctgcaaatatttttgtaatccagacacataggatggcccacacaaatcgatttgttttaacaaataaggttatgacaatgatggtaactgtttattaaaaaaaggttccatcttcataattcagagtctcctggatcggaatgaccctcaaggtcagccagtaatcaacactatatgcacactatcctgttcaacaccgccactacaactacgaaatagaactgatatttctttattccctgctaatatcagattcactatattcattcccttcagaagcaccaatcaaatggctttaggcataaataaaaacagagcaacttgaagaaaacaaatcatcactcccattaaattcagcacaacttcacgaaataggagcacatgtccaccccacaatgtaaaggttgaatggaagtaactactactcaattatgtcaacagaaataaatatatgcaaccaataaaactaggaattccacccaaacagtgctactctgtgcaagtccttggcacaaaatgcatcggtggagaaaagaatcataaacaaaacatgtgtacaagacacaacataaaattttggatagaaacagaaaaggacctgtgggacagccatcctctcaagattggcagcatagggcatgggtacatcagctccagcaattctctcaactggtgcatcaagatattcaaagctttcctcaacaacagacatgctgcaaagaaaacgagtgtcagaactaaaagtccttatccacacacaggtgtgccaatgcatgtggagagagagcgtaccatatctcagcaccaatcccatgctgtgggaagctttcctcaatggtcaccaatctatttgtttttctaacagatgcattgatagtagctctatcaagtggtctaattgaacgaaggtttatcacctattggcaaatagcagtaaaaaataaggaaacttttgcagtatgtggttgaaaagattgatgcattatagattattatactgaacataaattgtttaacaagtgatcacctcagcactgattccttctttggacaatatatctgcggcctgaaaaaaattgagcataagaacatagaaaagtaatattgcaatcataaatgtgaaagattttaagtaccgctggtactacttaaaacctcaaatagcataaactgaaagaaacatacactttctgaggaacaatatggcagatcaatttaactatcagacttatggacgtaccaaccatctgtttgataaacgatccctctatccgcacaaaatgaaaaataaattgctattcccaaaaggcatagctcacaagtgccgctacagacatacagtaatcagaatttacagagatatgatatgccacaccatagaaaactgcgcaaatgatgagccaaaacatataaagttatcgacgtaacatactcatcatccatattgtttaccaattacaaaatgacgcacctgaagagcatatccaaccatcttggagtatgcagtaattgtaacatctttaccctcacgctctatctacagagagaagacccacaggtaagtacatcaaacttcactgactgtataacagaaatatatatcagcatgtatctggtatacacttatctagaaaacaaggtgttcattaaaagggactcctgtgaaataatcaaggtaattctatgcaagtatgtttctttcccaaacatgtgtacacagctagtacaacatacctttgctttgccaattggcagagcgaaactagaatcaagcacttcagcagaaatagggaatgattctccatagctgcagaaaatagtatatcagcatcttggggaaatgacggctagtcagtatagcataacaagatcatgttccatacagcagttcattttccaagaaaacaacagggtccggatccctaatcgcagctttgagcaagccacgagcatcttctgcagaatatggaaccagaaccttaagacccggaacatgtgcataccaagccgcataacactgcaaaccaattcagtttgtaaatgaataattgcaattataatgacatatttaagtggcaaaataattctaccatgatttatcaaaaacaagtgatgcctaaaaagccagaatataaaagctagtggcaaactgatcttaaacagtcaaacttcctgctcagctcactgcagcttcacatgctgtaaagaactctcataattaatctttggtttcttttctacacctaaagaccagcattttggggagagggggatattaagtatttcagcattagcaaagaggttgccagatcatccaggacagtttctgggtagaacaacacaacaaaaggaaacaatgaacttttacaaagttcaatggggtcctaggatgataaactaattcataagccattccctgatcacaaacctgcgagtgttgagcgccaactccagcagcagctccattaggtcctctgaaaacaatagggacagatatctgacccgctgacatgtagtttgacttggcagctgaattgatgatatgatcaattgcctgaatgtgtaatataaataattaaaacgaaatcacagcatacaaaaactgaaatatgtcattggtacaaataatgcagaagtaaacactaatgaggtacacctgataaatatatgtcaattattaagcttcagaaaaaaaaaagagggtttcttatcaaagaaggtggacctccgaacactagatcctgagtgacgaacactttatcaagcatgtgtacaatatggattagagtatggtttaactaaaatgcaggaaagataatctatactagcaaattaacaaactagttgtacaacatacttacctaagtgttacattgctttacatagacaaaaactaatataaaattcaacagcaatccgttgctgcaagcaacaatataaactgattccactatcatagtagcatattgataattcgtgcattaccaacctgcattgagaaattgaatgtcatgaactctacaacaggtcgaagaccttgatacgctgcaccaacagcaatgccagtaaacccagcctggaaaagcagaactgaagcagataagtactagaacatgaacgcatgataccttagtgtgaaaaaaatgtgaatgggcagaaaagaaaggtaggtaagaaggtttttagaatcacctctgtgattggtgtatccagaaccctctcaggaccatacttgtcaagcaagccctttgaaatctgcaacagaatacacttcatgaacaacgataagagctaatacgtttacagcggacctgaggaaaggcacaactactaatattttttaacttcacacaccttgtatgcaccttgatactctcccacctgccacgaaagagaaggccttagaaaaacacacaaatcagggagagaaagtgagtgagttccaagtgtacctcttcacccatcagaaaaacagaaggatcagcagacatttcttcatcgagtgcagagttcagcgcttcacggacagtcatctgaataagtaaaatatgttgcagataacttgccaattgccatatcaaggtgcccaacaaagaaaaacaaattttaatatagaaatgtcatttttcccctttgcccactcaacaaactatgaagatcctttcagtgcaaagagcaagccagcagatacttcacttattgcattcattcactgtgctactaacttgataagtaattgaggaaaaaataaacgccaatgagaagggcaagaacaatgcaaaggaataagcatgtagatatatgatgcgatagaaattgcttcatttagcaagtgccatgggccatggccgcctagtgcgccataacaaccaaggtgagcaagcaatgtagatcaaacatgttagacatgattaccagacaacaatacatctttatcaaacaaagaaaaatcattaccggcttaccaacaaaataattaggaatataaataggaccttccagcatatacaaattaaatcaccacaaaccaccaacacaagtacagtacagtacgccccaaaggaagtaatcgaactatgcagatatagtagtcaccagttttgaagtcaactgtctacatctccacaacgatacatctaaagaaaaaccgcacaataccatccgaagagactgtatctccacgtctagtatagtgactgccaaatgaatcaatacaaactgttaaccctgtagcctgactgtctgtgggaaatttggacacgcgacccacatctataggcagtttagatatcagttcactccgacatcgagtctacatgtggctacaaatcagcagtcatcaaaacatgacaacattctattcttcaatcgggataacctaattccattgtgctatacataagaactgacatcaaaaccaatcctaagttgatctcaaccaaaaaaataggtacacattaaaacatcacattatctccatgaaccgtcagccacttccaataaccatccccaaccacctcaacaccaaactagaaacaattcgctccgttaatactaccgaaacaacaaaatacacgacatcaatgatacaaccaaccaccaaaacccaatttcccgtcaacaaacagaacaacgcaattccgcgggccagaccagatcattattcattccacaccaatgcagcgagcacgaatgaaaataattaaaaaaaaactagggttcacccaggccctcacctccttcgccgccgcggagtacgccctcgccgcatccgctgcagccgccgtcgccggccggagcctccgcagcacctgccccagcatctgcaacccccacacacgccatccattacccgtcagcgaccccccaaatcacagatcgaaacccaaccgcaccaaaccccgggaaatccgagggatggcgggcgggcgagcgagcgaggaaaaaaaaccgaggaggtcgtcggcactcacggggccggatccgagctgcctcctcgcggcgcccagcatcctccctcctggtcgcgatcggcggtggtcgtcggcgcggcgcggggccctggattcgccgccggatttgggggggaagcgagagagacggggaggaggaggagacgccgcctcgcgaatgggatagagagggagagagagagagagagaggagatcgattagttggtgggaggggagaaggaaagcgtggatacgcctctgtgcgagatttttattttccgcgctcttttgcaggaaagccccccagcttaatgcgcatttattattagtataaggaataattactgtaattacatattggcccaaaggcccagcctggtttgtgggagtaattgggccggcccgtcaaaggggagactgctgtgatgggctttcgtattgctatcaccgtaatgacggcctgtttagcataaatgtttttccaattaacgacctgaattttgcgaggggaactgtatatcccaaaaaaaaaggggaaaaatgtataactcccatctctacatcaacgaggatgaacataaccatatttatggacacaaggaattaaactctggtgagtagaatcatgcactcgtgactctaccgctacaactatacatttagaaaaccaccataaggaatatttaaaggagtaattcgtggattgacttttgtgtagggacgagtaatttttgtcttaagaacataaacaagtttttgaggttttttttaatgtaagaacataaacatgtctttgagattgtattttcacgacaaagggagcggaatcagtttaactgtacagaccaaaccttctccctcacttccttatatgcatttgcctctggataaaaaataatgcctgcaaacttctggtttctcaacttttactgcgttcttttctatactagatgtcacaattcttcagaaaaatatattcatactactataatactacttcttgttactattcacagtaatcgggagcaaataaataatgagacaacctctagtatctatatgcagatcgccacttgaaggagttcagacttcagacttcagaagagttcagagtaccgaggccactcgagagcaaaagaaagatcgccatctttgctgaactgtcacactgttggcgacgtgatcggcagagcgccccgcgattcaacgccaggatctcgcggtggattcgcaggtgtctgtcactcactctcacttgactcgctcgagccagggggacccgtccttctttcctcccttccttccttccgctgatcaaacttctcatttcgcctcttgaaagctgcaaaagttttttttctctctctccagttcagggaggccatttgtctcaagcatcatcgtttatcttacaacgaatcagtcgcggccaaaatttaaaatttaaagcttgattgtggagttgattttaaggtattttggactttgttttcttttcagcattgatctttaagtcgctagagacacatataaaagttttactcataaattattttgtatcgctactaaagccattctagcatataatccatcattggtcaaccgatcgggctcatatcgtggaggaggcatttgaccattttggtttggtttagttcccaactttttcttcaaacttccaacttttccatcacatcaaaaaaaaaatttctacatatacttccaacttttccgtcacatcgttccaatttcaattaaactttcaattttagcgtgaactaaacacaccttttggtacacagatatatgatttcatttctgtagagaagttaattttcagctgatctaaaacagtgtatacatgcgttttttcttcaaacagagagttgacaggcttttgttgggagctagaggaggcagagaaaaattttggactaaagttaatctgactgctgcagaaatgacagctgaataatggtagctggtggtagctagcaactggtgatcgatctgatgttcctgcttaattgaggttccttatcttaataaatgatcaagagaaacttacaagttacaattgatacagatgtcacagctgctgctcagtaatctttacttaggagctttcttaagctggggcttctctcttcaacctgctgcttaaacttaaactcctactaatcattatggtacaaggagaagtacaggaaaagcaatggagggacaaaagagaacaagaagaagaagaaaaaaaatcactagtactagtaattaattaaggagattttcagcatgtctaggcctctctttgagaggcagatggagcaccattgatgctgccactgctgacttcttcttctccttctccgtctgaaacctcagccgtgacacagctcgacgacgacggcgacggcgacggctgccgccgacggtgaccgtggacaccggtgaccggcgtttcgccgtcggcgtcgccggctcgccttcttgatgacctgttgttcttcagaaaaatccggcacaccacccattctcctggctgagccatgcaactctgcaaagaaaaacataatgataccattcatcagattccagatgatcaaattgagctctcaagtctgaactgaactgaattcgtgtttaaatttacagcgacgggtgcatgctagtagatgagatgtgagtgacaaagaggttcaattaaattttttgatggaacacaatgcaagacaagtggccgcacacagtgaagtgtcctaatccacgtagccaagcaggttaagttactttgaaaggaggcaaagattctctcatgtctgcatgattgagatgctgccgtgcgctgtggaaagccttttgcaaaagctgcaaacttctcttcagttaatttacccaaaaatttcacatacatatgctaagtttgttctaataaaagtttgaactaaaactggggttaattaatttgaacctttgaagcaaaacctaatgatgattcagaatgacattagacttaatcacatgtatcagtactattagtgttattactgaagaattggagaattcagactcacatggttcccgcgctttgtctgtccggcggcggcgacggcgacagcgccggcggcggcgaggcggtactcgtgcatgacccagtgggtgcgcgacggcggcttcgcgcggaggaagagcagcgtcgtcttgacgccgacgaggtgctggccgccgccgccgccgccgccgccgcacccgaagccacgcaggaacaccggcttctccgcccccgtcgccttccagtacccactccccgccctcctcctccgccacccgccgccgccgctcgccgccgcgagctgccggaagctgaagaagtaggcctcaccatcgccggcgcctgcacagaaggagagagttcacgatcagtctcccgctcggtcgagcttggcaatggcgccgcacctcctcgaaaccaaaacggatcaagaaaaccgcaccggggaggtcccaggggtcgagcacggtggcgtcgtggacgtccgggatgacggcggcggggagcggccggcacagcgccctccgccggaggtactgcaccaccagctcctcgtccgtcgggtggaacctgaaccccggcggcagctgctgccccggcgtcgccattgctaaagctcttctgctcagttagctagctaaccacgcagtgaatgcacagtagcagccaagctgagtgatcaacgatcagtgagacactgtcacagcttcagctcaagcttcacagatcacaggtaacttatgagttcttggaatgttcagagttttcagagatccagagattcagagagagagagagagagagagagagtttgatgatgagtggagtggagaagaaaagggcggggaatttataggatccatgtggcgtggagcagactccaatcctgccaccattgttgcttaaatagtatgattccttctccgatttgacatgatccaatcttgtttcaccctaaacatgtctcctaaattctgattgatacaaaaactttttcttctcctccctcttttttcagaaagtggagaaaaaaaatccaagtagcgcttgacagagatttaattaattgtttattttggttttaagatagactagagggtttatggtcaattgttaatcatgccatgtaagcaattcacttgactcgatggcttggatttatatgcccattggccattgcacaaaaaaaattgagtactattgtttctatgattgctatatgattccatgtttttagggacatttttgtctggttattcattttaaaaacattttttctgataaaaatcatgaagcaaacttcaggattggcactttgctcgtttttgcacatcggattcgaccctgatgtgccctatgcaaactgcagcttgcaagtgactgacaggaggaacacacgcacacaggtgcagatgttcttgtcagtgattgccttgtgagctaatcaactggcttaattggcagagctgattatcgccatgtgttgtgcgtgcttccgtggtacttcgtgtggattaggaggaatcattagcgccttttcttgcttctaattgtaatcatgtcactcttttggccgttgcttaatatgccgagttgcttcctgccccctccttccaagcaaccaagcatctccaatgtctgaatcttagggcctcctgggcccacacacctggcagatatttcaagggcactgtaaaaaaaacattttatctgacttaagattcatctgcatcagcatctgacttcctagtataactactccctccgttccggtttagttgtcattggggtgtagagttattgtcccagaaagaaggtcgtttaggcgtagggcagctagcaggctagccactattatgagtacttctattaattttcttccccatgctggttgcagatatatcggaataacagacgcagtactagttttgtgttaatttttaagcattgaaatgattaatgtaggggcacgttggtcatttttccaacaccatattttgtcatctctttcctagaacgactagtaaactgggacagaggaagtaacttgtactggtttctctttgaattttctgaagaaatggatattttttttctttgtgtgattatgcacaggaagaaataactgtctcatgaagtctcatccaatgcccattggttcagacacactcttttttctcctctcaattcatcagcattagcagggcataatctacacgaaacgagtgagaatattaatcgcacctcgtatagtgtcataatttcttggccttttatatttcttcgctcttaggattgtattgttcttccgctatatttaatgaaaaagacacactctcatgctatttttctcttcaaaaaaaagtgagaatattaaccgcaaagccacatttaaatactacatccgttttaggttataagatatcttgactttggtcaaagtcaaactgttttaagtttgactaagtttatagaaaaaataataacattttcaaccaagataaatttattataagaatatatttaattattgatctaatgaaactaatttggtattataaatattattatatttgtttataaacttagtcaaatttaaagtagtttgattttgaccaaagttaaaccatcttataacctgaaacggatggagtatttaacaacagcaggttaaacagaatggtgagttggtgacgtcacagcatcgcaccatgccggggaagatgacgtccaagcatagctcacagagcaactccgtgcaagcaacagggtgaaaaactccgggctcccctgtcgccattaccgtgacaaatacagcaggcttggattggaataactccagcgggaggagaggcttgtggaatggaattgcttgccttgctccaatcaaattcggcgactttttggtgtgccaaaaggggatcatttttaccccccaagaggtaacttgctcagtgttattacctttcattgcatctagatgtctaccagtctatgtgacgatgcaatgttgccaacgctgtcaaacccgggtttcgaacctatgacgtcaacaacgataactacgtgtcttttattatcgaatttcatgcactaaccagttcaacccaattacccaaaagcttaaaccggtgagaaaaatgaggtttttgaacttaaaagctctggcttttataccatacttagttacaaccaaccagttcaacctaaaagcataagacgatgaggaagcgcgcacaatttaccttttttagataatggaagctttattaatctcagtaaaattctatcaagtgatacaattattctgagagcacctccggcttctgcactcaaagagtgcacacagccaacaagaaagaaacaaaagataaactcatcatccaaatagcagggacaaaaagaacttcaggagccctctaaccgtagcctagaacgccacccatgcgccggggtagaaaactccatggccactagctccaattgttgacaagccacaacgatagttccccgcaaattgaccttctgaaggatagcccatgagcggagccaatgtgtaatcaaaaagataacctgcaaaggagaagatatgttttttctttcaaaaaccacatcatttttgcaaagccaaatagaccaaatagtggttgttgcccctaataagaccaaagatctcaaattgcgtggttgtcttcttatccaatgcccaaacatatgagttgtactattaggtaaactaatattcgaagcaaactggattaaagaccaaactgcatgggcaaaacgacaatcaaagaacaaatgattaatagtttcatctttgtggcagaaagaacaagacttgtttcctctccaattccttttaataagattatcttttgttaagactactccacgacgtaagtaccataagaagatcttaatctttaggagggctttgatcttccagattcttttgtttatattgggaacatcggtctgcaccaacgcaagataaagagatttaaccgagaatctgccatcagtggttagattccatttaaactcatcttggtcgtgagataatataatctggacatgctagtggttatgatccagagagcaaataatgcatgacagcttgttggagtggtgcctcatctcattgatggtggattgtccatcctccaatatgctgatgatactgtactctttatggaacatgatctagagaaagcttgtaatctgaaaatgttgttgaacgttttcgaagaattatctggcttaaagattaattttcataagagcgagctttactgctttggtgaagcccaaacagctcatgatcaatatactaacctttttcaatgtgaggttggttcttttccattccgttaccttggcattcctatacatcataggagacttcgtaatttggagtggaaggaagtgattgaacggcttgaaaaacggttggcaagttggaaagacaaacttttatcacttggagggcgactaacactaatcaattcagtgcttaccagcctaccaatatatatgatgtcctttttggaaatacctaaaggagtgatcaagaagattgattatttctgatcaaggttcttttggcaaggggatggacacaaaaggaaatatagactagcaaggtgggacatcatatgtcgtcctaaagaccaaggggggttgggaattcaagatcttaaaattaagaacaaggctctccttagaaagtggttgcataaactactcactacagatggtgtgtgacaacaaatgctaaggaacaaatatttgaggtcacaacctttgtctcaagctcagtggaaagcaggagactcacacttttgggctagtctaatgaagtccaagcctgattttctcaggtttggctcctccaacatcaaagatggctctcaagttcggttttgggaagataaatggttggggaatgcctgtttaagagaacaatatccttgtctctataacgttgttaggcataaacatgcaactatttcagaaattttccaaaccagtcatctaagcttttcttggcgcagggaccttactggctctaagttagtggcgtggaatcaccttctctcgtgcacaatttacctatgttccaccattcatgaattatcgacgatgtttcggtgcatgtaactaagtagcacatgaaaccaaaccaagtgcatgagacggagactagtacgaatctttattattcaggattacacttgaggagaaatggggacagaaattaggctcaagttaaagtgcccaacaacaggtccccttcaactcctccaagcactatatctttcaataatgcaaaatgttgacagaatggccacaaacaacacatggctgggcaccaagagagcaggtgatgctggaccagaaataggaatcctgatgagaacaccccccaccaatctcatttctctccacgaccctcattcgtcgacttgctgtcgcgagtcggcatcgtcctcgagcgaatcccgaccgaattccatgaaacattgagtgtgtcctgagggttctttcagggttcagacctatctagctggatcagtgtggctcaggggagagagagagcaatgcaatttgcaactcacacaattgtctgtctcacctgatgtcattgctcccatttccttaaacaaacagcaagtgcagtttcaggtactgctagtttaggcttatcttttcagattttttaccggaacattgaaacggattatttgttctgctccgaaaaataaattttcttaaaaaaccttgtgttgctgtattgtttagaccaagtttatttatcaagtagataattcgtagtaacaatccactcaataatttgttttaaactgaggcttagagttagatagctgcagagagcaagccagaaaaagctatctatcagcagtaggtacagaccaatcatatgagtagtagcagtaagcagagacagatcaatcagctagagtgtcctacatttcctctaacacaagccatttccatttctcccggtgttaacttaggaacccggaaaccggcatatcgatgaaccgatcgatcgatcgatccatgtcgccatgatcatgatcgatcatgtcgtgtgtgtgcaggtgtgaacagtggtgtgttcatcgctcgttttctggagttatttctgaaagcttaagactaattaatacactactgctactgctactgaacgatctctaaatcatattgtggttgggtacttgggggttgctttctccttgtgtggcagattgtcaatgcctttggagtgcgggtgcctctgacttgtgcgtggtgagacccttgcccatgaactgaagcaaacactgcaattgccaaccttaattaatactgatctttgagttgattactagtactatcttggcctgaaaagatggctagggtcatagcatctagtaggcaaatattattgaagaaaaggaaatgatcttgcttgggttgatgccttctgtccccagataagcagctaggaccccggaaactgcatgcccaatgatttcatccgctttggccgcctcaagctcggcttggttaattaggagttaggacctagtcacttttagtgatcaggacatgtaaacttctcaaagctagaggtaattatttttcaattagtagtaggttattttctgaacatgtattgagtataaattactcaactttgacagtatgtttggcaggttaggcagggtttcttttgccttgataagttgatttgtgtgcaagtggccttaaattagctttctttctcatcttagttttggccaaagcctgaacattctcactccttttactggtcagaaagctgctgacctattcagtgattctcctttcaatccagcaggtctcccactggtctaaagtttcagaagttttcagagattagcactgaaacatcctgcctgtgattcctgtcctaaatgcagagatgttagctttaattgttgcattgtttgatcagggtaacaaaacattgttgcattgcttgataacattgatgtgatgtgtctcacttttggagggacttgtttccaggagaagattaaggtctttgcttggtcacatgcatggcacatgtccatgcaatgcatgcgtgcaagctcttgatgatgatgattatgatgatggtaaaccagggttagctttcattctaagttgcttgctccttcagctgtttgtttggcagcagctgagggccatgagcatgaagtacagtactactgaactccatgtgctgaaggctgctgctgctgctggctgcacattgtattgcagcacgcaaatgcagatctggagcacagtaatcccttgggtcttaagagagagtaggaagtataaaacagaatgattagcttcactcccgaccattgctaacttggatcacaagttcctcatctgcactagccataagtagtagtagtaatatttcttctgcaagacaagacaatactctagatcatctgctaaatgcaagatattttaagaaaattcttgtgaattactatattcatacgatgcaaattcagaataagctagtactcataattttaaactgaggatcataggtgaacaccatctcattatcatgcccttgagagagacgacgaacttactcttttcttcctcacaagtcataaatccctttgatcttgcaacacagcatcagcaacatgatggctactgttacagaagcgggtgaga

SEQ ID NO: 964 - DNA, 15168 bp, Oryza sativa
aatatggattattatcagcaaaatattcatttgaaaattttgcaattttctcaagattagtaaggtgaccaacatctgtgggtactctatccctaaaattaggagcacttattttcgctaaaaggactattatttggtagagatatttccataaaaaaagattactctcttaataatactcgttatttcagacaataacatgtttttaaaaagcaactttaaccattatataattttctatatagaattatcaaaaatatataattttattatattactttttaagattaatctatgcctatatcctatggttcatatttctaaagtcttgttcagttaacaatcaaactagagggattgaagaagattgaggagcataattccacactataataggtgtggaataaatcattttgaaatatctcttaattcttttgtgagagggattaactgaacaaggtgtaataaagcaaatattttgaaaattattcatagtccaaaactaaaaacatataatacaccagtccagcactctctcgtctccacttcattccctaccacgccgtcatccatggccgccggttgtggtagaccccggcgagcggcgagattggcgaccaccgcctttccctcctcctacacacccttgtcctccaagctcactgttgtattatgaatcggattcggagatcgattgagttgcatcgagtgttggatcggaggcgggttccccggagttgctatataaacccttgttttgttccggcggggcgggaggcgatgacagcggaggaagaggggggatgaacgtacaaggcaagcgcaaggcgggtgcgtgttgcctcggtggcggcgggaagcggcggccgtcgtggaggtggaggagcgggactggacgtcgctccacgacgaggtcgctaaccacatcgcggagcggctgctcgccgccggcgtgagggagtacaaagcgttccacgccgtgtgctcccgctggagcgcatccaccgccgacccgcgggaccccacgctggccgacccccgcttccggccgcgcggctagatctcgatctgggagaacatcgggctccgccccgccgacgctgatgggatcacctacctccacgccgccaccgacaaggtccggcggggcatgctgccggaggcggtctagaggcaaagcatgttatattatctatgattctataatttattagattgtaaatttaagagatttaaatacaaacatattaaatcatcatcatacataattcacttaataaattctttttgaacatctttaataaatccttttcgaacatctctcattctctaaatagtagagtgattaattaaccgaaaagtgtgtaaagcaaatgttttggaaattatccctaatccaaaactaaaaatattatcaacccgaggaatatataatatgcggctataaaaatgggagccgattgcccggattaggcttaaaccctcagcccccctcattcccaatctagggttttcccccatggcgtcggcgtcgcgcttcctcctcctctccaggctccccgccgccgccgcctcctccacctcccgcctcctccgcccgctctccgccgcggggagcctcctcccggcggcgctcgccccctccgccccgcgcgcggcggcggcggcggcgaggtgcttcgccacgcagcccgcgacctcctcgctgcgggactcgtcgccgaactggagcaaccggccccccaaggagacgatcctcctcgacgggtgcgacttcgagcactggctggtcgtcgtggagccgccccccggcgatccctccaacccggagcccacccgcgacgagattatcgacggctacatcaaaaccctcgcacaggtggttgggaggtatatatggccgtcttgaacgatcctcccccccttctccctctcacgcgcatctcgcatccgtgggatttcgtggaaacactcgatttaatctgttagttcgtgattgggtcgtgattgggggtgaggaaatgggacggaggaagtggatttggggatatttatagttaggtgatatgtgaagtttttccatggtattatttgttaacttcatctgtggtggattggctgataaatacctgtttcagtgatagtgtattctgtactgttgatgcatattttattttattttcacaaatgtgactgggattttatttatagattccacatgtatttgtcattttcttttgattcgctacggtttccatattaatctggtctcatggtgttgcatgtagttagttattatgggggaataaattggtatttctatggggatgatttgtaaattagaagggaggtcatgccctcctgttatcaacacgatgttttttaatcatgcttcatgccctgttttgaaaattgattgtgttctattaattctgtcaaccactgacatatttaggcgtccatcttcatggtagcatgtgctagtttttctggtttctctttaattatcgcatcatgtaagtcctactgtataacaatttatttgcttagtttattcatttattttcttgatatatgccctgggtattggccattatataaattgctcataattctttttaaccaaatgtgtcctttcttccagtgaggaagaagcaaggcataagatctactcagtgtcaactcggcattactttgcttttggagctcttgtatctgaggaactctcctacaaactcaaaggtatttatggttgtatgaaattctttgtaggggatgttttatgggggtcacttgtgttcttgctttaacgctgtgctattaaattattttgccagagttgcccaaggtccgctgggttcttccagactcatacctggatgtcagaaataaggactacggaggtaaatgttcattctcttcctattgaattacatatcatcactttcttttctgaactgtttttatatcatttccgtgttagttatatagatcctctgtgataattgctctctatgtgtatgatgccatattatgatcaaactgattaattctaatgtccctgtgcaatgctttgaactgataatttctggctcttgttttatagaggttatgttttttctgcgtcaagtatatgttttaccatggaactcttctgctgattgctctggtgtcaccttgtattctagcataccactgaactttttatttggagtctgtatcctgtgaaatctcctagtactaggatatcttgaaatttagtttgctatttcttccctagaccatctgataagttggattgcttgattatcagtagtcatcgcagtgaaatcaactagttcaagcaaactttataaacttgagtcagtaatatctatttagttatctagttttgagggagtaaatggtaacttggaccttctgtttgtagttgtatatatgtcatggtagtggtagtgattgcggactgtccgtggcagttaccatcttctgtggttgagaatttgaatacatatgttatttttagtgtgctgtttgttgcttagttcataattatatctagcagagttttatgagttcatagttatttttatctgttttgtaatgtctttatccatgtgatggaatcatagagatgtgatctatgagcatttggtgtgtatttgacaccttgtcttttattgcaggagaaccttttataaatggggaagccgttccttatgaccctaagtaccacgaggagtgggtgagaaacaatgcgcgtgccaatgaaagaagccggcgcaatgataggcctagaaactttgacaggtcaaggaattttgagaggagaagggagaacatgcagaacttccagaacagagatgtgcctcctggccagggattcaacagccctcccccaccaggtcagggcccagtcccgcctcgtgatgctcctccgatgcaccatgctcagggtaatgttcctccacctccaccaccaaatgcaggtcctccaaactaccagccccatgcaccaaatccgcaaggctatacaaactatcagcagggcggtgcgcctggctaccaaggtggaccccctggctatcaaggtagcaaccagggctaccaaggtccacccccacccccaccatctgcttaccaaggcaacaaccctggataccagggaggagggccaggttaccagggcggcaacccgcctccttaccaaggtggcaaccctggctatgcaccaggctaccatggccaaggaggcaaccctagctaccagcaaggcggcgataactacaatgccggtgtgccggcttatgagagggacggacaagggaggaattaccagtagaacactgctagaataaacgatatgtagaatctagtacgagcgtaacttcatttgtttcctgttgttatcgcatgtatactcttatgctgctttgtgaactcggtttcgtatgtgtcgagcaatcacttcaatgtgtctggaactagcggttgtttgaagcacttaaaacattataaatgtttggtcaactagtgcattttgtccaaataaatacactgctaactgtgttcttgtacggagctcggaagctgctctgttaattccatttctattgttctgccatctgtgcgcaatggttcaattgtatatgcggcaacgtcctcgtctcctgtctgatgttgcttgattacgtctgagtggaagtggaaccaaacaattgcatatgcagccacgccgttgtgcagtactgttcgttgagattggtttggctatgttcatggctggttttggctatattcatggctggaggagtgaatgatacatataccccaaaatataataggttttttttggagggattaaggttcagatacaatttaaataataggtttttttttggagggattaaggttcagatacaatttaaataaaggatagtttgattggctaaggtgaggaatattgacaatatttcaatgttaaatacaaggatagtttgattggctaaggtgaggaatattgacaatatttcaatgttaaatacacggatagtttgattggctaaggtgaggaatattcacaatatttcaatgttaaatacatctatatctagatatagggagtagttctttttatacgattgagtttatgtttagtctaatttctctcttacttatctatgctactatatttataaaacatacgaattacccaactcaactataatccgctcacgagcaatatcatcggattttatggaatacattgataaaccacaaaaaccgataagatcctgataaattttgtccaaatttttaaattcagtttgttttttttagcttgacccaataaccgtgtggtttgtgtttttgccccggttcagaaagattttgcaaatcgagttagaccataattgtgaaccctgctgcctgccctgtgctcagttgctcaccattcacctatgtcgcctcgagcttgatcgccctccctcctccatgagctcggcgcaagcaagcacaaattgtattttatcctagttattaagcactctgacgtgtagtatctaggtcccgttcttttctccaataagagtttgatgaagattaaaattttcgtgacacgctttttaaactgctaaacggtgcgtttagtgcgaaaactatatatatatatatttcgaagaccgtattgatgttcaaaccataaaataaataattatgaaaccggagggaaacgcatttggacgaactgtgggatggtataatcccaaatttctcacctacattagggcttgtggaggagacaccgaagtgacttttacgtgtcccaacccaacccaatgcccagcgaactgcggcggcgaccacatcggcggtgcaagcaggcgcacctccggccattcctctgtcctcgcctcgtgcaggtgctccgcttctggccctgttcagttgcaaaatttttcaccaaacatccgacttttccgttccattaaaacttttttttacacatataaacttctaactttcctatcatatcgttccaatttcaatcaaactttcaattttgatgtgaagaaaaaaaaaacaggtctgaaaaaccggtccggttaattcggctttttcttacagaactgatattttctgaaaaccgaggcttcacgtaacagattaaataaaccgaaagtcagaaaaacatttttaatctgtcgaaaatttccactccacatctcccgttcatcccttcactcacttccctcctccttatccacgaaatcaggaggcgcggcgagggcggcgctcacagccggcggcgggcggcgggcggccgcgtcgtccctcctccttccacgcaccgcaacctcgggcaggtgaggatcgagtcttcatggagcgatgttgtttattagtgatgatttttcatgctcgtgaatttgtacatgatctatttggtatttgtgcccttacataaatctgaactgcttatttatttacttgtgaagttgtcgttcgttcctggaatggaaatgcgaagatattaataactggttaattaactaattaaacaaactaaaaaatattaggatttgacaggaaaacgatattgaattattgatagatttgtcgtgaaaaaacacgttcatatggttatacttttaatatttcctttaaatatgtagtttgaaaaaaaataaggatgaaacatgtgcattggagacggtgtcgatggcccgctatgttgtatgacactgtagtgtgttcttgtttgcctcgctatgttatagatggacaagaggaccaagcttttttgtattatagggctgcagggcatatgcgtctagaaaaaggaaaaggatgcgatgaggcaagccattagaaataggtcaatgaatgaaagggataggatgggaattatctaaacactaaaatatgtaagaatgattgaacttgtgtaaacatgcttggacttaatagtaggggtgaaaacggtacggaaacggacggaaacaacctttatcgttttcgttttcatatttttttcggaatcggaaaccccggaaacgaaaacggaaacgaatattatcgaaaccgaaaacggagcaaaaacgaaccggcgcggatacggtaacgaaaatttatcggaatacaacaacccctcaaactgagcttcaaacttttgtcaagtccaattctcaagtctcaacagtcaacaattcatcataaaacacaattatatgaaatcgtctcaacagcaaaatatattcttctataacttcatataatttgcataacaaatatttaaaaaaaattacagcaaaacacccttgtataagatatatagtatacactattattcagtgctatagtgctaatctgctatgagctactgctaatctgctatgagctatcactccatcatcagtacatagttcatcaattgtttcggtcatcacacaacagcagcacacatcaatccatcagtacagtacttggatcaatcacaaaacagctacttgcatttgatgattccatcataaatctacagcacaaaagaaatcaaatcaatggtttaggctcgtcggctcgtagctgggctgctggctgctgccgctgggctgttggctactgccgctgggctgctggctgctgcgactgcgaggcgaggcgtcgtcggctccttggtgtggctgtggcgtcgtcgtcagtggtggtagcggcggtgaaacggcgggacggcgccgcggccgcgagacggcgctgcgaaacggcgggacagcgtcgcgagatggcggcggtacgagacggcgaatacggtgggggtgaggttgcgaggagccgaggatggcggaccagcggtggcgcgggcgccgggcggtgggcgctagcggtgggcggagcgcgatgctccgccgccggctcgcggtctcgcaaagttgcgatgccgtgtggctgtctctctcctctagggttagccactatttgggtagatgccgcgatttgggttgggcttaaaacttggggacgagttatagactattgattctatgggcctttttaacttcggaaattccgatattttttccggaatttttccgaccgattccgagttccgacagaaactgctattatcatattcgattccgtttccgagaaaatgtttccgttttcgattctgtttccgagaaattccgaccggctgattccgtttccgaaaacaggcccggaatccggaaagtttccgtaccgttttcacccctacttaatagagcctcctcctttcgcatttgtaaactttttagttgtcgtccaatcccatccaacatgtatcccaaacaaaaaatcggttcatccaatccatccaaccagacaggcaacttggatcatcccccaaaaacatggatgcctaaaacccatccaagcttgctttcaaaccaaacactacctatgtatctctcgcaacgacgtaaggagtcacaactcacaacctcataggccaagtatggctttctctaggccggtcttcatgatcaactaccagtggctgaaacaaagcaaataacgatattgggttatttcgttgatcaaaatagtccaattgaattgttagttgctaatttgattcaaattgacatcattagatgaatgcgaaaggaaaggcttttacattatgaaatgtattttagtagcttcttagtggcaatacctagtggcctctgcatggcgcgtgcggaccttgcctcggcaccatgtgtccattgcctctgcatcaacgcacacgtccgtcttcctcatgctgctccaccaaacaagtagcttataggaattcattgcgttgctttctgattgcgcatgggtttttcaggttggcgcatgtcgagtgcggcggtgaatggattggctggtgccggtggtggcatcatcgcccagatcatcacctaccccctccagactgtacaatcattctccccctaccatcttatgtagctctgctgttcctttatagtctgctcaatccttcctcatcatgatgatggcctgagcaggtgaacacccggcagcagacagagaggtcagcaaaaaagaagaaggccaatggcgcagccatcgccaatacttccaccctcttccagatgctccaggtagttcctcctggacttttagtttatttggaattgcctcctctaatgttataatggccaagtgtggaatcgagttactgcagctgttccaaacagaaggatggggagggttgtatagcggccttaaaccctctcttattggcaccgctgcttcacaggtaaattccactggtttagtaatttggtgctactcacatcatttttttctgtaacaattgtatttccctgtttgtcaatgtgatgatacttggatgagtctgtacggtggtattcaggatttatggttcatcctgtttgtggttgtagggaatctattactacttttaccagattctcaaaaacaaggtggaagatctagcagttgctcgcggtaagaagggtctaggggatggtactgttgggatgttctcctggcttggtattgcagctgttgctgggtaagccatctactctcgcactgaaattgctaaacatcatttatatgtcaagtcaacctggagccccaacattcacccaaaacaaatcgaatgcttgtctccatttaatgctggaatgaacaattcagtctggacaaccgggacattatcagttggtagtggtccaatagggcatctccatagtatcctgtcaaacgaattgtaatagagttctgatgaatttgactgagcttgcaaaggctaacagagcgttgaaaccttaaattgtttcggaaagggagataagaaaatgtaattcatggtaatgtatggttgccatgattgttcgtatggccttgcctccttagaactgactgaaggcggtgattaactttgaatttgaagcgtgtaatcctttccagttaagatggtttttgttctggaaaaccatagcgctgtgaaatagagtcaccagtatggcgaagattgcactttgaatgtaatattgcaacattgatcctcaggcattctgatggacacttttctctgctgcaggtcaatcaatgttcttcttaccaatccaatatgggttctcgtgactcgtatgcaggtaaattttgtttaacagtctatattttaaaatgacatataacaccaaaaaagatcgtcgatgatggggttaatgagttactatactgtatgtcctgtcaaaattcaaaaaaagagaagaaatcttctaatatgttagaatattaacattggtattgcacccattgaatttaattactgttgcttttgcccccactttctggtagcatacttaccttctttgtacctgcctgactccaagcattagctttgtttttatgatgacaatgatccatgaaacttcaggaggcgccgaatcacaaggattattggtccatgacatcctttgtgaaattagttggaagaccatggtcggttgtaaccaagcttgtattaactatgcaactactattaaattggaacattctaatattattcaaaatatctgtaagtttttttatcatcagtttggaaattaactttattccatttttcagacacatacacaagcagaaaagaagatcatggagtctaaaaaggagcttttgctgaaggatgttgctagggccaattcaatagaggtctcaattcttaaggacaggttgtataaacttgattctgaaaagcctcgtccatatgggacaattcaagcggtgagtaattgagcacactcacattccttaagttgctatacattattttgtatatataatccatttcttaacaattatgcagcacataaaataagatagtacgtgaatcccccacacccaaccctgctcctctctattttttgttgagagttgtgaccacatctagatatttagatagatttctcacttgtactatttagatagtacaagaattcttgatttttttatcgaattgctttcttccttctagaactaattgctgcacttacagattttaaaattctgtttgcaaaaaactacaatgaatagtagctgcaattgcatttcaagttttgggctctacaaacttgcttttaactaatcaaatgtatttgtcactggtcagacatgatttttcttacttttatcagtagtatgtaggtccgggaggtctaccgtgaatcaggcataagaggattctggaaaggacttattccaacactaattatggttagtttatgtttctcaaaacatttgagctgaaattagtggttatgtaagagtgactatagagaatgaaccatttaaattgttaggtatgtaatccatcaattcaatttatgatctatgaaacattggcaaagcgtctccggtcaaagagatctggaaaggaactcccaaaaaagaaccttactgctatggaggtatggatttgttttttcgatttagctctgcattagaaatttgcatgtatctgtgtctgtggatatatgagtttttaacagttagatggcatcagctatttgcatgtgctgccttcctaggaacttcatgtttcttttttatttctagaaatttgtattgtatctttcaatcctataaacctgttcaccgtttatccgctttgatgcaaataaagctacattgatcatgatcaataatatttggttcaatgtaaaaagaatcatcgttgggattgctataattaccttcaaatcattcgtctataattcttgtactccataaattattatatttaaagatgcatgctacggttatttgagcaaaccagataatttggccacataaagcgccaggacagagtaatttcatactacaattagctatgcagtcaatttatgattctatgaatgcactaaagaatattcatcattattacttccctttgtttaattatgtccatagcacagaccatatatttgtttcttaattcttcagatccagagctaaataacatcttaagctgctttgaaatttcctttgatgcatttatatgtcctatccttaccattttctctttgagcaggtattcttattaggtgcaatagcaaagctcggagctactgttgtgacatacccattgctagtggttaaggtaaacttaatattatatacatgtaaatcatcttatcttgtgcaaagtgttaaaactgatgcatttctcacttgtacatctgtttaagctcaattttttttaagaaatgaggaattactggcttgtcagatcagccagtgatgggccactcaggattgccaaaataggcctgaatagaaacccggaagtccacatcgatgctagagatttcttttccatttctctactctgtttctctgatgttgttaaaacaaatgctttcagcaaaacaactacagtactaatagctgtcctgcattgttgcatacaacaaccccatgaatatgctgcaccacatttttgctctccttcagaatataatttaatcttgtgagactttactcaacaacgacaatatctagacctgccacgggtgcaagtagttgcaggcaatgccagtctatctgggttgagtgtatgaatggtttacattatcaaaatagtgtcatgtttgtttgtgctatcctgattgttgtattgaactaatgcagtctaggttgcaagcaaaacaagaaattggcaggaatgtgatgtccagatacacaggtaaatcatttcctaccattttaacttactagcagaaaacactgtttcatttccatatttgttgggatcattgtttttccgcgctgctcctatgtcttgtgtgtcagacatttagctatacctcttccgttataaaatgtagctacttttagctacggatatagatattttgggacggagggaatatttgctactcattgtgcaagtaatataatgctgactgcctgttttctccaggtacgattgacgcgatcataaagatgatccggtatgaaggattgcacgggttttacaaaggaatgggtacgaagattgtacagagcgtctttgccgcctcagttctttttatggtaaaagaagagttggtaaaattcgtagttatgttaattgctaggagtaggactgtgctcggtcctagctctaagaaacgataggcagtttatatatatcgaaacaatttgcaacgacctcttcgagactatatatcgattatttacaagataggaaacccaaaatgtctccaaatactaatgcttctcttcttgatggtgcgttgtactttccatcttcaaaaagaaacattaacagccaatagcacaaacatcaaccaaaatttcaacatgctgaagaatttccttgttttacactacaacaatttaggcagcgttcgtttggaggacattgagggagagcacctcgttttccgcacgcacgctttccaaactactaaacggtgtattttttgtaaaaattttctataggaaagttgctttaaaaaaatcatattaatccatttttaaaatttaaaataattaatactcaattaatcatgagctaatggctcacctcgttttgcgtatcttctcaatctcctcaatccccttcttctcaaacacacccttaatcctttatttgcacttcttgtctgtctcattgacacgtgaggctaaggacccacaattcagtgacagaaggagaaaagtgcaagattgccaaaaactgcagtagcgtaggtgaaatatgtgggcaggttcgattatgaaaccagtttctcagatatcacacttatcattttcttttacaagacagaatacagatgactcattgcttatgcttctcttcctgctggtgcactcccaactttgtgattaggattcctagtagtactagttaaattcgtgactttggacatcacatccatggatataaatagcgagagaggttaacccctgagggtaagccacaatcgagaaattcgagagtttggatctctttgtattatggtcttataagaaactcatgaggggtgttgtggttgcacattatgaacaaattcatctggtgaagttgcttcttagtttatctaatttattctaataaagtaaacttgatctaacggttggttttggacaaaacgagtttctacagaaacgttatcgaagcagtcttcagttttacggtcagaccacctttttaagccttttgaggttagggtgaactcaattatttgatgtttcgattatgcgggagagaagattcagagagttcagagatgatgtgccaaccagtgctcgcttcttgaccagttcatgagcagatggtgaaaagccaacaaaggctgacaagatccgccacagctttctttgggctggcaaagcttatgcaaacggcggcgtctgtcgggtcgcatgggctcgagtttgctcgcccaaggagtatggtggtttggggattcctgatctagagaggttgggaatcgccttgaggtcgcgatggctctggcagcagagaacttcaccggaaaagccgtggcaagggcttagtattctggtctcgcagaaggagcgcaatctagtatcgatttctatggtatgcttggtaggggatgggaattcggtgctgttctgggaggattgctggctgcagggttcctccattcggttgctagcgccggctgtctatgctgcaatccctgcccatctccggaatcgacgcacggtggccgaggcaatgactaacagaagatggatccaggacatcagttcggcgttgggtattcaagcgatcctggagtatttcaagctttgggattgccttcggtcagtgcggctttccgaagagccggactctctatcttggcggtgggagacctcaggagaatactcttcccgctcggcttctcgtgttctcttttttggaagaactcgtctccagcacaagctaatttggcaatctttggcaccccctcgctgtcgctacttcctttggttggtactccctccgtttcacaatgtaagtcattctagcattttccacattcatattgatgttaatgaatctagacatatatatatatatatatatatatatatatatatatatatatatatatatatatatatattcattaacat

SEQ ID NO: 965 - DNA, 6359 bp, Oryza sativa
tggtttgtcgcacccggatcgatgtgttttgtgtgatcaatgcgaagagacaattgatcatctcttggtcgcatgcccggagtcgtggcaactgtggtgggttgcgctcagagctatcgggcattcagagtgcttaccgctcaatgaacactctttcctctcatggttgtgcgactgtcgcaagaagatggtcaaggaacattgccggggtttcgacaccatcgtgacgttggttgcatggacgatctggaaggaaagaaacaatcgagtcttcaaccagaagagcagaacttgggcggaggttgcaagggttatgacgggtgaagcggagctgtggcggctagctagagctgcaatccccgttttggtagctcatgttagtggagaagggtcgcaaaatttagttggagattaggcttttatttcttggttctcctcctgtaccctgtccccttcgctttgttttttttcccgctttgtacatatatttattccttcttaatacaaagatgcgctccttgcgtattaaaaaaaaaagccaacaaaggcattgatcgtcgatgccgctgctagtaatctacttctactaatatgccaagaattgagaaactgtgcaggatcagctcccctccgatgcagactgaacatatccctgaagatcttgcgagaaattccatctgcattcaattcattggtagtacacagtttcttgagcggccaaaaggccatcttaattgattgccaatctatctgaaatggcatctactgcaggtaggagtagtgattctgaagctggttcaactgccgtaaatgttgttggagatggctgacgaacaagtgaacatcacttggtatacatactagtagtctagtactagttgcatctgcttggagtaatttcatgaaaacaatggtatggcatctagtatgataatggtaacaaaatgtcttaaatctgatggatcactgcacctggacctggacctggacaaggacaagaagcaagaatgcaagattgcatccttgttttttccctcttcttctgtcacactcacagggggtacgaggagtttgtaaatgcatgcattgaacttgtgcatagtggagtatgcagctgccatggccgtatgctatgctgctctgcaaactcaacttactcaagctcacattcatcatcatcatcatcacaaatctgcaaatctgcaaactgcaaatctccacaaggttgtcaccgattcatcatcatcaaggatcgccacctgcgccagatacgactggagaaggcagggtccaagtggccttggattggaacagttcagttcttgctctcatcttctcttctcctttcttctcccggctagtaccagtcatagtcaaagcatgtataattaaaaactgtcacatttgtgcagatgcaggagagaagatttcgaaagttcagactttggctttggccctgtttatatcccacccaaaattttttaccctgacacatcgaacattttaatacctgcatgaagtattaaatataggctaaaaaaataactaattgcatagattgcgattaatttgcgagacgaatattttaagcctaattgcttcatgatttgacaatgtggtgctacagtaaacatatgctaatgacggattaattaggcttaataaattcgtctcgcggtttactaatggattctgtaattagtttttttattagtgtccgagcaccccatacgacaccctatataatacccgatgtgacacgccaaaactttacacccctggatctaaacacccccgatatggcgtgccagtgcattgatggagtatttggagtaccgaaagtcgttggaaaattaatcggcacatcatcaaagccaagaacaacacttgtttggttctgggattagatggggtgggatgaaaccatccctgatttttaggatgggatgattctactcgcatgtttggttcataggatgagaccatcccagttctttgtttggtagaaaggatgagggaggtatgggatggacgccatttgtggctaccgtcaacccacgttcgatcccggcggcaagctggtgggagcggtgcggccagcaactcggcgagcgagcaagcggaggagggacggcgtggccgatgactcgacgagcgcacgagcgagcaggcggaaggaggagtggtggcgaccaacaggcagacgggcggacgagcgagaaggcagatgaccagtcgtggaggagaggcgagccggccgctcgcggaggagaggcggcggagacaaggtgacgacgggtcgcggaggagcgttggcctctcgcagaggagaagcggcaacatgtcgcggagggtcggcagcagtgggtcgcggagggtcgtcgaccgctcgtggaggagaggtggcggagggtcgtggaggagaggtggcagccgcttgcagagaggcgtcggcagttgcggaggtggcagacatcacggatgagcgccagcggatgtagagacaagctgacgtcgtgtactccgtctaggtaggacgagctcgtccggttgattttaccggatggcttggtcctagattttgagaggaatattcctctttagggaccaacccaacccactaactcataaaccaaatactcctcaaagtgggttcgtcccatcccatccttgcaaccaaacaccacctagatgacgagacaacacacgcagctgtatgctagttctccctcgggttacatagctgtggagattttgggtaatatatatctacacggacagcttatccgactgaaggtaggaggtggaccagatttgtatattactacatccgtcccagaatataagaagttttagagttagacatgattattaagaaagtaggtagaattaaatagggagaggtcgtgattggttaagaaatggaggtaggtggaaaaagcgaatgatggatagtggtgattggttggaacagaatgttggtggagaagttattatattttaggataagtcttgagtgttaaaagttgttttaaggcatagtccgtagtattagtcttatgcaattgaataactgaataagaaaatccatatcatgtctgactaggttttcccctttgtaaccttgcccccgaacctagggagggagtcccctgagggcataggaacaccaagattatcagaccaatacaacatccggtggatacaatccccgaaataaaaataatgtattatttctcatcgggaaggtctgaatatgtcgaaatctttgtctttgtactcatccactttagatctcatatgctaccctttttctcggtgtcgatttctagaatcgacaataactattgttgttttgaataagattaaggttaaaagatccatttttataaaattgttttttttggaatattcactttcaaactaagaccacttgtcttcttcttctaatatttacaaaaactagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctgacaaacaagtgaacatcacttggtatacataggcctgctttagttcccaagacaaaaacttttcaaccatcacatcgaatgtgtaaattgtgagacgaatcgtttaagtctaattgcaccatgatttgacaatgtggtgctaccgtaaatatttgctaatgacatattaattaggcttaataaattcgtttcgtagtgatggaaaagttaaaagtttatgtgtgtagaaaagttttgatgtgatggaaaagttggaagtttgaagaaaaaatttagaactaaacaaggccaccttcgggttacatatatacccacagaaagcttatccgactgaagtatgtaaatagattagaatttagacattgtatatatacccacggaaagcttatccgactgaagtatgtaaatagattagaatttagacattgtattaccttatattcgaaggcatagcccgtagtattagtcttatacggttgaataacttaataagaaaatccatccctttgtaactttgccctcgaacctacataaaaagtatagagcataggaacaccaatatcatcatatcaatataatattcggcggatacaatcccgaaatcgggagtaaggtattatttctcaacctgtttaaatccgtctctttactcatccattttagatgtcgtgcgctactcacttttctcattaccgatttatagaatcgacaataactattattgtgttgaataagattgaggttaaaagatccgtttttatataattttttttggaatattcactttcaaactaagaccgcttgtcttcttcttctaatatttaagccatgttattaccctaaaaataaacattttatttgctcacttcgttcttaaattgtaactagtggtccaagtttaaatgggaacaaattatagctatcaattattaaaaatggagggagtaataccttgactattaataatgtttaaaatatttagtttgaagaaaacttttataaaattaaatatttacttattttctaaaaattataaagaattgtgttttggagatcatgttgttgttgcaagaaccccttcttactgtaaagttatgacccactaactgcaattaagattctaaagttcaaacctcgatgtgctacattatcgttaattctcagccgttggatcagtagatttgatcatctctgaaccgttggatgaaaaaacacatcctaatccacctcacacagtcaccatgggaggcccatctaatttgatcgtcgcccaattcaataatgagggatttttttcatcccaatcaccaatcttaacaaaatatcccactgcaatacacggggtttcaactagtaatagttgactataagccaattatgagcttatgtgagtgagaagataaagaaaaatatgaaatgttggctcttatgcaaaaattaactttacacatgcttcaaatagatgcattgttaagttcatagtgaaagagagaaaaaattgaagctaccctaagtattatactactttttagctttaatacgggcttagagcaatactccctccatctacttttgatagttatattttatcttggcacacagacaaaggataagtaattttacttatcatctatttaaacatgctactagtcattccttgtaaataaacaattcattaatatttacatttctcgatgcccatgtaaccaattttgtgtgaaagaacggagagtcgcacattaaatctgagaaagtcattaagatgatatgttgttggattgaaatatgcctatcaaaaataaaattttcagatttagaaatatgcctatcaaaagtagatggaaggagtactgaggtagagaggagaagagaggagaaagaggagaagcgggctataaatttacagccagcttggcacaagaaacaataaactctgtgagagagataagtgagtcctacattaatggtaaagagctaactataatttaagtggcctgagagaaggctgcaaagaaccttacatgcaataagtcgactgtattattagccttcctcttatagctacttgttagctccaagcgcattaatgttgagttcaggtcagctcgtgggatgagattttttggcgacatgtgaaacaagatgagccattattagtacataattaatcaaatactaattattacaaacttaaaaaaatatttatttgattatttaaataagcttttaaatagaaagcaatgcagttagaaaaactgtttatgataattgtggagagagctaagtcgaaatgtagaaacggacgaattggctgtgttcttaactggttccaacctccgcttcctccttcctagcacacacgtttcccaaactattaaacgacggggttttttacaaaaaaaaatctatagaaaagtttctataaaaatcatattgatgatatattttttaaattttttagctaatacttaattaatcataattcatcgttccgttttatgtgtggagggtaggggttttccaatcccttcaaaagaatacagagtataacggttaatactccatccgtcccaatataagtgtacctagaatcggatgcgatatttcataataaaatgaatatgaataggtagttgtcca

SEQ ID NO: 966 - DNA, 1019 bp, Oryza sativa
actaatccactttagatctcatatgctaccctttttctcggtgtcgatttctagaatcgacaataacaattgttgttttgaataagattaaggttaaaagacccattttaataaaattgttttttttggaatattccctttcaaattaagaccacttgtcttcttcttttaatatttcaaaaacctagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctaacaaacaagtgaacatcacttagtatacataggactgctttaggtcccaagacaaaaacttttcaaccatcacatcgaatgtgtaaattgtgagacgaatcgtttaagtctaattgcaccatgatttgacaatgtggtgctaccgtaaatatttgctaatgacatattaattaggcttaataaattcgtttcgtagtttcctggtggaatctataatttgttttgttattacactatgtttaatacttcaaatgtgtgtccgtatatccgatatgataatcaaagccaaaaattttctccaactaaacaaggccatactacgagttgcatctgcttggagtaatttcatgaaattaatgatatgtcatctagtatgataatggtaacaaattgtcttaaatctgatggaacactgcacctggacctggaccaggacaagaggcaagaatgcaagatggcatcctttttttctctcttcttctgtcacactcacagggggtacgaggagtttgtaaatgcatgcattgaacttgtgcatagtggagtatgcagctgccatggccgtatgttatgctgct

SEQ ID NO: 967 - DNA, 738 bp, Oryza sativa
agtagctcatcatttgagtttgggcaattgttggacaccattatgaagcatatgttggccggacgggaaaagaaagatgatgtaaaagaggtctctcctatcaggcagttgctgccatgggcaccgctctgtagcacgcacgcttcgctgcacggacaatatcgcaacctgcaacacaacaataacgtcgttaatataaatgaagataaagaaatgatcagcatagttgatccatataagggataatatgaataagattaaggttaaaagatccatttttataaaattgttttttttggaatattcactttcaaactaagaccacttgtcttcttcttctaatatttacaaaaactagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctaacaaacaagtgaacatcacttagtatacataggactgctttaggtcccaagacaaaaacttttcaaccatcacatcgaatgtgtaaattgtgagacgaatcgtttaagtctaattgcaccatgattt

SEQ ID NO: 968 - DNA, 10702 bp, Oryza sativa
  unsure (1)..(10702): unsure at all n locations
caatcaagagagtagaatcagggattgggaagagcaacatagagaaggcagaagcatgagactaggattagagaaatagaaattaggggaggcagagttggaggaggaagagagccatggcaaagccagattatatttctgttcatcgatccccttccagcgtgtgtggctgctgcttttatagtagtcaacttcctagctgagtgggccaaggtttgcttcagcccaagagctcactcgttaggcccatatcgtgacattctttcccccttgagtttcggcttgccctcaagccaatgcaacagagtcatagagccgccgggatcccagatcattggaactcttctggtgcaactgaagaacaatatcatgtgtctaaatatgatgctcaccattctgacagaactccaatgcaaaccaagtgatatttcaactggaaccatatagagtatatgcttttgatcctctcatctacacaaaaaccagcccagtacctcattgcagctcaggaacagcagttcaaaaccaaccagcataaaaccattcatgttttgcaccttacagtcaggtagaactaaagttttgatgagtccaagatgaattgtactccagaatctctcaacagatagcaaggttccatgcaattcagtggtgatgatgtggctgaagaatatttgatttgattcacaaagtgctctagcaagatatatactcatccaaaactccacggagagatccattgcatcaagtattgtgctagattgttcacaataaactgacactacccaagttgcactgaactgataaataaataattgcatcacaatgacccaattagattgtttctttagcaaggcttgaaagtgtgttccattggcagctgaaacatccgcaatatctgatctcctttgaaaatgcttgcaccaaacagaacttgctagaaagttgaattgtaacatactcggaacttgttgaataaatgagttttcattcccatatagaacctgcctggttttgcataaacccaggtacaagatgcagcttggatttatcttcgcccaagattgcacaagcaaatcaatgtcacttatgtctccagttggatgatcaagaaggtagttggaaccgaaattgacaactcccagttgcagctgctctctctgtaaacagcactcatttgtcttcccactttgattccactgaagaataaactcagatttaactagtaactgttgcagcctttcccatagttctccccaagaattgacaaatgacagtagcaatagttttggttgcagcattacttccaacccattagtcaaaccgccacaataatgcacatgaggtgaaaataatctcaagatccataaatcaggtggtggccatgtcttccaggaagtgatctctgtcaatgtcaaaaacatcaattccttacttttagtttgaagagaaggtggccatgattgaaagagtttgaccagcacacttctgctgccttgtactgttcgtggatcaggacagggttcaagttgatgctcagcactgtcacctttgcaaatggctccaggaagagatggcccatactgtgagatcttcaccaccacgcttccactgccttgagtaaaccatggatcaggccatagtaaagattgctgctcaacaattgaacctttgcacttggcttgaaaaggaggtggccatggttggagaggctcaaataccaccacactgctgcatcttccatctgcttgacaaccatagagacatatcgtcaaacagatgagagatagatagatagctcagtctgaatcagctatcccgtagtactccaataaacaattggtgccatatactaatatacaaattaatcaaccaagaaccagtcaatgataattgataaagaaatgcgaaattgtgtggcatgcagatcgatcgaatggacagcaacgacgaggggtggggggtgagattccattccacccaactcaacacacaccaccaccacctgctgtgctcgagttcgagaaccccaaccccaactactcccattcctgcctcccctgcgcaaaagccctaaccctgctcaacacggctcttgttggtgggccccacccaggggaggttttaaactaaacaaaaaaaaaacttgagccaatcagcatccttctcgcccttcgccagtaggacaggcaaaaagcagctgcagcatgtttgggatgccacgtcagcaattctagctacgactacgaaatcctccagcaagaagaagaacgcaccatttcatttaggcttctttatctccaaaatctccaaaggcccgggctcacgacaacatcaccgctacagtgtacaggatcggagcgccgccgtatcgagtcgagatccatggagacctatcagccagggcgctgccgccgcctcgccgccgaccaccaccgtcgcggcatcctcgctgcaggtagtgcaagctgctacccctacgccgctaatccctaccgcatggcgccggcggcgagcttgttgcgccacgtcggtgcgggcggcggcgcgatgaacacggcgttcaccgagacgacaaccaacggcggcggcgacgcctcctatagcatcgggccaagcttgagcttgcgccagcaccacaccggtgtgggcggcgccggcgaccggaccacggtgttcgccggcggcgacgcgctcgccgcgaactacccctacagctacgcgataccggttccttactccgctcaaggctggcaccgcatcggtgcggggggcggccggaacacggcgctccccaacttcgacgtggccccttactttgctacggcggatctccatcacatcggtggaggtggcgaccacaacacggcgttcttccccaacatcgacgacctcgccatgaacgctttcagcctcgccgcaccaaaccagtactctgctgcggaattctattacaacagtgcaggtggcgagcagaacatcgaggaattctactacaacggtgcgagtggtgtgcagaacatggtgcccccctacatggacaccctcactgcgaacgctttcagcttcaccacaccgggccattactctgctacggaattctactacaacaatgcagatggtgagcagaacattgaggaattttactataacgctgtaggccatgagcagaacatagtgtcccctaacatggacaccctcaccgcgaatactttcagctttgccacaccgatccattactctgctgcggaattctactacaacggcgcaagcggtgagcagaacattgaggaattctactacaacggtgcgagtggtgtgcagaacatggtgccctccaccgtggacaccctcaccgcgaacactttcagcttcaccacaccgggccattactctgctacggaattctactacaatggtgcaggcgatgagcagaacatagaggaattctactacaacggtgtaggcggtgagcagaacacggtgtcccccaacatgggcaccctcaccgcgaatgctttcagcttcgccacaccagcccattaccctgctgtggaattctactacaacggtgtaggcggtagcagaacatcgaggaattctactacaatggtgcaagtggtgagcagaatatggcgttccccaccacggacacccatgcagtgaacattttcagcttcgccacaccggcccattactctgtcgaggaattccaccaaatcagtgcaggcgccgagcagaacatggtgtcccccaacacggacaacctcgccatgaatgctttcagcttcgccaccccgttcaatcactctgctgcagaattcttccaccacatcggtgcaagcggcgagcggaacacggtgtgccccaacaacgacacccacctcgccgcgaatgctttcagcttcgtcgcgccagtccattactccgatgccaatgcagacctccttctccatgtggtggatgccggcggtgagcaagacacggtggccgccaatgtcgacgtgctcggcatcccaccagcaccggcaagcatcaccaatgccatcgtgaagagcgtgtggcgggagaactacagggagcagttcaagctcgtggtcgacgcgctcaaccaacctcgtcgccacctctacatcgccgtcgacatggagttcgccgcagacgccaccaccaacatccgccgaaggccggtaacctccaccggttgctaccatcacctgcgcgagtttgtgaatcgaggtgacatagtccaaatgggcctcacgttcgtgttcgtcggtgacggcgaacaatcctcctcctcctcctcgccgccgccgataacactagagatcaacttcaaaatcaacatcaaggcgcgcaagtannnnnnnnnnnnnnnnnnnnnnnnnnnccgtcaaggccatgatctgagggagcaccggaggaggggcgtctcgccgcgtcgcgtctacgatggccgctccgtcacctggctagcttaccacggcgactacgacctgagtttcctcctccacctgctgcaacgcggaggccgccgccgcggaggcggcgatctcccgcgtcagctagccacgtttctgcgccggctacgggagaatttcccggcgttctacgacgtccgcgtgatcaggcagatgcggaggatcatggcttcagcgggaagctcactgggctcgccgagcacctcggaatccggcgtaccggcggcgccgcgcaccatgccggctccgacgcgctgctgacactgtcgtgtttcttcaagatcttcagatccctctcaggacagcagctgcatcagctggatgctcggcgagggttactcgctgggttagaggagtggaacatggcgatcaaatgtgctcgccacattgacgatcacactagaaacatcaaggtgatcgaggtggtggcagaaaacctcggcgaagaggcgcgacgaatcggagagctggtggacagcaacttcagcatcattggagtagaggtaaatcaggtagtaatccatcctcaattggacaggaaggcttatgaaatggtcatcgcgttcatgaaccctgaaggaatgttggcttacgggcgtgcctggaaattctgcatcagtcgtttcacgtcagacaatggcaatgtactgaatctgaaacagcttgctgaacttgtgcaatcttgtggagcaaccgataaccctgatgtatcctgggtgacattccacggatcagatgtgatctgcagactgatcaggtcagccaatggtggtgttattccttcatcgatcagcggagagagtttcctccctagcttgtatgatgtcgcattgatcgttcgtcgattccttggcattggcacactccctacaaccgagcgcaatggaggtatttttgatgttgctcgagcgctggaactgaaggccatcgaggccgacaaggaggcagagagggttcttcttactctgagatgcttcatgagattggcagaaatggagtcggctgtccaatggtagcttgtggcgagctgctgcatgctggagcgttcagtgtgcagtggtaccaaatccttgctgtttcttcttctcagaattcatacgtgtgaacttcatatatgtatatgttgtaacagtatgatttttttttatttagaactagggcatgaagataacagtatgattttgtagctttaatttgtgcttatatgactttccttataacttgtacaaattcctagcttggaatataataataagggtgtacatacgtgaattgctctgggtttgtatgctggtgaaaaagtagagattaattggatgttgatggtggatggaaacgaaatgcatcatgttgctcttccgtttggctggaacatgttggcatctggcatctgcagatctgctgtttttttttttttgaaagtacagtggcatctgctgttcgatctcttcgtagcttacagcccttacctttttttcttttcaatggagaattgctgctggagctgcccatcagcaaatcgctcgacggtggaagatgcatgatcgttcagtgtggtaccgaatcatttctgtctgtcaatgttgtcagtgtggttttttagctgttgttgtgatacaaaaaggaattctacttaagactcattcgagtgaacctcatatgttgtaacagtgtaattttgttgcgtttgtgctcatatatgcgacttttttttcttcttcttctttgaagactcatacaattttttagctttaaatagaatttaaatgagtgtttgtttgtgaattgcatgttgaatagcttcatattgattgtgaaagggtaagaggcctaatatgtaagtggagaagcttctcacctcatttactagcttttaagataggaaatgccccggttatgattcaacaatgtacttgtttgtattgtatgtatgcgcagatgaataaggcgaacgaactgcatcagtttgtagatgacattatgaataatcaactgcgagatgaatgatgtttggaccttgtggtccgctctgattacaagtgagcagaaatgctagtcgctaatatgttttagccagcacaatctgatgcaatctgtaacaaaacacatcagttgttttcttcgacatctgtctgaaacagcggtcataacatcacagagacagagattcgtagcagtgcaaaagttttagcgccaagtgcaacgaagcagaggagagcgaagcgccgaagcgtgtgcgtaggatgaattgcgtggttttgaacggggaaaatcacagatacgctttcgcgtgggcccacctatagcctgacttctcatcagtcgctttttactagaaaggggtcatggtagtaggatattctagcggagagggtggtgggccctctcgaatcctcccctttttctctcgcgcggccgtgtgggcgtgtgttgcatcccgtcgcgccgcaccgccaccaaccccacaaaggtggggccacccgagaaacgtgcccaatgctctgatttccctgcaatgcaccttgtacttcttttttatagtaactagctgggtggcctgcgcaattgcgcggctagtatccatacaaaactaccttcttttatatatgagtttacttaaattttgataaatagctatctcgtcatcttaggcctttaaaagaccaaaccttatcattttcatgtttctaattttatagtttttaaaagtcacgacaatcgctacctcttccttctttgtcacccctttatttgcttccttgatctactacggcttctattcatcctcatttgaactttaaaattgaccttataagttaattatctcgttggctttcatttttataatttttaaaagtaacgccaaacgctgccactctactcctcttcggcccatccgctgcctcatctctttattgtcattgggattttaaaaatcgaacgtagttatcatcagtgttcatttttaactttctaaaagtcccgccaaaccgtcagcggcatcaccattatactactctacagcccgcttgatgccttttcttttaattatcattgagattttaaaaatcgaatgtgattacctttgtgatttatttttttactttctagaagtcttgccaaccatagtgattgtgcagcttaacgggttgcctgtcatctctccttcctgttaattgtcattgggattctatttggggtttgtttatagtttttacgcccgctgtcttatctctttattatcgttgagattttacaaatcgaacgtgattatcgctggggtttatttttttactttctagaagtcccgccaaccactgtgatcatgatgttttaatggtctgtccgtcgtcccttctctggatcataaacacattgtttttaatatatataatcaattaattgtatgttcagcactgataaaaaatgatccagtgacatgccttactactgtacttctttaattggtttgttgattttatgtgtgcacgtactccgtatgctgcatgcatgagactacatgagtcaggataacacatagcagctagcacctactgaattacaatccaagtctagtacggattgtttcactcgggaggcagggattccgattcctctttttttttcttttctagccaaaattgaccggtcgatttcctattagattctttctccatctctaaatactttaaatacttttatgtatcgtatgacttatgatatcaatctacaccgttgtaattttgaacaatcatgatctagcggtttatattttttttcttttcttcgattaatgtgggaatttctagcccccacagtaaacgtggtgtctcctttcaaggctgctttaataatataatagatagatgactgggaaaaaaaatacttgtgcgtcgtaatggatgaatgctattttaatcttatcattgttatacggtttggctatggcaaaattgactatgggaattcgtttggatatatttttttagaaaatcatgagctgcaattaagagtccggttttcatctcaaattaacatgcgagtttttttaaagagatttcttatataattcctttgtatttctaaaagcaaacgaaatgaaaatccaactcaaacacggatctgtatttccaaaagagaacgaactttaaaaaaccgactcaaacacggatgatgtaccaaaatatcggcaaaaacatcttcaatttttataatagtagagaaataaaacatcacggttttttctcaacgagctacaaccaattattacggctaacactcttaaaaagaaaattagtagtattaaccagaaaattagtctagtgttttgtgactaatccagttttttaaacagaagacaatgtcactaatctaaaagcaagtttgatagtataacaaactattaactttaaaatttaacacatcactacaatcaatataatagtttatccatacaatattttcatataaatatatatcatatcattatcatttgaacctcttatgcacacataatatcttaaagcccatactgcagttggctataaagtctatatctcgtttttcttcttctcttctacatgtgtgcttatagctagcttatggtctgttgttgttgtactttgctctaatatctactcccttagtctcagaaggttttttttttaggatttagaaccgatatatttgcaccagaggtacctggaatattgggggcatttgcattacactcactccggtgcgttacaaagcagctttcgtttggtttcagattgcatgatcaaatgcaatcatcctgttggataagacataagcaactagcactactgttattttgtattgggaaaaggataacaaagtctaaactgcattaatctgcatccatggagtctgttcaggagagtggctgttattttgacgccaattctccaaagcgatcctgactattcttgtatattgatagagcaggaaaataaagctatttacagagttttgtaggatggggaactactcaccattatacaagttaatacatgaggttaatcctaattgagattagacaatatttgatatacagttcactatggagtctgttcaggagagtgggtgtttttttcttcttgtccttattgtttctcctgttaaagtgtcaggtcctgttgattactgatagcacaagatttaaaatttctctacctcatgatcgtttaattgctataatctttttccctgagcacatgacctttttttattccaacttaaattcatagctggtatgtttttatttcaggtataagcagcatagtaaaatgagcaaagttgacgatttaccttgaaggtaatccatgatagacgtaagttagaaagttgcaatacgactctccagtttctttcatagtgaggattttagagatgaaataataagaactatttgtaattctatgacaggtggatctcaattaatacctttaagacagatagtaaacttatggtcaagaactgcatataccaaaactgtgtttagttcacaccaaaattagaagtttggttgaaattacaacgatgtaacggaaaagttgaaagtttgtgtgtgtaagaaagttttgatgagatggaaaagttgaaagtttgaagaaaaactttggaactaaacacggcgcaaggtctgttctacataagatccaaagtgaagtacacaatctttgtaagatctgttttacggtgaccagatcaaacgtgattatcactcattttcctcattgtatggacaaattacgtactccctttcaaaaaagaacaatttctagagatgaatttggacacatacctgtttagggtcattcccagaaattattttttatgggacggagaggagcatttgtctacttaatacttggcccataattaaaaggaggcccaggactgcaatttgccgggtttgcatttagcatttgcatgtgctaagatagatgagataaactatatgcctcttgtctctttcaagtgcgctctgttattggcctcaaatcatcaatatctcccttaactcgtttaaaatctatacccatgaaatatttattttttttaaaaaaaaaactctcccaaagacaagttacaagtgcagtcaacctacccacgttaattttggccataattatttctagaatctagattttctcataaaaatattaccatacaaaaatttttttgtggcaaat

SEQ ID NO: 969 - DNA, 6543 bp, Oryza sativa
taaagtactttaagcacaacttttcgttttttatatttgcacaaaattttttaataagacgagtaatcaaaccgtataagaaaaactcaaaatctcttatatgatggaacgggacggagggaatatttgcctacttggccaataattaaaagagggggaggggggcaggtctgcgaatctgcaattagcctgtttttgcatttatcatgtactaagatatagggggataaattatatgactcttgtctcgcttgttattgacatcaaatcatcgatatctcccttaactcgttaaaattctacacccatgaaatatttatatatttttttaaaaaaatctctcccaaagacaagttacaagtgtagtcaatccacgttaattttggccatattatttctacaatctagattttctgataaatatattactataaaaatgttgcaaatactttcacatgtgttattgcactttgtgttttttttcagatttgaaaaggaaatttgggtgttgtatctagtacctactccctccattctaaaatataagcatttttagaatagcgtcaaatcaaacatttttaactttgactattaatagtattttttttaaaaaagatcaatcatgtaaaattgatgttaatagatttatcattaaaaaaaactacaatacttcctccatctatttttgataggcatatttccaaattttaaaaaaatatttttgataggcatatttcaattcaaccacctatcatcttaatgactttctcggatttaatgcgcgactctccattcttccacacaatattggctatataggcatcgagaaacgtaaatattaatgaattgtttgtttacgaggaataactagtagcatatttaaatggatgataagtagaattacttaggggtgtttgattgggcttttcaacctgcttttgcttttgtataagccaaaagccaaccaaaggcctaaaaccacagctgcttttgtccaaaatcagcttttggtgtagtataaatcaaaaccacttctagccctgctttcgtgcttttggggggaaatattacccacctgccacagcataacggttaccggttctttttttttgttgttttctttcccgtccgtgacttccctctcctcctgttcgtgacttcttccgcggcggcctcgacactggcggcagcggacgcggcccggactagcacgacccccgatccggccggcctcgacgacctctctccctctgccctggtgcacagtggccctcccccggcgagccgtgcatattctgccccccactcgacgccgccctgccctgctccgacgacaccgacgccgtccctggtctggacgccgccctgctcgtccacgccatcgccgccgaggaattgagccgccggcatctgctcttccccgtcgccgccgccgagaaatcaagcggacgaggaggagcagccccggctggcctcggttgcccactcagtcggggacatcatggccggcggtggtggcggcagaggccggggcgggggcgcagcggtccatgggcgccagccgcgcgcgaaggcagcgggcggagccgaggaggcggctgcgcatgccggcggtggtggcggcggagaccagggcgggggcgtggcggtccatgggtgccagccacacgcggaggcggtaggcggagaccaggaggcaggacagctcgtcgcatagcgcctccatctcgtcgtcggcggcctccacctcccgcaaaaacgtctcgagcttctggtcgatggaaccccctgccgtcatcttgccgatccagcggcgccgccacatcttggccgcaactgggggagattactaagatcgatctcccaaatcttcctcctctcttcccctccctcttttcctacggtggaagatcctgtgtacgacatgtggggtccgcttataagcatgactattatttcaaaagcttcaactattgaaccaaacgagtttttttaaaagccacggcccatattccacagctgctttttaaaaagccacagcccacagctactttttcaaacgccacagcttaaccaaacacacccttatacttgatcattgtgtcaagatgaaatatgactattaaaagtaaatggaaagagtattatgtaactttttttaaaaaaaaacatatttcttttacatatattgttgatcaaaataacatattaaaagactgtgtcaaaatttaaaaatacttatattttgagacggatggagtatttggaaaagtatacttaggctgtgtttaaatccaaagtttggatccaaactttagtccttttccatcacattaacctgttatacacatacaacttttcagttacatcatctctaatttcaatcaaaatccaaactttacgctgaactaaacacagccttagtggggtgtgcattacaacctttccatgtcagtcaagtcaatcgaatgatacattggatttaggcggaatcgtagcaggcgatttcgcgtagtacagtattatcttcttttttttttctgattgatgagtaggatattctggcggataggttggtggggccatgggcccgcctagaaatcctctcctttttcttctttctcgcgacggtttacgtatgtgggcgtggccgcgtgggcgctcgtgttcgcagtcgcgtcgcgccgccaccaaaccccagggacggtggtggaggcgtggagccacctggagaacgttggccaagaccgcctcactcagtcactctcacccgttcagagcgtcgaagggagactgtttctcgctccccatctactatacctcctctgcttttcttctgctctgtttcccctgctttgcaggagtagtagttcttagtgttctccttgcaattagtattaacctgaaatttaattcctctggctaatccttttctttaacatgagaaaatgtcactaatactaatggcggactaatcgagtgagccatgtgtgtctctttctttcctttttctttttttctttcttgaatcgctatatttgcatcagccatcaggtgcctggaattttgggcgaatttgcttcaggctcagtctgatgcaaaagaaaacaactactcctactaagtaacgttttgtttcagactgcattaccaaacgcaatcatcacaacctgttggctagtaacacatgttagtagcacctagcatcactgcttatttgtagtcaggaaaggatcattcacctctcactcacagtctgcatttacaattggtcattcattcatctgcattcgacaactgatgcgttttttgttggcacccgccattcacatccaactgctctactcattcatccgcatacaacccagtgcaatttacaaaaacaaaacacttctatttgtatattacaaactataaatgtgagtcttaaaacaaagaagagttttgattttgtaatgctttccagtccctgtcccctgctgctctctctttaaatgtaaataacttttatttctcttaatggaaaaaattcgcctctggcgtattcccgaaaaaaaaaacaaagaagagtggtctgagcaaaagagcaactgaacttacaccgttacaacataagaaactcagtcatgtgagtcttaaaaggaaaaattctgtatgagcacaaaagatacaaaactacacggacaagtgacaaaatggcattgacaaccacaacaaggattcggttaccacaccgagtgatcatgcatcctccatccatcagcaatttgctgggcatttccaacagcaactctccttaagcagcccttggacagccatctttgtgcctgggaaatcagggcgttctgccagtctcatatagcatctcagagtaagaagaaccctggctgcctccatgtcagcctcaatttccttcaggttcagtgcttgagcaacatcgaacaggcctcctttgcactcaatccaaggaattgtgatgatgtcaaaggatctacgcacaagcaatgcaacatcgtatatagcaggaaagaatgctctccggtgtccaatgtaagaacaccattggcttggaaggtcttggggagaaaggaatgacctgatcatcctggcgatcccatgtgctccgtgaaatgtcacccaagatatgttggggtcacccaatgccccacaagatgccataaacttagcaaactgttgaggatgcacacaggcattgtctgccctggaactgatgcagaatttccaggcacgactgtaagccaacattccttcagcgttcataaatgtgacgatgatttcgtacaagtcagaatccttaagaaatgtcttgatgagttcataattttgttgggcttcaactgcgtaggagcgcttacccaattgagcatggattacctctactcaaacgatgttgaagttgctggccaccagctcttcaattcgtcttgcctcttcatccaacttatgtggtagcatcttgacaacgtagatgcttccagtatggtcgtcaatatggcgtgcacatttgatagccatgttccactcctccaacccagcaagcaatccccgccgagcatccatgcggtgcatctggtgacctgaaaggctgacgatcttgaagaaacaggacaatgtaagcagcgcgtcggagccatggtctcccccttgcagcaagcggaggaggaaagccaagtcatagtcgccgtgataggcgacccaggtgacggagccgtcgccgaacgggaggtggcgcaggagcccctcgtaaacaaactccggcgtgacgcctcttttgctgtgctgcgtgagatcatggccttggctggataggaaatgtatcgactcgccatggtacttaggcgaattgacgttgaagtcgaagttgatctccagtgctatcggcggcgagggggcttgttcgccttcgacatcaccgacgaatgcaaatgtgaggcccatctgaactatgtcacctccgttcacgtacctacgcacgtgttggtagcagctggtggaggttactggcctatggctcatgttggtggcggcgtccgctgtgaactccatgtcgacggcgatgtagaggttgcgatgaggttgatgaagcgcttccagcacgagcttgaattgctccatgcaattctcctgccacacgctctgcacggtggccatggcgaggtagtgcgcgagcgtgatgtcgtccgcagcgtcgaacacggacgacgcagtgccgagatcatcagcgccagcgccgaagtagtcgatgatgcctgtggcagcgaagttgttcacgccgaagagttggaggttgtggatttgatcggccgctgcgagtgtgtagctcggtgcggcatagagatgggcgccgcggccaccagggacgaggatgcggcctggcctagtgcagaggcggcctcgggtgtgtagaagttgccggacggacgattcatcgtgatggtagttgttgccgaggtggtcgctggactgataatggttcactttgcctgtcgacggtggagcttgttgtgctgctggcatgccaagtgcaccaatgttgtcgaacaccttgttctggtcaccgccagcaccaacgtgatcattgaccatgctatccttgccgtccgcgccgatgtggtttatggttgcggtgtggtcaataacgtcgtacgccttgtttttctcgtggcctgctccgatgtggtgcagaaccactgcgagggtgccgttgtcgtggtagagctcgtcgtccaagcccgcacccggcttggcgatgacagcatcgtagagcatgctctcatcagagctcactccgctgcccgcaccgatgtggctcaaggtcgccgtctgggggatcgagctgttcttcttgcagctcgctccaccatggtgcaagaccactgcgagggcgctgttgtcgccatagagctcgtcgccggagcccgcacccggcttggcgatgacagcgtcgtagagcatgctctcatcagagctcactccgctgcccgcgccgatgtggctcaaggtccccgtctgggggatggagctgttcttcttgcagctcgctccgccgtggtgcaagaccactgcgagggtgccgttgtcgccgtagagcttgtcgccggcgccgatgtggttcaaggtgtccatgctgcctgccgccggtggagcttagtgacgcctttgcgacgtcaggaacccgagggtcgacagtgagagagagagacacctctacgaaatgtgcttttgtctaatgtggtagtatgattttgaggcgaatcccctgtcctctcgcgcttagatagaattgttgttttagcttaggacaaatgtgcccctaaactctaatgatctgcagtggcaactgctgacgtggcatgccaacactggaggtcgcggctgattccggattggctgtaataataccgtcaagtttttataaatttaaaccaatacgggccccccaacccaagagttcgaggctttgagccggtatactagtgcgcaggattctccacagtggtagttaatcgctggaagcgaacg

SEQ ID NO: 970 - DNA, 8079 bp, Oryza sativa
acgccggcggtgaggtgatgcagcggggaggtcgtcggcgcgtagagagcatggcgggatggatggagactccaatcccatggttatgcccgcaaggaaggcgggggaaggctggaggcaacgtttctgttctaccagcagctcttcttcatcaattcatggtgagcagcaagaactagggctggaaactgtcaatcaatttttctttaatacgaatatgatatcctcctcctccttttttttttcttttcatacaattatgctagtggtgttagacgactacttttaattcaatggtaaccgtgatgttaggacataagattgcagtttgatgtagctgatgtaataatgttcatgctgctacactactgaacatctctatatacagtatgagcaattttatagtccttgaggagatactatgaggtaccattttttctattgtaaatttggtatctcttggtatctagatactatgaggtaccaaattttacactaaaattttgatacctcacggtacctcctcaagaaccatagaattgctcatatagtatagtttctgttctccatttgcataacaccaggctaaatttttctgggccctgttttttgagagactatttgcgactgatctgcgaacaatagaaaagacttactttctttagggtgtggattgtcttctgtttggggtctttggcaaaccagaaacaaaatggcgattgaatcagtgtttttgttcccctgttaggccctgttgatgtttccttcgtttgcaaaacttagatatgttagtcttttgtttccttcatgtttagctgttgtccccagccctcaaacttctatatcccaaactcgctctcaataaaatcaagggccctgccctttatccaaaaaaaaaagttatatatgaaaacgattcaacttgaatatccttaggtttaatgaagtgaaaatttaacagttaggacgaagcatcacctaaattcttttggtcctttttcgtattaattgtgatgcactctagtcttatttacacttcatctcatttgttagtatgatccaagaaaattactgtatggctcgagtttgtccctggcataatctgttataatgtatcatttgatgaagatgtaccaaacatcacgttgcctagttcttcttttgattgttgatctaattattgggcacatcatagctgaaaataggacttgattactgattgcacaaggtttaaatctttctatctcatggccgttgaattgttaatcttttccctgtacacatgattttttttctaattgcagctcaaattcataggtggtatgtttttccttcaggtataagctgcactgtaagaagagcaaagttggcaatttaccttgaaggaaactcatgataaatgtgaatcaagagaaaattgctataggtctctccagttgcttccatgctgagtattttagagatgaaataacactctttgcaattctgtggctggtggatcaattaatacatgtaagacagatactaatgcatattccaacttttctacataacattcaaagtcgatctctatccaaaaatagaaggtacaaaatcttcgttaggtcaagctttgcagacccaactaagttgttcaaggtctttttgaagaagcctgaagaatcagtgggaatgcaatattcagatccagaagggctccacaataagaggtatgccattgattattgattcagttgatctttgggataaccaatacattttctaaaaagcactatggcataatacactactatctgataagaataagactaaatggataagacaatgtttcctgttatgcccccacacctcttctatggtcaatgatcccttgaaacatgaacttacaaagcatattggtgttgatgcctcctttacccggtctcattgccatcagaaaacaattgctcttcagtattcccttagaattgcaagtagcagttttttttttcactaaatcgcaaactcgagagcatcatcggcttccttcatttactcaaaccaatgcttcagatcctccccttccaccttgagtttgaaggggggtgttaagtatatcaaacattcaagcacatatcttgtaggcccatgtggctcatgaggactctgtataacatcatcatccctgagggataatggtctttctcaaatctccaaggtaattaacagaccttagagggagcaaaatacaccatgctaaagtagacgatcaggctatcactgtaaaatcaaagtgtttttgattattattctgtgatgaacaattggacattggagattattggttttgttatttagaatctattcacgaagtggtttttgagatgattggattttacaggtgaatcgcaggatcgtcattttatgtgaccggtcagaccgggtagtgtgtgccggtcagaccggcgtgtaatgcgcggtcagaccggcgcagcccacggtctgaccggccgacactgtgtcggtttcggttttgagttgtttatttggatatccgaatttattttatgattatgacttctagatgactcgatgtcaagttggagatagcttggtctcggaatatagtttctttgtttatttcatgtgtaggtgactcgatgtctcgggagagtatttgcggtgatggaccgggagtcggcttggggataagatgacgtccatggtggtcagagatcatgtgggatacttaggctagagttgatgcacatggttgatggagattccatatggcatacgatggagttattgtgtgcgtatgggatgcggagtcgaatttggaaggagtctaaatttggggcgattggttatgtaaagtttcttacttgtactagaggatttcctaaagtgtttagaactcctagtatgagtttggttcgtggctttaggctgcctacctcatgtataaatagaagggggagcggaggccttccggtatggcttttgaaagcaatagaattgagttttgagttaaggtttcgagtttagtcgagatttttgtaaagagtgatgttggtgcactttgaaaacacagagagaatcaataaagtcgtcatgtactttaagagttcttcgatttgtgtttcatcgagtttcggcggtctaaccggcgatctaccggcggtcagaccggtgggagcacggcggtcagaccggcggcggcgacaggcgcggcaggcaatctcggcggtcagaccggagattcaacaccgggctgtcacaccccaatctgataccggcgtacaacggcacctgataggagcgtgtcgtatggaaaacagcgcgaacccgttttctacgaaaccgcgatctcggtaccagtcccaaggacatagtgcttgtacccacggtgacaaatatgaatcaaagcaatccttaaataaatagaggacttatttaccttaacttaggttgcagctcagacagcccgagaatacaaccgacgacgcggacgaggaaacaccaacagcagcagcagcagcggaaccaacggtctaacacccaacaccacaggcgacggctgggaaccaggacgaaaccctaatcttcacttcactttatcttctcttcagggcggaggaactatatatatatttatatagagcaagggtgagtactttcgtactcagcaagtcacgggaacttaggtgtttaatgcaagcttggaagagaggcaaggttgttttgcaaatcttttatttgaagatattttgaaatcactaagtgatttatttctttctaagtttgggccgaaaagagacttacgtctcgtttcgaccttaagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttctactcgggaagcctagtctatgatgccctcagacatcccgaatcacacagattcgtttctgaccactcaggtcatccatctgtcacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggcctttttaggcgttcacaaatcaaactccaaccaccttgatcggtaagtgagcaagcttctcgtccttgccttactaagaacccggtttgtccgaccccgccccggcgttcccaactattggcatgcgaggcttccctgaatcgactagttacttagccagggtgtcccattccaccttgtggttgcactttgattatgttcgatgagtttcccacaggaatcggtccttatatgcgaatacaggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgccagttgcaaacaaaataataatgattttccaattataggagcaattggtcaaagggtgacttgtctttctcaaggtcttcacgaagctttacgaatcttcgagaaatcccatgatcgacgaaaatccgataaccgcaactatacgcaaacaatcgaaaacctaaacaaaagaccaaaagaaagatcctatttagactaaataatagtgccattaaacagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcactgaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaatgggtggcggatgtggtagggggaggacgagggagcaaagttagactttgttccacggcagctggtttggaagagagacgcaacatagactttgttccaaggagcgaggagagaggtgaggcccatcagctagcgagagagagagagagagaggagatgggccggctcgggttgggcggcccacggccgggtgggcgtggccgagccgagccaggcctgcgcgcgcgggcgacgctgaccggtcgctgcttgacccggtcaagctgggccggcgggccagggtggcggccacgttggcacgggagagagagaggagaggagccgggccggagatcggacggctcacggcgcgcggcggaatccggcgaacggtggcaatccggagcgagcggcgggcaccggaagcgagagggggtcacggaggttccatccaccggctcggatatgggagagaggcgcgacggaggccggcgacggcggccgtgcggcggcgggatgggtggcatggcgcgggagcaaaagaggaggccggcggcggaattggcggtttggggtggttcattggagctcaaggtgggtggcggcgaggggattcggcacgggaccgaccggcggcggcgcgcgactgcgcacggcggcggcgggagcaaggcaccggcaagggcgcgatttggaggacgaacgcacaaactaccatgccccagtgctgtttaggagtcgctagaggatatagatgagaggatttgggcggggagctcacccatgagcgggaacggcggggcggatggagtcgcggcgaggcagacgtgacggcgggcgggcacggcgcggagagtgaaagggaagggcgcgggcttataggcgaggaggaaaggtcggtttgaaggagggaaaccgacattggcggtcaagggagctcggctggtgttcacgggcggcagcggcggtttcgtgggcaaagcgaaggcggcgacggtgtggatgcgttgggcggcgaagacggtggatcgagcggcggaaaatcgaaccgcgggagcgggaggattagcgcgggctggcgcggtcaaggtgggggcgacgagctggcgctggcgtctgtgtctctgcctccgagcgctagcggccaaggagcggaggcatggcgtcgttgcttgggagggaaaaagagaagggaggacggtggaaaggggggactttaccatgccggtttgggaaaaaggaggtgggagagggagtgctctgccttcgggatttggatggacgcgggtggagcggcttgggcacgcgctgcagagcttgcggcaggcagcggggccgagcggcagcatgacgcaggcgctaacggcggcggcgaccgggcggttgcgcggcgcaggcgcggcagggctgacggcagcaacgaccggccggtcggccacgcgcgagcgcgggaaagagcaaaggcggtggcgagttttgggcggcgacggcgggaagcggcgtcggcgcgagagagagacatcgagagagagagagagggagaaacagcgagagcgagagagacagagagagcgagcgacggctctctctctctctcggctcgcatgcgtgcaacgcacgtgcgaggggggggagatgatgggctgggaggggagatgggccggggaggagagtcggtccatccaaaaacatagggaggtaaagtagacttttacagagaaaactgatttggatagaattggagagatttagggtttggattcgaattcaaatttgatattcaaactcgagggtttagggatatatcaggggaaactcaaggagaagtcatggtaaggattcaaaaggaatacttggatatttgttctcgggaacatagggtggagtctaggaaaggattcgaggcgggatttgaataattctggattcgtagaagtatttggcgaggattcaaaggaaggatttgaatttcagaatttgatttcagagactcgaatcggaagaggaatttggatgagggggaggatttttgatttcgatgagagggaacaacgggattaaattgggatccttggcacaacttagactctcacacagagaacgaaaattttcgcatttaggattttgccgaattagttttttaacgtctcacgaaaagcggagcattacacggtcagaccagcggcatccactcggtcagaccagcagatcaatctcggtcagaccgacttccgtcgatttcgagggtaacttttatttccgctaaaagttttcggtttttgggtataccaaccattcaacccccctctggttggcttagttcttgtgattcgatcctacaatcacccctcatggtaacctctgcaccaccaggaattgtaccttaaaatatagcaaatgaagtgaattaccttttctaaattcaggcacaaatggaatctctatgtgtagttactttattgatcgcggtttatcattgacttcattgtgaactggagatatgctttatgtaccagtatttttactgcctattacagagagcagtgcgcatcaatatctgtatgtggaacctataatttcctattcctttttgctaaccgtgacattctttagatg

SEQ ID NO: 971 - DNA, 3064 bp, Oryza sativa
aagggattgtgtgaccccaagcagtcgctatgattttggatagccaggacaagatgatgatgagccaataattacacaaagttagcactagtgctgaccataagaatttgatgagatagtttcagctatatctttgtagcatcagtctactattcagagttgaggtattgattagtgcttgaccatcaagcaggtggtactttcccagtttcacatgttcaaaaacagacgtgtcaacaaatgccagcttacagtgagaaccggtcaacctgaacatgtttaacaactgtaaatgatcttgttagggatttaccaattcgagtaatcctccaatattaatgggtacaaatatagaacgattccatgcactggtggagaaatactttttagtcacggttcgcaaccccctgtagtcccggttatctttagtcccggttcaaatacccgggactaaaaatagatctttagtcccggttagtaacaccaaccgggactaaagagaggggatctttagtcccggtacaccaaccgggactaaagagagggttgcggcagtgagatgatcccctttttctttttttttcttttttattttctcccaaatcaagtgggatacatatcccaaatcaaacccccaatccacaaatcgaagtaacatctcaaatctacatcacaaatcaaagttacttatacacacaaataaatacatcacaaatcaaatacatcacaatatcctaagaaattactcaaatacatcacagatccaaacaatgaatcacaaatttgtaacttctcagtcaaatacatctcagtgaatcatcacaaattaaaaaaaaaagaatgccgttgccaccgccagtcgccacgaacgacgggcgcggccccaccggccgccgggcgcggcctcgccgcccgccgcccgccgccctccgccgggcgcgaccccgccgggcaccgccccatcgcccgccgccggccgggaaggggaggaggaaggggagagaagggggaggagaggaggaaggggaggagttggagaagagagttatagaggatagatctgaggatagagggtgagattcgatctgttaagttgtaattgtggatgagaggataagggatagggattatatactacgtgtttaattttagtcccgattggtactatcaacctcttgatctttagtcccgattggtgttaccaaccgggactaaagatcaaaatttttataaccgggactaaaaacaatctttactcccggttctttttggatccgagactatcgtggattttgccggaccgagcaaagatggttcctccaccagtgatgtcattccttgaataagaaacacatgaggaacaatgattcaactaaagtactccagcattaggaaatttcaagttactatttgcatgatgaatcttttttgctctgctgtggaaacagcaacatacagacttatcaactaattttggaagaacgagaaagaatcaatctggtttggtggggaagatcagctccggcatcgtagggcacaggacaagactgtgttgcagaggttggagacgtcccgtggcttcacttatggactaggccaaagagatgtaagttgagtggagggaggtagcggactgagctagggctaaaaagaaaggaaggaataagctttcaaccccaaaacaaagcaaagatttaatgtttcaatttaggaaagattttcacatcttatactacacccttcgttctaaaatatgagagattttggacggatgagacactttctagtacaatgaatctggacagagagcaaattcagatttattatattaggaagtgtcccatccgtctaaaatctggagattttgatgtcccatccgtctaaaatgtcttaggacggagtattagattgtactcactactggattgtttttattttggtatgaagtacagcctacaggcgagggtgtgtttggttgcatgcatgaaacctggctcgcacgcgtggatgcagtaggtcgctgtttggttgcctgcagctcgctcccagcctggtcgagcggatgcaaaaaatcccccacagccaggctgagcagaaacgctcaagttgagcttcgctactcggccaggcccgcacgatgcaacgcgctgcatccgcgcatgcagcgccccgcacccgcgtgtgcaagggcaagcgatggggtcaccactccgccccttgctcctcgtcattttcccccagcaatcgacatggcgaagacgagctctgctagagggagtggcgcccgacgaatccaacttgctgctgcatccccctcctcttcccaccgtctcccaccttcaatatccggccaccgccttgcccacacgtccccgctgatggtgtgagcactgccagatccaactagtggtgaggcggcaaaaagcttgacggtgacgagctcagcggaggtcgcggcgacgaggacggcggatccaccttgctgccgcatccctcctcttcccatcgtatcccatcttcaatcgtcggccaccgtcgtatcccaccttcttctgtgccggtcagatctggagcagaggagcggcaagcggcggatggagaggagcgcaggaagatgggtggaggaacggcgagcggcgggcaggtgggcatgcatgcggctgcgggcggacgggagttgatgacgacgaagcgacggctgcaacgccgatccccttcctttctctctttcgtttcttttttctccccgggttttctgttttctttttctttcgtttctcactagcaagtactccagcaacagagaagtcaatgtatgcagaattactactaatagattaattagttccactggttcatctagcttaaagaaaaactagcatggtggcccgcacagattgcgcggctagcattattatattttctctcacgtaataacatatatgttttcttattatattattcaaatatattaaaataacatcataattttaaattttacaataactttacgaaactacaaatgtgtaatattcatatggtattttatatttaatgcgagata

SEQ ID NO: 972 - DNA, 1035 bp, Oryza sativa
tgtcaactttgctctttttgccatgcagcttatatctgaaacaaaaacatatcagaaatgaactttagctgcaatgaagaaaatagtatcatgcacagggaaaaaattataacaatttaacggccatcaggagagattttaaatgttgtgctataatcaggtctcagtgtcagctatgaactgtgctctgtaattagatctacaatgatacaccagggaaagagctgaggaaccaaattgatgttggtatagcttcatcaaatgctatatcaaaacctgcattgtgtcaaagaagtgtttatacacatagcaaactcaggcgtggccacactaattttctcggatcacactaacagatgagatatgaagcctaaataaggccggagtacataacaattatgaagcataaataatttttcaggctctgttttagttgatgctccctcctaaatgctaaccttctacattcaagaagattgaaatggtcaaatattgtcccttccaaacgactaccaggatcacattttggagagtttgcatcaaattctttagcctactgcctgctaaactcctttttgctgggatggctgctgtcctaggagagaccatccaatggtattaagattacctagtgctaaactcctcaatttaacctagactaattctgtttgcttgggaagattttatcccaaccaggattaattaattcttccgatacagccatggatggcgctggatctggatcttgtttgctcctcaagacctcaaccctgtgttgcacataacacttgctgctggtagaacagcaagaacagaagcatatccaccttgcggaaagaaatcagaggacagaggaggagactggagaagctgacctggaacccttggcggcggcggcggcggcgcccgccatgatgccctcgccgccggcgtcctccaccgtctcgggttgggcggcgctctctcctcccacccccacgtcgccccgatctgtcacgaaccaacactatcacacctaatctctcacacacagtg

SEQ ID NO: 973 - DNA, 1970 bp, Oryza sativa
ggcgcagcgcacacttatccggtccgcgactggtcgcggtgtgtgaccggtcacagaccggtcagatcgcgggttaggtggcaacaggtggtctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgttagaggtcacttccggctgtagactagccctcattgtaaaaagcatgtttcccttcttaggcagctagaggcccatgtggtgacccctgaccagataaaaaggaggcccaggcctaggaaaaaaagggggagagagagaagaaaggaggggagttgggactctggcgaagggtttctagagcctgaactctctttcgctctcggcctctcgggattccttcacgcaccgatccaccagaacacaggagtagggtgttacgcttctcagcggcccgaacctgtctacgtcgcccgtgtcttgcgtatttcctctctcgctgacgttcctcagatcgagggcgaagaatctcacttagcgcccccggccgaatcggcaaaggggggcctgcgcggtctcccggtgaggagcctcacgctccgtcatctggcgcaccaggtaggggcgcgcgtatttttctaagccctcgtcctctttcgtgtgcgccaagcttctctcgctcagcccaatggtcgaacgggcagtggcgcacagcctctctccgaacgctagcggtgacgatggggagcagaacccgcgccgtcgggctcgcaccccaccgttcccctatcgccgaaatcctgggcggggggtggcgctcggggaggtcgaaagatccgtgacttctccgcccgcgggcgacgggggaggacggcgagacggggcgcgtcgccgcctcgtctactgcgatggcggcacgccccaaggcgcgctccaggctgcgggcgcgctcctgcgtcacccgcctgtcgtccccgatccaaagactccagcccgcgttggctggatgacgtggccgacttggtcatgacgcgcagcggcgcctaggcgccggcgggcggtcctcccacaccgaggcctctggcgctgccgccgccggctccatgtcgtcgaggcggagggcgcggcgagcggcggccgttacccgccgttcgtccgccattccctcgtcaacgcctccgacccaagaatatgtgcgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagcctttggaacgtccgttagcccccaaggttccggcccaccatcaccgaaaaatacaacggaagcgtcaaccccgccgagtttctccagatctacacgaccgggatcgaggctgccggggctgacgacagggtcatggcgaatttcatccccatggccctgaagggtcaggcgcggggttggctaatgaacttgccacccgcgtcggtccactcttgggaggatttgtgccagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcaagaagatcgcctccaaggagccccagaccaccgc

SEQ ID NO: 974 - DNA, 1784 bp, Oryza sativa
tagacaccgatgacaatgaagaagagagacatcatgggcagatgagtagttaggtaacaaaggaaagggaggcgatggttgccatggaaaacgggccaagggggcaacaaacgagtgaagtggtagcgctggtttctaaatccaataaaaaggaacctcaatgatgataagattttgattttataaggtaccgataataacaaagataaaagacagcatgacaaacggataacaaaagagaagagagagtgagagacagcggttgccatgggacagtgagccacgaggggtggcaaatgaccgtaaagaggaaggagcaggtgggctgtaaaggattaggatggcacggttgatggaacatctaaagactataaaataaaccgcaatgacgataaaaaaggaagggcagcgggcgaatcctaaacgagtgtggtaacggcgattgacatggcttctataaagtaaaaaataaaattgactgggcttgttaaaatcccaatgtcaacaaagatggctaaaagaaggggttgtaggtggactgtaaagaagtagagtagcttcggttggcagtactttttaaaactatgaaaagggaaacgatgatcaggttcaatttttaaaatcttaatgataataaatagaaggggttgaaggcaggccataaaagagtagggtggtgacgcttaactggacttctagaaactataaaaaacagaacttgacatgacaataaactctgaaaactattaagtctaatttttacaggttccaaagaagattaaaagaaatcatagtgtgccgggcaagattaaaggggtggtggctggtgtgactttataaactggtttttttaaatcttaaaacaatgaggtaactatttaataaattttaaagaaatttatgtgtaaaaaattagataatattatatggatgctagccgcgtaattgcgcgggccaccctactagttgtagtagaattcctcaatattctgctcaccccctacaccattgtagtagaattccacagcagagtaatgggccggtgtggcgaagctgaaagcattcgcggtgaggttgtccatgttgtgcggcactatgttctgcacaccgctcacaccgttgtagtagaattcctcgtaattctgctcgctgcctacaccgttgtagtcgaattccgcagcagagtactggtttggtgcggcgcggctgaaagcgttcatggcgcgggcgtcgatgttggggaagaacaccgtgttgtggtcgccacctccaccgatgtgatggagatccgccgtagcaaagtaaggggcgagcacgccgaaagcgtgatcgacgttggggaacaccgtgttctggccgccccccgcatcgatgcggtgccaatcttgagcagagtaagcaaccggtgtcgcgtagctgtataggtagttcgcggcgagcgtgtcgccgccggcgaacaccgtggtctggtcgccggcgccgcccacaccggtgtggtgctggtgcaagctcaagctcaagctcgggccgatgccgtaggagtctggcgtcgccgccgccatcgccaagggttccaggtcagcttttccagtctcctccttcccctcttcttcctcggtcctctgattctttccgccatgagttcttgttgttctaccagcagcaagtgttatgtgcaaaacacagggcgaggagcaaacaagatgcagatccagcgccatcgatggctgtgtcggaagaattaattaatcctggtttggataaatcttcccaagcaaccgaat

SEQ ID NO: 975 - DNA, 11341 bp, Oryza sativa
ggcaccgattgtttaatactacgggatagctgattcagagtttcagactaagctatctatgtgttcgaccaaatgtctctatggttgtcaagcagatgcagcagcggcggaggagggaggatcgggccggggcgacgtcggggtgggaggagagagcgccgcccgacccgagacggtggaggacgccggcggtgaggacatcatggcgggatggatgcaccgccgccgccatcgccaagggttccaggtcagcttttccagtctcctccttcccctcttcttcctcggtcctctgattctttccgccatgagttcttgttgttctaccagcagcaagtgttatgtgcaaaacacagggcgaggagcaaacaagatgcagatccagcgccatcgatggctgtgtcggaagaattaattaatcctggtttggataaatcttcccaagcaaaccgaattaatcttggttaaattgaggagtttagcgctagacaatcttaataccattggatggtctctcctaggacagccattccggataaaaaggagtttagcaggcagtaggctaaagaatttgatgcaaactctccaaaatgtgatcctggtttggaagggacaatatttgatcatttcaatcttcttgaatgtataaggttaagtattagtaacatttaggagggagcatcaactaaaacagagcctgaaaaattattgctggcccataacattcatttcattattggtatgtattccggccttatttatgcttcatcttatctgttagtgtgatccgagaaaattagagtgtggccacgcctgagtttgctctgtgtatatacacttcttcgacacaatgcaggttttgatatagcatttgatgaagctataccaacatcaatttggttcctcagctctttccctggtgtaccattgtagatctaattaaagagcacagttcatagctgacacagagacctgattacttatagcacaacatttaaaatctctctcctaatggatgttaaattgttataattttttccctgtgcatgagactcttttttatcattacagctaaagttcatttctgatatgtttttgtttcagatataagatgcatggcaagaagagcaaagttgacaatttacctcaaacctaaggaaatccacgataaatgtaggtcaggagaaaattgcaattgcaacacactctgcatgtgtggttgcttccatactgagattttttttcaatgagataagacctctttgtatttctatgacaggtggaacaattaatacgtgtaagatagatactaaacttcaggggggggaggactgcatatatcaaggtctgttctacaatctacataacatccaaagttctctccccaaaaatgacagaagtgcaaaatcttcattgcgtccgttttgcaatattttgaagaagtctgatggaacagtgggaatgccaatattgagatccagaagggttccaccatcagaggtatgctttgatcattgaattgaattatattgtaaaaaaccaatgttagaaactgaaaaggctccatgacatactaatatttattttgattggctgataggactaaatggccaagacaatatttttgaatttcaaaacttttacatccttgatcctagatgtatcgaatacaccatgcgaaggtagatggtcaagttgtgcccaactgcctatgtccctcactggtaacctctgtgcactttcaggaattttactgtacaatacagaaaatccaagtgaacatcttttgcttaacttatggcatacatggtatctctaagagcagctaatttatccattgcagtttatcattgactggagttatgccttatgtaccagtgcttttttactgcctagggagtattacagagagcagtgcgcatcactgtatttgtgactggtacaggatcaacatgattttgtctcgttcttcttttcaatgttttttttttctggagtgtttcttgttggaaaaagagatgaaccgagtgcctagttctctcgcagtactttgtggcagctgagaacagtacgattgctgattatttaagtggatgctgacagcagttgatctcttggtttgcactaatctgaatgtttttgtttggacgtttttgggcagatgatggtcattggtgatgaaggagatccgtagcaagatgatgaccatatgaatttggtgagacagttttagctttatcatcttagcatcagtcaagtctagagagttgaggtggtgattgatgtctgaccatcaagcaggtggtgcttttcgcaatttcacctgacctttttttttttgttcaattgctgagggaaatcatatgtgatgcctcaagtctctctccaccaatgccagatttcaatccagaacttgaacatgaatagcaaaattgtaaatgaatttgctaggaatttaccatttcaagaaatcttggaatattaacaggcacaaattgcggagtagccaacctccatatctttcgttagaataaggccatcaccaatcaaggataccatatgagtgtcttcactaactgaagatactgtgcgggaaacacctctggagaataccctggtgacccaatgagtgttcctaacccaaaaagcctacgtagttattttactgtactacccctctcttctcccccacttcctctctcttccccacatttactcatctaccggacccgttcacatcgtggtcctcgccgccgccgctcgcctttccctctcgccgcggggccactcgccgtcgccggtggccgcgagggctgcctccctccctctctctcctcgccgtcatcgtcgccgctgtggccgaagcgtcatcgccgtccgccacctccgcctccctccctcactctcctcgccgtcgtcatcgccgccgcggccgacacgtcgtcaccgtccgccgcctctgcctccctccctcactctcctcgtcatcgtcgtcgccgccgtggccgaagcgtcgtcgtcgtccgcctcctccgcctcgccggtctcctccgcctcgcaccgtccgcctccctgatctcctccgcctctcgccatcacaggtcgggggcggcaaaatccggcgccgtagcgggtggatctagcccccccggctagatcggggaggagatggtggcggccgtcgcgctggtcgcggggtcggcgccgtcgccgtcgcggggtcggcgccgtcgcctccgactcctccccactgccgtgtgcctcccgcctactccaagcgacgaggccgagggtggaagggcaaagttgtggtgggggagccgtgtccacgagccacgcgctcgtgcaacacatagccccaagcggtggctcaagaaaaggagcttgagccacccgtcccccgcctgagggtcacgcctccctcccaggagacgacccggcgacggaagttggttaccgtttgcgaggctacgggctggagacacgcattggtgatgcccctaagaaacatacgagtaaacaactaacgatgattattttttgctttcaagtggtaacagcaacaacgaaatacaggttttttttaacagcttctttcagggtgttcgaccaggaatgacatttgcaagactgaagtcaccatcaggatcatatacacacacgtcagtttcacaatctcaaagatgcaaaagcatcaaacaggtcatgaaagaggactaagattacaaacacaattacagaaaggccctttgctgtgcctctatttgcacttgttgtactcagtcaacacgtgccacgtgagcttggaacgaaccaaagcgtgcagagaaggggcgccacacgagcttcatcgcatacttgctgctccctttcccttaggaaggtcaggaaagaagggttttcacttttagaaataaacagaaaacagtttagaccaacaaattccctgtttccatttacataattctcaaaaaaatatatatataagtcttgtaacttgtatgaaagtgtttgcaacgaaacacttgtatattgttttcatgaacccccccccccccctaaaaaataactatggccaaataggttgaccacatacacttatctttagaaaaaaagaactttgtttgctcgaggacgtacaaattatacttcctccgtttcacaatgtaagtcattctagcattttccacattcgtaatgatgttaatgaatctagacatatgtatctatctagattcattaacatcaacacgaatgtgggaaatgatagaatgacttacattgtaaaacgaagggattaccagttaacgatttcactgatgatttcaaattaagaacagcgacatatgaaagagacgaggttatcccctaggttggccaagtaatgtgtccaaccgactacgaaaatgacctgaagcctcgaaaatcaatagatttcgtgtcgtcatggtgattggactgtcagctgtagattgcagccaatcgaccgcgcatttcctggaaaatcttgctcggtagagccagtagaggctacctaggacttttgtaaaattgaagttctaatttctggagctaaaagaattttaattccaaagatcgatttcttgtccttttttatgttcgatttgttgtcgttgttgcctgaactggtcagcttgcaaccaaccatatatcctttctgaagtgaagtgcatctctttaattaattcgtcgtgtactcgtgtgggcagtgggccagccagccgcccgccactctcacctgtacttcataccaaaataaaacaatcaatctagtactactagtttaagatatggagtacaatctaatatttcatccgtcccaaaatagatgagacacttcctagtataacaaatctaaatagtctctttgatcagattcactatactagaagtatctattaacgaccaaatttggtaaatcatatattggatttggagccaaagccgaagcggatttggaaggagttcgttatttttggggaacaaagtgtgcatcggctatggattgcatcggctagtgtctgcatcagtgaatcggataagaggaagccaatgtagccgatttcggcaagataattatagaatcattgtcaaaatcgactgaagtactgtacaactattgctaaatacggattgagtccgaagaaggcaattgtatctattaattaggatattctagtagtttctttatagatattttcggtaagagttcgcctaagggacttgttcgtgttttaaagttgtaatagaagtagagtcgtgtccgacaaggacatattatatattatgggtataaatatgaccccataccttgtaaataattaacatcagttcaataacacttcaataatactttcagcgcatcaccacccttttctattttcattgtttcgacgagttcttgctttcgagttgggctgcatcggttgcaatctccgacgaaaaggtaaaacttgttatggcggcttgcgttctcaggattagtgcttacatccttatgacactctaatcttgtttatgtaaatcgccaagttatcatatatgctatataatctagatcgataattttatatagttctatcggctagtctctattatcgaaaccagccaataagattaggtaactttgttgagttagattatatagtatatctaccatctcgaaaaagttctcatgggcttgtttatcagatattatgtttctctttatgcttaatgttgcatcggttaagtttgaactattaagtaatatctagaatcataatctctagcttgcttcatgattaccgatagagatagcattggagtttcagccgatcttacctggtttagctatcttgttcttgatttatctactcgatatgttaaatctgccctttatatcaagatctcattaagaaaaaatatattaagctcgatatcaatctgcttagattaaactaataatagattgattcttgttcaatatatttaatctataatgatatcttagtataaaaaagtatcagagcaatagccgatacacactagatttgcctatcggctatgatatgagtttatataatcttttgctttcaaatacttttagacttgagtgatttatactgctttggcagccatccgatctatccaatcacttggtttaaacatatttagaagaatagattatattgtgttgatatttacagccgataaagtgaatttagtccccttttcactatatacgttactgtcgatccaaattatattgcattggctcgatttagacaatatgtcattggcaatttagctgatcggctatcgtttatggatttaactttgaattctttgtttcttgttggttgcaggatcaaaccaactggcacgctctaaacccgaaagcaaatctttagacctgcactagagtaaaacaaatctctcaggccagtgtgtgtttttttgcatcaacaatgtctcatccatccaaaatctcttatattttgggacaaaggagtagtataagatgtgacgtattcacgtctattcagatttgtactagtagaatgtcacatttcgtattaggtttgtttactcatattttgtattccgtattaggtttgtttttttaattttagtagtcacattttgtattaactttgtttattttactatactagaaaaatgcccgtgcgttgcaacgggtgaggccgtgagggtgactttaatcttattattgttatacgggtaaattaaggtgaaattcactgtgagaatttgcttggatatatatattttttataaaatcataagctgcaattaggagtccgatcatcccaagttagcatgcgagttttttaaagagatttcttatacgactccttctgtatttccaaaagttaacgaacttaaaaactgactcaaatacggatatgtatttccaaaagcgaacgaagttaaaaaccgactcatacacggatgacgtaccaaagttccagcaaaagcattttcaatttttataatagtagactagaaaaaatgcacacaacgggtaaaagcgttttttctggtataatagctattaggagctaagcaataaattgaaacattaagatcgctaaatacattataatgaaaatctttcatttgttttgggctgaaagcctatagcttattccttcctttttagcccctccgtacctccctcctcagcttgcctctctttagcccaacccataagtgaagctgcaagcccaactagcacaacgtcttcaacctccggaagacgagatgtttacctatttgccactcttacaagttgcaattaaggatatgctactggacccacacgttatagatacatgagggctcacatggtagcaaattcttaattgccacattttaaaaggggttaattggatccatgccattataaaattgtaggtttggaaaaataccattgctatttatgaaattagaaacatgccattactattcaacatgtctttgagacgtaccactgcttgtcccttcaccgtgatttctaaacttttctgatcaaattacccccgtcttgttcctccttttcttcctcccacctatttctctctctcctctcacccctcctctctcttctgaccaaaaattagaaagcagcttcggcagcacagaggagaggagaggagcgtgatggagaagaagacgagagaaaggggaacaagaggatggaggaagaagataagggcaatttggtaaacaaaaattagaaatttcagcaaagtggtaagcaatggtatatttcaaagatctgttaaattgtaactagcatggtgcccgcgcagattacgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagactcgtcttttaatatttcttttttttaattccgaattttctgtaaattgtatttctatatagactctatgctcttcttccaatattatttatttttatttctgaatttttattatttctaattatatttctatgtggactctaaactcatctttcaatattctttaatttttaatttcgaatttcaggtacttctaaattgtattcctatattgactttaaactcttcttcccatgtttttcttaattttgaattttagttatttgtaaattgtatttttatacggactctaaactctacttttaattttattatgtttattccaaattttagttagttttaaattcctatatggactatatactctacttctaatatttcttattttttatttctgaattttttttcttaattgtatttctatatagactctatactctacttctaatattccttatttttaattccgaattttagttatttcctaattgtatttctatatggactctctactctacttctaatattccttatttttaattgttatttcctaattgtatttctatatggactctagtctgctcttctaatattccttattttttaatttcgaatttcaactatttctaaaattctatctagactctagtctcctcttctaatattccttattttttaattccgaatttcagctatttctaaattgtatttctacatgcattctgctttttatttttctctgattaatgtgagaatttcttcaggtatttctaaattgtatttctatatggactctgctttttctttttcttcgattaatgtgagaatttctaggccatgagagcgaacgtggaggctcctttttctattcctttaataatataactagctgggtggcccgcgcaattgcgcggctaacacctatacaaaattatatattttatatgataaggtttgaaagaccaaaccctatcattcccgtgtttctaattttttaattttacaccagttgctacccgttacttctgtcatatccttctttatttgcttgcttgatctatcactgtttctattcattctctttggaaccttttaaaattggatcttatagtttttagagtttatcgtctcgttgggttttgtttttataatttatagaattcccgtcaaacgctaccattatactcctctacggcccgtccactgcctgttatctttattgtcattggtattttaaaaaacaaacataattgtcgtttaggtttaatttttttagtttctagaagttccgtcaaaacgtcagcgactttgtcactgtactccaatacggctcgcccgctgccttccttctttattctcatcgagattttaaaattaaacatgatcatcattggggtttattttttttacttttccgaagcccgaaccttttaaaattggaccttatagtttttataatttattgtctcgttggatttcattttttataatttttagaaatcccatcaaacattgccactatactcctctacgacccgtccgccgtctattctttattgtcattaggattctaaaaatcgaacataatcgtaggaattcttttttttttactttctacggtagctttaccaatgtactcccgtacaacccgcccgctatctcttctttcattggggcttattttttttactttctagaagtcctgcaaaccgccttgaccgggtgcttcactacctgcccgccatcattctatttggtgttttattaatagtttttagatgtcctttataggcctattacttaataaccaaccctactcatttatagctctattacttaattaatcacgtcatgtgtttttgatggtcttttcttccaatagtctttattttcttatcaccaattttagttatttataaattgtattcctagttgaaatcttattttccttttctaatttcagattttattttattttttatttcgaattttaactaataatgtattgtgttcttttaatattttattttttattttcaattttagtcgttttaaaattgtattcctacttaaactatctttttcatttgtccaatttcggattttattttatttttcattccgaatcttaattaatctcgtattgagttcttatatatactcttatttcaatattgcttatatttaattccgaatttcagctaattttaaatagtattcctagttgaactcttcttttcttttattttttaatttcgattttttattttttttattttgaactttaattaatctcgtattgggtttttatatgtactctacttccaatttgcttaattttaattccgaatttcagttatttttaaaatgtattcctactcgaagtcctcttttttcttcttctaatttcgaaatttattttatttttattccgaattttaattaatcacatattgggttcctatatggactcctctttcaatattgcatatttttaattccgaatttcagctattttttattgtttttctatttggactcttcttttcttttttccgattaatgtggaaatttttagcctccacagcgaacgtggtgccatttttttataatttttagaaatcccatcaaacgttaccactatactcctctacgacccgtccgccgtctattctttattgtcattgggattctaaaaatcgaacataactatcgttggaattctttttttttactttctatggtagctttgccaatgtactcccatacaacccgcccgctgcctcttctttttattgtcattgagattttaaaaatcaaatatgattatcattggggcttttttttttttttactttctagaagtcccgcaaaccgccttgaccggttgcttcactacctgcccgccatcattatatttggtgttttattaatagtttttagatggcccattaaccgccaccaccctactcctttataggtctattacttaattaatcacgtcatgtgttttagatggtcttttcttccaatagtctttatttttttatcaccaattttagttatttataaattgtattcctagttgaaatcttatttttccttttctaatttcagattttattttattttttatttcgaattttaactaataatgtattgtgttcttttaatattttatttttaatttttaattttagtcgttttaaaattgtattcctacttgaactctctttttaatttgttcaatttcggattttattttatttt

SEQ ID NO: 976 - DNA, 7661 bp, Oryza sativa
gcgcataaccatgggacgggacagaggagaaaggggaaagagccaaaagagagggggaaggagaagctgaccaccaatggccgcgctgcgtcggcggcggcgcctccatccatcctcaccgccggcaatccccatcgccccgatcctccctccctccgcgctccgctctgtgtctgccgatcctgatctgctccatcctccctccacaaacattgacataactactagtactaggctgcatcagccacatggtaatactaataaacaaggcatatgtggtgattgaatatcaatgggcgactcaataagaaatgtttggattggcacgtattgcaaacacaaagagattcttttttgcttttttttgcaggacattcaacacgactacggagaacacaaatcaactaactctcctaaataaatcaactatactgtagtaccgaatacttctcctctagtactcctcgctcgtccagctcagcggcttggcacttgaagaagtctggaaccgaatgtccctggctggttggtggggccatcaagttctcctattttttttttaaagaaaagccacttggccgccggattggcagcccggcgcgcgtgacgcattgagactttaagccactgacatttaggccccacatgttagtggcccaatttcccggtggtggaggaggagtacagcacagcttatataaccacccccaattcttcttcacgaaatcacaattcacaaagcctcgcatctgcatttcgcaagcagcctcacgcgccagcagcttcaccgtccgcaccctccagtagcctagccctccgcagcgccaagctactcgtcccacaccatgggcgtccaccctttcgccaaggcagccaacggcttcgtcatgcaagccgatgccccggacgccaagctcgccgacgtccaagccgtcgcggacgcaatacacggtaacaccaagctcgccaacatccaggccgtcgcggacgtcatccacgggaacgccaagctcgccgacgtccaggccgtcccggacgccatccacgggaacaccaaggtctttgacatccaggccgtcgcggacgccaagcccgacgtccaggccgtcccgggcgccatccacgggaacaccaaggtcgccgacaactcggtcgtcgcggatgccatccaggggaacaccaagctcaccgacgtccatcccttcatggaaggcgactgctccatcaaactcgccgacgctcaagtgcgcaacaaggccgtcgatggcttcgacgccacgaacatgagccctttggtcgcgcggtgtctcgcgcaccaccttgccaaggtgtccgtgcagagggtgtggcaggggaactacccggagatgttcaagccagtgctggacgcgttcggtcagcctcatcgccgcatctacatcgccttcgacttcgagttcgccgcggacgccttcaccaacatgcactgctggccaggatgtaccaaaaccaactacgaatacttgcgccggtacgtgaacgagttaatgtcgtttagtttggcctcgcatctctaattatccattcaagaatgatgtcgaagaagctgcaattaaccttccttcacaaagatattaatttcgacttacaacaaaaaaaaaaaaaaaaaaaaaacttgtgcagctacgtgaatggaggcgatgtagttcagatgggtctcgcatttgtatttgaggatgaagtcgacgaagaaccgacattcacggcgatggcactggagatcaatttcgacttcaccgtagagctgcgtaagtacaatggcgaggccataagcttcctgtctgaacaaggccatgatctcacggagcacagggacagaggcgtcgtgccacactttgtttatacggggctcttgagccacctcccattcggcaacagctccgtcacctggattgcctaccatggagattacgactttggtttcttcctccgcctgctgcaagggggatgccgtggcagcagccatcttccacttgagctgcccacatttctgcaccaattgcggctcaacttccccagattgtacgacatccgtgttcttgggcagctggtgcagcatggcttccgcgggagcctcaccgcgatcgccgatctccttggggtcaaccgtttcggcagagggcaccacgccggcgtcgacgcactgcttacactgtcatgtttcttccagattgtcagctgtctttcagcctcaggagaccaccagctgcatcggctcgattctcgccagggtttactcgccggaatagcccaggtgaacaaggctatcaaagatgctcgccacattggcgaccgtaccagcaacatcgatgtcatcaaggtgcaagcaggaaacttggacgaagaggcacaacgaattcaagagctggtgccaagcaacttcaacatcatcggagtagaagtaatgcaccctcaattgggcaaccgctcatatgcaatcggcgcccaacaaaattatgaatcgatgaagacctatctgaaggatgccgactcattcgaaattgtcattgcattcgtgaactctgaaggaatgttggcatatgattgtgtgtggaaattctgcatcagctccacaccacgtagtggctgtctgcatccccgacagtttacccggcttatggcgtcttgtggagcaacgagtaatcctaatgtatcctgggtgacattccacggagcacacgggatcgccagcctgatcagctcattctctgcacctcaagaccttccaagcgactggccttcctacgtcgagcaacggagagcatatttccctggtatgtatgatgtcgcattgattgtgcatagataccctgacattggcatacttcccacaacggggtgcaaaggaggcttgtttgatgttgcccgagctctggacctgaacttcatcaaggacgacaatccggtaaccagggttcttcttactctgagatgctacatgagattggcagatcgtggtgatttcccagacaagcagtcagctgtccaagggcagcttatggaaaactgctgctggaactgcccagcaaaacggatggagcatgcatgatcactcagggtggtaccggaatccttgtggtggctgtccatgttgtcagttcagtttagtggtagcttttgttctcgcacgaaattttcctgtttgagactcagacgagtgaacttcctatgttgtaacagtgtaatttttgttgccttttgttctcacacgactcctctttgttttaagactcacatttatagtttgtaatataaaaataagagtgttttccttttgtgaatcggcttgtatatatgcagatgaatgagtagagaagtaggatgtggatggcgggtgcgaacaaaatgcatcaattgtccactacagatgagcgaatgaccaattgcgaatgcagactgttagaggtgaatgttgtttggacttgatggtcctttcctgactacaaatgagaagtgatggtagctgctattagtatgtgttactagccaacaggttgtgatgattgcgtttggtcatgcagtctgaaataaaacgttactagttgttttcttttgcatcagactaaaacaaatccccccaaaattccaggcacctgatgcaaatgtctcagttcaagggggaaaaacaaaagacataaaccttgagagatgttgtatcgttttatcctcctcctaaaatgaaattagcagagctactgccctttctcctcaaagaaaatttgtacgccattagtattagtgacattgtcctatgtgaattagttttgaggttaatactaattgcaagaagtaagtgcagagcaggggaaacagagcacaagaaaagcagaggaggtcgatggggagagagaaacagatatctggtgtgtctgcgcgcgcgcgcccaagctgctgatagtgattgttggccgtggacgctttcaacgggtgagagtgcgacggagttgggcacgtttttgtttttcgggtggcaccacatccacaatcgtggattggaatcctctgccgttatgccgttagcacgtagtaacacggcaagagagctatgttatacgggaacagtgtatcattggatgcgtgatggatggtttagatgaactgctagacttatcttaaaataaatggtgccgtcttataaccacggtgaaaagttactcattccataaaagaaaattaggatgaaatgtgacacattatagtattataaatctgagtctattttgtattactaaaatactatattacatcatattctatgattgtttttaagagataaaaggaagtatatctatcactgttctactcacgtcaacagttaccctctaccttactactcactccgtttcaggttataaaacattttgacattggtcaaagtcaaactattctaagtttaatcaagtttgtagaaaaaaataataacattttcaacccaagacaaacttgttatgaaaatatattcgattattgatttgatgaaactaacttagtattataaatattactatatttgtttataaacttagtcaaacttaaaataatttgattttaaccaaagtcaaaacgtcttgtaacctgaaacggagcaacggagggagtagtagtctaagagcaggtacaatagcaggctattagccaactacaaacatattttaatgagataaaagatgagagagaagatcagcgggctacagatctgtagccagctgcagcacggactccaagacgcaatgtgtgtatgacaggtgggaccatatactaatagtatagtaagcaattattgtatgaattggctataaatgaattggagcttagtaatgggctgtactattaaacttgctctaagaggaaccaggttggtggtggcgtggcgtttaatcgcgcgatgaagaaaaaggagaggatttctaggggggccaccaagccaccaccctgtccgccagaatatcctactcactcagaaaaagggataatattctaggattacgcgaattcgcctactacgttttctagaagccaatccgatgttcattcgcttgacttgacttgacacttggaactgaaaaattggattgaacaccagattaagatatgcccggcttcattatttcactcatgtttatgcgtatctttataagttagaatttaaattttaaaacttaattaaagttaatttacaatatttgctttttatcgctaaggatacatatatataaattttatctaaaaaattaatttttatttgctaataaatggttaatgaagcattacgtaagcgaactaatatgaccggctttcacaaagcgccagtactgcacagtgcacaccagacagttcagtttagcatggccagactcatgtttgaataagtatttgtttggctgcaaggtgcaagctgaccaacgcagggatattaacttcctatcccatttgctaaattgtggcattctttggatgttctgcttgcgggatgcagtttgcatgatacttagggttctatagctgcatgtgtaacgtgttcctcctctaaggcacataattcctgatatgaggtagagaaaaagggttctcggttcataatttaaaacatgggtaaaaatatttaacaataaattgatttccgatgcttctcatttactccatccgttttaaaatatttgacaccattgactttttagcacatgtttgaccgttcgtcttattaaaaaaacttgtgaaatatgtaaaactatatgtgtacatgaaagtatatttaacaatgaatcaaatgatatgaaaagaataaataattacttaaattttttgaataagacgaatggtcaaacacgtcttaaaaagtcaacggtgtgaaatattttgaaacggagggagtatctcataaggctatctcttttcttctaccgtggagagatttggcgccaatgaaggagaggagtgccatggacgttttaaggggcttactgcttgccagtacccgaaggacctgatgctgcgtgattgagttagcaacaacccctttcagccctgcttgggaatagtagtagtcttgctttgctcctggcttgtctaagagctgtgccagcagctatgatgcttcctttggtgaactggagtccccagtctttatgttttcttttactctgtttgtaagaactattatggctttttaatgaaagctgggcattagcctcttttcccaaaaatgttggataaatacataagcaactagctttactgttattttgtattgagaaaaggataacaaattccaacttgtgtttttcgaagcacagaaatcacgccaaggccactcgcgaacaaaatcatggatgtactaaaaatgtaggaaatgggagcgaagggagtggtgtgagtaattacgagagaatagtactattgctttttctttttctccttgtaggcgggaagcgcttggccgccatgctatgctgctacctttcctccttaaatttttgtactgtttctactcttctataatataaaatcagcgtgcttggttcttttaaaaataaattaattaacagctgatccagatgccccaaatattcctgctaccttgtgcaaatatttcggtacgaaaatgagattggcaaacattaggataagtggcatcaccttgtgttaaaaaaggattaatcaccgcaccatgctggattaatttttaggttaatgctaggtgaataacattaagaaggggcagagcaggggaaagcagaggagagtgaaaaacagggtgggcgcggcgtgtattgtgttcggaatttggacgtgtgcaggcttgaaatgttttcgggtgggccccacctgtgtggggttgttggcggcgcagctgaccaaaatatcctcctactaggctgctgaccaatgcgccagattcgctttccagtaaaagctcactcggaacatcaatcctgcatttttttaagaaaaaaaagaagtgtactttaaatcttgaactttttaatcatttattttttttggctaaagttacacaagatttgtgattgtgtgtgagagagaggtcaatagtcacgactgtctgattgaggaatactagtgctgatttctctctttggaacggcgaggaagaagcaggtcacttggaattaaaggttcgtttttgggccacttggcttcaccagattaggagatgctttttggaaagcgcctgaactgcacaacagttcagtttagcacgtacggtcagatcacatgtgattattagtccctccgttccaagatgactgagaatcagtcattttcctcgttgtgtggacagatttagggctgtcaacgagccgagctcgagcgagctcgcctgtccaagctcgagccgagcctgttgcaccttcgggcttttaggcaagctcggttcgagctcgagctcggtgccgagctcagccataagtagtataatatatattttaataataatctcttgataagtataattattttctagttaatcacactaataaaatagtagaaaatgattaaaataaatatattgtgctaacacatgctaatttattgtgtaaatagatactaatatatatatttatctattagtttattatattaataaggtgaacatgcaatat

SEQ ID NO: 977 - DNA, 12891 bp, Oryza sativa
  unsure (1)..(12891): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtcagtatctcctgtaagcaacatcttccggcttcaagattcagaaaggttatctctgtattcctttaggttaaagaattcagaaatgtagtaggtcgcccacgcgtgggcgactcggggggaaacctagcaccgccgctgccactctctcctcctctccctcccctcgcagctaccggagaaccgagcggccagctgggacggcggcggcaaggccaaacgtcgacggcgctatgtgcatggaaggcgggccggcgcgcggagcagaggttgaagacacggcgtggaggcggcagattcagcgccgccgcggctggatccggcctccccatgggtggatctggatctggccggagcaagccgctctcgggcagcgacgacgggaggcgaaggcggcggcgtctggtggctggcggcagctggtgaaggaggctagcgcgtgcgaagctgcgaccggcggcggtggagactggcacgcgcggaggacgcaatggccgccggcggcggaggcagtagaggcgtggctggcgacggcaaaaaccggcgtgtgcaaaggcgcggccggtggcagcggaggccggcgctcgtggaggccacggtggcagccgcagctgaagctggcgcgcgtggccggcaacaggagatgactaaacggcgcgatggagcggctgagggcggtgtaaagcctgtcggcggtggcgacgctcccggtggttggcagtggacggtgaggaggacggaggctgccgcagtgagagaatggaggcgacgacgatgcgaccaggcacccgttggaacacgagcgccctggtcgaggcggcgacgacggtcatgttgtgaggggggtgttgaagcctacggccttttgcggggaagaggggatccattcttttctcaccctctccctctccaacccaatcacgtgggtagcggaagctggtgcgcgtggccggcgacaggagacgactgaacggcgcgatggagcggctgagggcggtgtaaagcccgtcggcggtggcgacgctcccggtggtcggcagtggacggtgaggaggacggaggctgtcgcagtgagagaacggaggcgacgacgatgcgactaggcacccgttggaacacgcgcgccccggtcgaggcggcgacgacggtcatgttgtgaggggggtgttgaagcctacggccttttgtgggggaagaggggatccattcttctctcaccctctccctctccaacccaatcacgtgggtggacttgaagcacgacaagggttgagactcttctttgatggccggccggcggcgaggcgtcgacgtggtggttgcgcatcgaaggggattagatggtggttttgctgaactggcatgcactctttagcgcgggagagtagaacaatgggtgagccggcaatggcaacgcctgcgggcgtcgttttccccttggggcattgttgtgttttctatcgtttcccaatgggttcttcaggtgaaaacaacgtcctggttctcaaggacaggcggcggtggcgcttttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccctataatatgtgccaaaatgttacgagcccttccgttctcttctactctaatctatctatggctatatttagttccacaccaaaattggaagtttgaagaaattagaacaatgtgacgaaaaagttaaaagtttgtgtggctaagaaaattcgatacgaagaaaaagttaaaagtttgaagaaaaaaaaaagttatgaatctaatcgggcatagcctatgcctgaggctctatctcccttgtggccttatctgaatcatttttcattgttcacctcttgttcggatacttgtcccctatcttttcccccttccctggcgtaaaagaaaaaaaatatctcccgtctccactccactccttgcgccatctcgcggctgaacaggggagtggaggggagggccgcctatctccatctggcgagcagagcaagagcaagggaggggatcctggtgtggtgagcatccacatcctcttcctgattcatctctctctctcccaccgggactacttttgcctggaatttgctttgctttcgttaagctcctctcttaatttccgatacttaaccttaatacaagtagtaacagtttgtttgttcgtctcaagttggattctcgctgatgtttcttgaaattctctcagtttcttggtgcttcttgggaatttttcaggtgttgttgttgtcgttgttgctcgccggatgttggaggtctgctgctgctccggcgtcctcggcgggtcgccgccgtcgtcgaggactgcgggggtttcctcacctggactatcgccgtctcggcccagtaagcggcgaatcggccgcgcccgggtgcagccgcgcgcgccgccgccgtgcgacgagcggagggcggcggaggacgtcatccacgcgctcaggtcggcggatggccccgccgaggcgcttgagcggttcaggtcggcggcgcggaagcccagggtggcccacacgaccgcgtcgtgcaactacatgctcgagctcatgcgcggccatggccgggtcggggacatggccgaggtgttcgacgtaatgcagaggcagatcgtcaaggcgaacgtgggcacgttcgcggcgatcttcggagggcttggtgtggaggggggactccggagcgcgccggtggcgctgccggtcatgaaggaggccgggattgtcttgaacgcgtacacgtataatggcctggtttatttccttgtgaagtccgggtttgatagggaggcgttggaggtttatagggtgatgatggtggatggtgttgtgcctagtgtgagaacctactctgtgctgatggtggcgttcgggaagaggagggatgtcgagacggttctttggttgttgcgtgaaatggaggctcatggcgtgaagccgaatgtgtatagctacaccatctgtattcgagttcttggacaagccaaaagattcgatgaagcttatcggatacttgcgaaaatggagaatgaagggtgtaagccggatgtcattacccataccgtgcttatacaggttctttgcgatgctggccgtatcagtgatgccaaggatgttttttggaagatgaagaagagtgatcaaaaacctgatcgagtgacctacattactctgttagataagtttggtgacaatggtgactcgcaatcagtgatggaaatctggaatgcaatgaaagctgatgggtacaatgacaatgttgttgcttatacagcagttattgatgcattgtgccaagttgggagggtctttgaagctttggaaatgtttgatgagatgaaacaaaagggtatagtgcctgagcagtattcatacaactcgctgatatcggggtttcttaaagctgatagatttggtgatgccttagagctgtttaaacatatggatattcatggacctaaaccaaatggttacacacatgttcttttcataaattactatggaaaatctggtgaatctataaaggcaatacagagatatgaactaatgaagagcaaagggattgtgccagatgttgttgctggtaatgctgttttgtttggtcttgccaaatctggtagacttggcatggcaaaaagggtatttcatgaattaaaagctatgggggtttctccggatactatcacctacactatgatgatcaagtgttgcagcaaggcatcaaaatttgatgaagctgtgaagattttctatgatatgattgaaaataattgtgttcctgatgttcttgccgtgaattctttgattgatacactctacaaggcaggcaggggtgatgaagcctggcggatcttttatcaactaaaagaaatgaatctagagccaacagatgggacttacaatacacttttggcaggattgggaagggaaggtaaagtcaaggaggtaatgcatctgcttgaagaaatgtaccacagtaattatcctcctaatttgataacatacaatacgattcttgactgtctctgcaagaacggggcagttaatgatgcacttgatatgctatacagtatgactacgaaaggatgcatacctgatctttcgtcttacaacactgttatatatggccttgttaaagaagaaagatataatgaggcattcagtattttttgtcagatgaagaaggttcttattccagattatgcaacactgtgtactatcctcccaagttttgtgaaaattggactgatgaaggaagctctgcatattatcaaggactacttcctccaacctggctccaaaacagataggtcttcatgccattcactaatggaagggatactgaagaaggctggcatcgaaaagtcaattgagtttgctgaaatcatagcatcaagtggtattaccttggatgatttctttttgtgcccattaattaagcatctctgtaagcagaagaaagctcttgaagcacatgaacttgtcaaaaagttcaagagctttggagtttcactaaaaactggattatataattctttgatttgtgggcttgttgatgaaaacctaatagatattgctgaaggcttgtttgctgaaatgaaggaactcggttgtggtccagatgagtttacttacaacttacttcttgatgccatgggaaagtcaatgcggatagaggaaatgctaaaagttcaagaagagatgcatcgcaagggatatgaatcaacttatgttacttataacacaatcatttcaggtcttgtaaagtcaagaaggttggagcaggctattgatttgtactacaacctgatgagccaaggtttctcacccacaccatgcacatatggccctcttcttgatggtctgttaaaagctggaaggatagaagatgcagaaaatcttttcaatgagatgctggagtatggatgcaaggccaattgcactatctacaatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagaaatgggtcttgaacctgatctaattacttacaatttgctcattgatggtcttggaaaatcaaaaagattagaggaagcagtgtctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacatataacgctcttattagggggtacagtgtttccggcagtactgatagtgcctatgctgcctatggtcggatgattgttggcgggtgcctacccaattcaagcacgtacatgcagctcccaaatcagctgtgactaactagttagtgactgaatgtacttcttctgtatagttttgtctataaaaggaaaaggatcaactgtagatagtccacttcaatatatctgagggttctgctggttcttgttctacactatatttttgtacttgatggaagaaaattattcaatacacagctgacttgatcacttgaatcatctgttcaatttaactgacattgtgaggttacagttgttaaactcttatcaagtccatccattatatgtggttcaagtacaactgatctgtgtgcacattacccattttctttctactggtatgtctcttcagccaaatgcttgtgacatagttcagttttactgcctgtataggtttactgatgtgtgcgcatctttaggaagttgagctagtggttcagtttcacagtgttacgctgcttagcaacaatcaactttttccctgattcacctttttctcatatgatatagcactgccaatggactgcttgagaaggttctctattgttgcaatacatggaaatgcagttagatgcttcctttccaaaagtttctttgttcacatgatagtgaattggtagcattttgcatactttgggtcaaaagatgtgctcatttcttgtagaccataattacaacactggaatggccaatttccttcatgaaaattttcaatgagcagccaatgcaaattcaaatttactatttcctttagtttggttgtgtctaatctgtaagtttatggtgatttttactagaaaaggtatcgctaagtttctgaaattattttcatttctcttcagtctagaactctagattaatttgttgatcttgcttatatgccaatttgtttgactatattttcctgttgtatctatgatatgctctctctttgttttggggtttatcatggtatatttctatattttatggtgttgagctgttgatcatgagaaagtaaacttgcatgttaaactgaagtaattgacagtttgacattcgtaataccttgatataccctgatcaaatgtatttttgttccaaactcaagctactactagggaacattcatcttgatctatttattcaaagctttcttgtggtgctcagttttgttttctggttttagattgtaattttgtctggtaacaagctcttcttttgatatttttccccttgaaattcaaagaaaggtgtattttgcttgcctacctaaagagaagtttgcagttctagttgaacagttgtgcatctgtgaagtttgttatggatgtcccctttaggatgcgtttggagtttggtattgaactgaagaagctattaattttagtgacctaacttcttgagtgtttttcattcgtttggtgtggtatatccatatgcagaagttgtggatgatgcgtattgcttctttttaaccagcactcttctcttgtcatgatgaaggacaccacagattcaataaagccatacatattctgttctccaggtatgttgtagcatctccttccttcaatatgctaaaacaatttgagcttgtagatccatggaccgagaaaaaaaacagatgcaaaagaatgaagcatagtttactcctctgcatgctattgccaattgtgcctacaaaatgatgttgtatacttcgattcaaggaaaatttactcctctcatggttgcttcttgcttgttttctcatgactcatgcattgggcgtcaatgatgccctgctttgtttgcagttggagatcacctagacacctgccactaaacagtttggtctgcttgttgctgtgatgcggttatgcccttttttcctgaggtatttttagaagaaaatttctacatgtttcatattgcattatcagggactcttcaaactgttcgtccccggaagctgtcggcacagtgaggaagcagatcaccagccatcgtagctatcacaatgccaaagagccaacaacaaaggtcagggtcttgatctcttgtatgcccagtaacaggttaatcctcctggctctctgtactgaaacaatttctctggatctctttcccttttgttttggaccttatacaacctgctgatggttaataatgatgttcttgaataatagatcatgttaagctgtttgcatggtctgctgctgtcaaatagttttatgcggtcacaactcttactaactgatcaggttgacttcaagcattgggctaaaaactaagattatgtaacttaaataacatatatgccatcatcttcaatttaagtgatattgtgtcaatcttctgatcaactgtttacatcttcgggttatgtagattcatgtcatcttcttttactctgaaatgctatatgagattggcagaatgtcctgatttcccaggcatggcgatggctgtccaagggctgcttaaggagagctgctgctggaaatgcccagcaaattgctgatggatggaggatgcataatcactcagtgtggtgaccatctgatttagcatggcgtatttcgcaaaaggtttgaaattcaaaacagtgtctcatcggatacgccatagtgattttcagtttctcttattggcgtacctctgcttgtggaaccctcctggatctgaatattgcattcccactgttccatctggcttctccttcaggccggcaaagcattgcaaaacagacctaacaaagattacttccccctatttgtcgtaagaaactttggatgttatgtagaacagaccttggtatatgcagttcttgaccataagttcactatctgtcttctgcttgtaataattgatccacctagaattacaaagtggtcttattatttcatctctgaaatcctcactacgaaagaaactggagaagactattgcaactgtcatcacagcgacctcagttttgcttcgacagcttcttgtcgcagtcctaacacttgtatatatgtacataccctaatcttaatcttgctccgttttaaatcttgtgctatcagtaatcaagtccagtttgagctatgaactgatctgtaattagatattacaatcaatacacgaggagaagaactgggcaaacaacgtgatgctggtataacttcatcaaatgttatattagaactcatatcacgtcacataagtgtacacagaaaactcaagtcacattctgatttttttttttctcggatcatgctagcagatgagatgaggaataaataagattggaaatatgttatgtaccagcgagaattcttcacattctgttttagtttgctccctcccaactgttagtttttcacttacagattcaagaaaattcaagctgaacgcttagattttagtatgatacatttcttttataaagggtaggaccccctgtcgttattgaaaccaaatgttggggatgcagaaatttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagcaccatggtctgcggcaacgtcagcaccgtcgtccccatgttgcagcacaccagcatggccagggagcagaagttggtgctcgacgccgacgccgacgacgacgggttgcaccacaccggcgcaggcgggaagcagcagaagttggtgctcgacgccgccgccgacgggttgcacctcaccggcgtgggcgggaagcagcacaacttggtgctcgacgccggcgcgggcgggaagcagcagaaattggtgctcgacgccgccgacgacgggttgcacctcgccggcgtgggcgggaagcagcacaacttggtgctcgacgctggcacgggcaggaagcagcagaagttggtgctcgacgccgacgacgacgggttgcacctcgccggcgtgggcggaaagcagcacaacttggtgctcgacgccgccgacgacgggttgcacctccccggcgtgggcgggaagcagcacaacttggtggtcgacgctggcgcgggcgggaagcagcagaaattggtgctcgacgacgccgacgatgggttgcacctcgccggcgtgggcgggaagcagcacaacttggtggtcgacgccggcgcgggcgggaagcagcagaagttggtgctcgacgccaccgacgacaggttgcacctcgccggcgtgggcgagaagcagcacaacttggtgcttgacgccgccaccgacggattgcacctcgccggcgtgggcgggaagcagcacaacttggtgctcgacgccggcacgggcaggaagcagcagaagttggcgctcgacgccgacgacgatgggttgcaccacaccggcgcaggcgggaagcagcagaagttggtgctcgacgccgccgacgacgggttgcacctcgccggcgtgggcgggaagcagcacaacttggtgctcgatgccgccgacgacgggttgcacctcaccggcgtgggcgggaagcagcacaacttggtgctcgacgccggcgcggacgggaagcagcagaaattggtgctcgacgccgccgacgacgggttgcacttcgccggcgtgggcgggaagcagcacaacttggtggtcgacgccggcgcgggcgggaagcagccgaagttggtgctcgacgccaccgacgacgggttgcacctcgccggcgtgggcgagaagcagcacaacttggtgcttgacgccgccaccgacggattgctcctcgccggcgcgggcgggaagcagcacaacttggtgctcgacgccggcccgggcaggaaagcagcaaaagttggtgctcgacgccgacgacgatgggttgcaccacaccggcgtaagcgggaagcagcagaagtttgtgctcgacgccgccgaccacnggttgcacctcggcggcgtgggcgggaagc

SEQ ID NO: 978 - DNA, 2427 bp, Oryza sativa
aagcagccgaagttggtgctcgacgccaccgacgacgggttgcacctcgccggcgtgggcgagaagcagcacaacttggtgctggacgccgccaccgacggattgctcctcgccggcgcgggcgggaagcagcacacttggtgctcgacgccggcccgggcaggaagcagcagaagttggtgctcgacgccgacgacgatgggttgcaccacaccggcgtaggcgggaagcagcagaagtggtgctcgacgccgccgacgacgggttgcacctcgccggcgtgggcgggaagcagcacaacttggtggtcgacgccggcgcgggcgggaagcagcagaagttggtgctcgacgccgccgacgacgggttgcacctcgccggcgtgggcgggaagaagcacaacttggtgcttgacgccgcccccgacggattgcacctcgccggcgtgggcgggaagcagcacaacttggtgctcgacgccggcacgggcaggaagcagcagaagttggtgctcgaggacgacgggttgcaccacaccggcgcaggcaggaagcagcagaagttggtgctcgacgccgccaacgacgggttgcacctcgccggcgtgggcgggaagcagcacaacttggtgctcgacgccgccgacgacgggttgcacctcgccggtgtaggcgggaagcagcacaacttggtggtcgacgccggcgcgggcgcgaagcagcagaagttggtgctcgacgccgccgacgacgggttgcacctcgccggcgtgggcgggaagcagcacaacttggtgctcgacgccggcgcaggcgggaagcagcagaagttggtgctcgacgccgccgacgacgggttgcacctcgccggtgtgggctggaagcatcacaacttggtgctcgacgccggcgcgggcgggaagcacagaagttggtgctcgacaccgccgtcgacgtgtcgcagcacaccgtcgggggcgcggagcagaacttgctgctcgacagcactgatgacgggttgcaccacaccggcgcaggcggggagcagaacttggtgatcgatgacgacatcgacgggtcgaaccacaccgtcgggggcgcggagcaagacgatgggttgcacaccaccggcgctggctgggagcagaacttggtgctctgcaccgacgtcgacgggttgctccacaccggcgcgggcggggagcagaacatggtctgcgacaacgttggcaccatcgtctccgggttgcacgacactatcgcgcgttgggagaggaacttggtgttcgacgacgtcggtacagccgttccctggttgcgccacaccggcgttgatgggaagcagaacttggtgtaccacctcgccacggccaccgtgcagagcgtgtggcgggagaattgcatggagcagttcaagctcgtgctggaagcgcttcatcaacctcatcgccacctctatatcgccgtcgacatggagttcgcagcggacgccgccaccaacgtgagccataggccagtaacctccatcagctgctaccaacacatgcgcaggtacgtgaacggaggtggcatttttcagatgggcctcacatttgcattcgtcggtgaaggcgaacaagctccctcgccgctgatagcactggagatcaacttcgacttcaacgtcaattcgccaaagtaccatggcaagtcgatagatttcctatccagtcaaggccatgatctcacgcagcacagcaaaagaggcgtcgcgccggagtttgtttacgaggggctcctgcgccacctcccgttcggcgacggctccgtcacctgggtcgcctttcacggcgactatgacttggctttcctcctccgcttgctgcaagggggagaccatggcggcaattgcctcctgccgcctaagcttgccaccttcctgcaaaaagtgcgggagaagttcccagtcgtctacgacgtgcgcgtccttgggaagctggtgaaggatggcttcaatgggagcctcaccgcactagctgaataccttggaattccgcgtaacggcgacgaacaccacgccggctccgacgcgctgcttacattgtcctgtttcttcaagatcgtcagcctttcaggtcaccagatgcaccgcatggatgctcggcggggattgcttgctgggttggaggagtggaacatggctatcaaatgtgcacgccatattgacaaccatactggaagcatctacgttgtcaagatgctaccacataagttggatgaagaggcaagacgaattgaagagctggtggccagcaacttcaacatcgttggagtagaggtaatccatgctcaattgggtaagcgctcctacgcagttgaagcccaaaaaaattatgaactcatcaagacatttcttaaggattctgacttgtacgaaatcatcgtcaca

SEQ ID NO: 979 - DNA, 434 bp, Oryza sativa
gatctggatcttgtttgctcctcaagacctcaaccctgtgttgcacataacacttgctgctggtagaacagcaagaacagaagcatatccaccttgcggaaagaaatcagaggacagaggaggagactggagaagctgacctggaacccttggcggcggcggcggcggcgcccgccatgatgccctcgccgccggcgtcctccaccgtctcgggttgggcggcgctctctcctcccacccccacgtcgccccgatctgtcacgaaccaacacaatcacaccaaatctctcacacacagtgccaccaatatattgcaaatccactcaagaatacaagtgcccagggatacaatcaagagagtagaatcagggattgggaagagcaacatagagaaggcagaagcatgagactaggattagagaaatagaaattag

SEQ ID NO: 980 - DNA, 727 bp, Oryza sativa
gcagccctatgagtgatatcagtgatcatcagagtgtaagatcccctcatccagccacaatatccgtttcctacattattgagcattgtgccgcactgtaacaattcatctagagagtatttggcacacatgacggaccaattgactacctcaacatgtagcaatttgcgtggttagacttggtcaaaaccaacggggcatgggtacagaaaaaaggatattaccaatggtcccgatcagaccccttaacttagctgtctatagctagctagtctctttccaagactttcttcttcttttttcttttttttttgaggggctttccaagactttctgcattgcctagagtatgtactttctcttgttctttaatttgctcttcttttcaaaatatgatggagaacactagcacatagtttagtccgccagtgcttgactactccacaaatgtcttcaaatggtgccaccatctgctagtccaaattccctgtggaccttggtatttccgtcttagtgaatttgacgcttttgatgttcttgctcaatcgtactacgtacatattccatgccctgcttatcctacccggccggagtggaattatctactggaaatcactagaggtacaaatgttggggttgtttcttaatcatggatagacgatgactcgatccacttgactacaaggattttaaatcctgctgctcacaatttcgtacacataagtgt

SEQ ID NO: 981 - DNA, 432 bp, Oryza sativa
cgacgatgggttgcaccacaccggcgcaggcgggaagcagcagaagttggtgctcaacgccgccgacgacgggttgcacctcgccggcgtgggcgggaagcagcacaacttggtgctcgatgccgccgacgacgggtttcacctcgccggcgtgggatgccgccgacgacgggttgcacctcgccggcgtgggcgggaagcagcacaacttggtgctcgacgccggcgcgggtgcgaggcagcagaagttggtgctcgacgccgccgacgacgggttgcacctcgccggcgtgggcgggaagcagcacaacttggtgcttgacgccgcccccgacggattgcacctcgccggcgtgggcgggaagcagcacaacttggtgcccgacgccggcacgggcaggaagcagcagaagttggtgctcgacgccgagg

SEQ ID NO: 982 - DNA, 253 bp, Oryza sativa
  unsure (1)..(253): unsure at all n locations
acatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaagcgaacgnnnnnnnnnnnnnnnnnnnnnnnnnnnnnnnnnnnnnnnnnnnn

SEQ ID NO: 983 - DNA, 605 bp, Oryza sativa
acatctgtctgaaacagcggtcataacatcacagagacagagattcgtagcagtgcaaaagttttagcgccaagtgcaacgaagcagaggagagcgaagcgccgaagcgtgtgcgtaggatgaattgcgtggttttgaacggggaaaatcacagatacgctttcgcgtgggcccacctatagcctgacttctcatcagtcgctttttactagaaaggggtcatggtagtaggatattctggcggacaggtaatcctctcctttttcttctttctcgcgacggtttacgtacgtgggcgtggccgcgtgggcgctcgtgttcgcagtcgcgtcgcgccgccaccaaaccccagggactgtggtggaggcgtggagccacctggagaacgttggccaagaccgcctcactcagtcactctcacccgttcagagcgtcgaagggagactgtttctcgctccccatctactatacctcctctgctttcttctgctctggctcccctgctttgcaggagtagtagtcttagtgttctccttgcattaggattaaacccggaatttaattcctcttgctaaacctttttttttacattgagaaaatgtcac

SEQ ID NO: 984 - DNA, 932 bp, Oryza sativa
cgatatcgaggcgggcatccagccccccacgcacatcttcttgggttggaggcgttgacgagggaatggcggacgaacggcgggtaacggccgccgctcgccgcgccctccgccttgacgacatggagccggcggcggcagcgccagaggcctcggtggcggaggaccgcccgctggcgcctaggcgctgctgcgccgtcatgaccaagtcggccacgtcatccagccaacgtcgggctggagtctctggatcggggacgacgggcgggtgacgcaggagcgcgcccgtagcctggagcgcgccctggggcgtgccgccatcgccgtagacgaggcggcgacgcgccccgtctcgccgtcctcccccgtcgcccgcgggcggcgaattcgcggatccttcgacctccccgagcgcctccccccgcccaagatttcggcgagagggggacggtggggtgcgagcccgacggcgcgggttctgctccccgtcgtcgccgctagcgttcggagagaggctgtgcgccactgcccgttcggccattgggctgagcgggagaagcttggcgcacacgaaagaggacgagggcttagaaagacacgcgcgcccctcacctggcgcgccagatgacggagcgtggggctcctcaccgggagaccgcgcaggcccccctttgccgattcggccggggacgctaagtgaggttcttcgccctcgatctaagaaacgtcagcgagagaggaagtgcacaagacacgggcgacgtagacaggttcgggccgctgagaagcgtaacaccctactcctgtgttctggtggatctgtgcgtgaatgaatacagagagccggagagcgagagagagttcaggctctagaaccccttcgccagagtcccaacccccttcccttcttcttcttttctctctctttttag

SEQ ID NO: 985 - DNA, 3716 bp, Oryza sativa
  unsure (1)..(3716): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggacatcggacggcagctatcaacttatcaagccacttgccattgccccgaggggccgaggggctcccacgcgggacgggacgaccacgcccgtccgaccgtctgtttcgtccccgcagtaggaagaacggagacgggctcgtagccgtccgcttcccaaccgtcgcagtcgcagtcgcagcatccacgccacgccacgccacgccacgcgtttgtgtgtttcactcgaaggctcgctccactcgaagaccgaggcgtccaccaccaccaccaccactcgagttcccccacgatccccaacccttcctcctccgattcgccgccggtagctgccagcgtctgctccccggctcgccgcgcgccggccggcgagtgcaccgcgcgcgggcgcttggtcgacgctatctccggagtactccgcgtggatttgggtgaatagtggctcgtttcgacagggtgacttgtgctgtgctcgatcgcggtcgtcgcttgctgttgatcgaccggtccagatccgcgtcgtttacacggtgcgtggctgttcctcaatctacgggtgagtgttttctgaacgaatcgatcctacctgttcgggattgcttgtagaagagacaaaaagagagtgatgttgtttcacgcaaccgagaattaattaattaaatcgtctggcatggtagattttgctgcgtgcgtagaaaagagatttcctaaatttggggatactagtggacgatcgatcgagcgcctattctgtcgatcggttcgtggattcatggcttgagctcatgagttggttggtacgttcccgcgttttgtagatcggacctcggactcatggagaaccgcgtcggtgagtcgtcggcgaccgccgtcgatggcggcggcggcgccaaggactcgggcagcttcgagtgcaacatctgcctggagctagcccaggaccccgtcgtcaccctctgcggccacctcttctgctggccgtgcctctacgagtggctccacgtccacgcgcactcccgcgagtgccccgtctgcaaggccggcctcgaggaggagaagctcgtccccctctacggccgcggcaaggcctccaccgatccccgctccaggtcggtggccggcgtccagatccccagccggccggccgggcagcggccggcgacggcttcccagcctgatcatcaccacgaccatttgccgcaccacgacccgtggttcatgggcggcgccggcgcccctgtggccggcggtcgctgggggaactacactttctcggcggccattggggggcttttcccattgctgagcttccaggttcatgggttcccgcaggcggcggcgtatggacctgccgctgggtttccttacgggtatggacattcgttccatggctggcatggccatggtttcccgcaccaggcaccgcagggccagcatgttgatgtgttcttgaaggtattgcttgttctggttggtgttcttgtgattgccagcttgattgtgttttagatgtgtgcagttagctatggccaatcctcggtgatgagcctgtatgaaacggttttattgtgtcaatattaggtagtagctcccacgggttgatcagtgtggagagatagtacaaagatgatgcttcagtagttactagtaggattctgtgataatgagtggtagctgataatgttgtcgtgcttctcgatatattacttgtgcagttgcaagtcttgtttgtagtttttaagtgaagtttgaatccttgttatcttttcataatgcatttgcattccaaccttgtcctgtggctgtcgcaaggataatatcttgcattatttgtgtcatatatggattcttgattgtgcatatacatcaatacatcattggttgtatctgaaatcagcacttggaatttgtttctgaatttaaaatattgtaccggacattttctactttctgttctctttatgtgcacatggccttattttatcccatacaagtactatatgaacttgaagtaatttcttgaagtaatatctgaatacttacttcttactgtttcagcatagtttgtttaatccgagtcaccaaataaccataatatctaccttgctttgcatttggtgatctgagataaaccaagatggtaataaaactttatgtaccttaatggcgatgtatgtaacttgtaatattcttccccgatcagaaaacgaacttgcagtactattcaataatgcaaaaaaaaatcaactaagattatcttttttttaccttgttttttagctggtgatccattgagtgcagaatctgtgcagtataatttagacatttgtagttccataaaacagtagcaatttgacctgtacttttttttgctagcctgtactcgctctgtaaaaaaaaaagagcaacttctagggatgagttcagattcatccctaaaagttggctattttctcgggcatatcaaaggtccaacagtaatatcaattttgcatttatacactcagtttcatttgatggaaaatttgtttgaaacatgagtactatagatgatgttggaacatacttattctgtttcataaaaaaaataaattctagatatgaatccagacatcaccaaatactttgattttttttattggagagagggagtaaatatctcgagactcctaaggatgctttcagatattttggtcggctgttggcatactgaatagtagatccatgtagccatcaccaaaataatttgtacatggagctccataatccataggcctctcagctctgagtttgatgtttatccaaccgtgtttctttttctcgggattatccaactaattcggattaatggactagtagtaatcttactaagcttgattgttgcagtgagatctggcgttgaatcagccactcagcaagctgaactcaagtctagttcatggtctctctcaaaaaaaaaaaaacctgttcatatggtccgtttcttttgggccggaaagttactgtgacttacctgtgggctgtggcaatataaatactgggactggacttatgagttagttcagtggcaatatctcgggaaagtgatttcaccgctcaggggatattcctcgtgtcgagcatgccacctaaatagtcataaaaaatataaaaaattttggcaacatagattaatatgaaatatatcacccttttttaagggaaacactgtaggggaagcctccacagttaataaattaaattaaaagaaggaatacaaaatatttacaaaaggtttatccactgagataaggcttgtctctcaaaaacttttaatctaaagactaaaagggaaagatcaatcttaaagagagctttccaggaaacaaccgaaggtggtacattctgaaaaatgaaagcatttcgttgcttccaaatgttccatgcagcatagagaattttttcaacaaaatgagtggatctatatgagatctttgcctgcagcagcatatcatcaaaattgagagaaaggttccagacaattcccagttgcgcccaacaatctgagctgaattgacattgaaagaaaaggtggaaagatgtttcccttgcttgagctggacaaaggacacatgcta

SEQ ID NO: 986 - DNA, 7720 bp, Oryza sativa
atagaacatttgcttttccaaatccaacttaagtacccaggggcttgaacatgcatgaaatttattgcataaattttctgtgaagagaacagtccattcccccagacataagcccaaacatctttatcaccagataataagttaaggggtctgcttcactcatggattcatattcctggaaagcttgttcagataaaggcagagcaaaaagctgtgctatgcttttagtagaagttatgcttacagagtccttgtgagagagggcaaaagagtgaattctagggtaaacagctgacctgactttaccattccaaaaatcactccagaacaaacaagttttcccatcacccactttacaacttgacagacttatgaaaatatctagaaattgcaacacatccttccaccaaaaggaacctcttgggcgaatagcatgtggtaatttatcagagtaataagaggtccaaatcaaattaacccaaggaataggatgcctgttgtaaaatttatgcaaatttatgaaatatatcacttcataaatatgcaagtttaaattcaacttctacaagttgtaacaaaaataacaaatatagttacaaataactattttcaatttaatttgttatttttgttgcaatttatagaagttgaatttggtcttgcatgcttgtggagtaatatattctgtattaatctatgttgtcatttttttcaatttttttataactatttagatgatatgcaaactatgagaggatgtcccattgagagatgaaaatccacgtcccaatatcttcagttttttgttctcaactgtgcatatcgaaatgggatctgtttttacgccggtggggatttgaacagccctcgacaattcggcctttcttctccagtgtccagattacctggatcatcttcagaacctttgctagtgtaagcggactttatttgcattgccccagatatccacggaggcctagctgcctactcttttttcacatacgcgcaaaaaaatcacgtcatattagaagaaaaagaattttagttacacaacacaatcagccagaccggcttatgttaggggaagggagaaaaagcaaatgaaaaataaactgaagcttagagaaactacggtggctaaaaacagacttcaagcagcgggaaggagccaagccacgctacactcctaacaaatcctcaaaaacggcgacgccagttaaagaccacatatggcattccgaatggatggactccagaaccacaaaaactgaggagagaacggagtcgaaaaccctagagtttcgctcatacagttgccaagagaccaggagcaccaaggagtcgaagctgtcacggaggtgctcaggtaagcaggccctggaggacggccaccagtcctggaaccagctgccacgggggagagagggcagcccagctaggaggcgacaacactcaaagccagatttgccgagcgaacacgtggtcgaggaggatgtggttcgccgtctcgagatcctgggcgcaaaaggggaaggccgagtgactatcgatgccacgtttctggaggagatcagccgtccaggagcactgttggaatgcaaatcaaaggaagaacttgcatttggcaggattctttgcgtgctagagaagatcagcacaagtaaaggaatgctggccatagaagaatgcctggtacgcctaacgcgctgagtagcgctggtcagccgtctagcgccaaacgagacgaacacccggtgagagctgtacgtgaagcaccgtatcccaaataaagagaaactagaaaatgacaggacaacgaggacaccgtggatattaaagacccataagttgttcgtcaggcggcctagctgcctagtcaactcagattcagcattcaggagaagatttctgggggttgataaacttctcggaggcacaccaggtcaccagcacgtgtgcaagctagagctactgagctaactaaatacgcctctgcagagtgtcgtagtatgccacaccggcacggttgtacatcggctggccgcaacagcgttgcacggggaaatggattagacgggcttatgtcggaactcaggaggagctctatccactggaagtcaggggtggatctacagtataaacatcggtgtcaggcgacaccgacgactttcggtaaaacctaaaataaaactggttatccatatactataacattatgttctaagtataattagcatactatgatatcgatatacacgttatgatactaacaaacagattttctggatccgccctgtaagtccacggccacctactccatcgtccacgttgcgcgaccctaaacgctctccccccccccacacctcagctagcatgctgatcgatccgccgtgcaaccgcatccacagtgcacgcacgcagctacaaagatgtcgtacgaccacgaccggtggcttgtctgctctacgttacactgtgcgtggcttgtctctgctctatatgtgtaccgcgtcgtcgtgtgcacacacacacacacacaaccgtactgagggtggcgcgcgcacggggctgaggagcgaaatggcgccgccggcggggacggaagcggctggcgctggccaccgcaagaactggcggggcgagtccgggaacctgtggcgcatcgccgggccggtgattctgacggagatcttccagttcctcatcgggttcgtcaccgcggccttcgtcggccacatcggcaaggtcgagctcgccgccgtctccgtcgtcaacggcgtcgtcgagggcctcgccttcggcctcctggtaaaaaatcacgccaggacggtcagtattgatgtgatcgatcatcgctaggcattttgttcatggcgcctgtcgcgctcgttttgatcagcttggcatggggagcgcgctggagacgctgtgcgggcaggcggtgggggccgggcagccgcggatgctgggcgtctacctgcagcggtcgtgggtcatctgcctcgccacgtcgctcgcgctgctcccgctctacctcctcgcgtccccggccctgcgcctgctccggcagtcggcggccatctcgtcggtggccggccggtacgcgcggtggtgcgcgccgcagctgttcgcgtacgccgtcaacttccccatgcagaagttctaccaggcgcagagccgggtgtgggccgtgacggccatctccgccgccgcgctcgccgcgcacgcgctgctcaactggctcgtcgtcgccaggctcggccacggcgtcgtcggcgcggcgctcgtcggcgacgtgtcctggtggctgctcaacgcggcgcagttcgcgtacctcgtcggcgggtcgttcccggaggcctggagcggcttctcgcggaaagcattcaccagcctcggcggcttcgtcaagctctccctctcatccgccgttatgctgtggttcgtagcattgtacatgcagttcaagttccatttcacggtgaaaattagcaaaatatttttttcatggatgaattggtgcctgcagcttggagatgtggtattacacagcagtgctgattctggtgggttgcctgaagaacccagagattcaagttggtgcgatttcaatatggttagtacatcaattagcaatgttctgatatttttatacctggcaacgattgaacattaagtttaaacgattcaacttactctgtcgtaaacagcatgaactatcagctctggacactgatggttgcagttggctttaacgctgcagtgaggtaacgcacttatcctatgcgttgcttccactcaactcactggtaattttctgagctcacacacatgctttgcctgtcacattttttctgtcagtgttcgcgtggcaaacgaactcggcgcgaaccacccgaaagcagccaaattctcggtcatcgtcgccgtggtcacgtcggccgccgtcgggctagttttcactctggtcgctctcgtggcgaggaagcagctgccgaggcttttcacggacgacgacgtgctcgtcagggagactgcaaaactgggctatcttcttgcagccaccatattcctcaacagcatccagccggtgctatcaggtacagaaccattctataatcaagtgaaatatatgctcaaattgcttcaggatttgacacttgttgatgcaactatgttgtgccattggtaaatggcacaaattgcaggggtggcgattggggcagggtggcagtcatcggttgccttcgtaaacattggctgctactatctcgttggtctgcctattgcagccgtttttggcttcaggctgagccttaatgcaacagtaagacagacaaagccggcggtctaaacttttatttttcagtgatgattttcttgcagggagatgtggtaaccgttgtgtactaaccaatgcaggggatttgggtggggatgctgatcggaacaatcctgcagactgttattctgcttgtcatcctctacagaaccaaatggcagaaagaggtacagtgagctcgcttcatcaaaggactagtcgaagctgatcgtctcggcttagtttcaatttttttttcaaatgtttttggacggcaggccatgctagcagaggagcggataaaggtgtggggagggggtgttgagctgccaaccattcaagaagcaagttgaagcgaaaagattctaactacacatactacagatataatagaacgctacgcgtgtcacattgtttgctacgattccattgcaattgtgcatgggctgcggtaagtatgaatgtagtatgatcgttttacagcagagcagaataaagataaagttggtcaatgttcagctactcagatctgttcgactccgtcgaccacatggctgcgcgacatgttcacttacggcaagtacagattacaaggccactgtatctggccgtgacaacctgactagcttggtgctcgtctagtgttcagatatgagctcacgacagcgtacgtctggggtaaccggcgtcgggtgcaccgcgcacgccagaaacgaccgggtttcgcgacctcgatcaacgtacgaccatggcctaagcaaacaccgatacaccatggatcgtcagagaagagatacaaattaactgatgtaattgcataagacaaggtacggcgattcattacacggatcaacgacaccgttatcatgggagtggtgacttgtgagcctactgaagctgaattaacaatttaaaatgcatctatggctagtttgcaccagacggcgatcagatcttgttggtcagcttctcgcccttgatgagcgggttggcgcgggctatggcgtcgcggctggcgcccttgaagtcgaagccgcaggcgtgcttctccgggtatcggtgcgtcccgcagtaggtagccccgcatcggcatgcgaaccccaacagtcccaccttcttcttgcacgacgcgcaccggttcgccggcgccttcttctctactaccgtcgccggctcagggttgttcttggaggagaatgcggcgccattaacctcagcggaaggcacggagcaggaatcagacgtaactgcgccggtcgcgacggtagcggcgctcgcggcggccacggaagaggagggccccgtcgccatcgtggcgccgttgaggaggcagtgctggcggtagcagacggagcacatgtcgagggtggcggggttcccgtagaagccgcagccactggcacagaggaccggttggccggcgctcgcctgctgctccgacgacatcttgatgatattggcgcgtagaacgatcgtctctcttgctctcgggaggaagacgtacgtctccgggggcgccgagcaacaaaacgatcgatcgaagcctcgaaggcgattgcgcgtttcgattgaggcgaacacgatagcgtcgatgggcctcgggggacgtggctttatagggccttggttggttacgacacggagtcgtagtccgaaatcgttcacaacacggactggcaatgattccgcgattctgttcggagtccggccacttctagggccctcttgactcaggtaggcctccctctttaccgacccaaacacatagcggcctgctagcccaaacacatgcaacgcggcaggctccggagcaaagaataaaggctatattacctccttgtgctgactccagctagtgatgactccaagtctgaatttccttcctcacccacaaaatcaggagtcccattttttttgcctaaactagacacgccgtatccttacatgtcaaaaccagttcaatttatctttttttctctacacagtgatattatccgatacgataatctatttatacctaattaaaaataagtaaggcttccggaacgatttttcgtccatcgttgtcatcatccactacattattttcttccaaacgaaacggatgactaaactgtaggttcgcttgtttaggatagaactcaatttcgagctcgatacgaagcggatttgctctgattcttgagaaaacggaaagagtaggagatgaggatagaaacctctcaattaagtttggattatctccaagggtacggctggattttacagaggaggcagtttcaggcggcgtcaggcacccgagggagtccggacggaggttagggatgatactgtcgcgatgggtccacgtgacagtgtgagagagaacaggggagaccaattagacattcggttgcttgctgggccgaacatgtgctcacgggctgaggtggaggagagaataagggaggaaggtgggctggctcttgtgcgggttgaggaggaaaatgagctataaatggcccatatagaaaagagggtttttatttagatttttatttaaataaatactaacatggtgtttgtattattagaattagcaattggcctctaaaaattccaagaaaaattcagagagtgtaattaggctgtgttcttaagtctatgtttccaacctcactctctcgtttaccgcgcgcacactttttcaaactgctagacgatacgtgttttgcaaaaaaaatctatataaaagttaatttaaaaatcatattaattcatttttaaagttttttaagctaataattaattaatcacgtattaatctatttctccgtttttcgtgtcggaggtgagggttcccaacactcacataagaacatagcattaatcatggataatttaacaaaagttaaatcagcatgcaattttatttgtcacgcttactttacctacctagttagaaataccccagtattccagaaaaattgtattttagttaattaaataatgtaaatctttctcaacttcttctcaattttcttgtcttttcttccctttgtaacgcacgggcagttttttagtccagttagaaaaataaaagatacatgtttcacataacgtatttcttcctcctctctctctctccctcacagactaccttgtggcaaaggtaacacggagatggggcggcagtgctcgagtcgctggcactactggcgacaccagataagtaggccaactcagggcctaccttattgttgctgttgagacgagaagttgcgaacatggtgttagcgcccatctcagccttactcacatgcgtcgcttcacctacattgatgcgactctcgtgctgcacttgttgtcccattccaccacactctttgctctctcatcactaggcatgacttgtgtatg

SEQ ID NO: 987 - DNA, 21852 bp, Oryza sativa
tgcgaggaatatactcggtattctcgcgtgggtgtctctctggtggattgctaccgttgccatcgccgaatgtaccctagctctaccatcatgtttaccaccctcatttggttgtctttcattttcctttattttttttggttgattgtatcgccatgtaaatgtaacgtcaaatgaaacccctgtcaaaaccatccgggaaggtttattgaatcggttttaatagttggacgatatgctattatatgctattatgtttgatattgtggtggagtgaggaaattcagatgctcgttctacagtaaagggtggtggactttttttacgggtaagggaggtagattttttttccccgaacaaatcacgatgttggttcgtcgtgatggacatacaactttttcttccccttggaccagcagcacgaaagcaaaacgtcgttccggtgcaggcgcagctccgctttaaccacgcccagcgcgagaagcatcagaacaggtaacaaggcaagttcccttcagagccagcggctcagtagtccatcccaggctcagctcccatgctcagtagtcccggcaaaaaggggagcgccgaaacttaccaaaggccagcacacgcgccagccgcgcgcggagacgaaaaactctcacaatcaggaatcagctcgccatgcgggcgcgcgctccggcaaacgagtgaaagagcgaccttccaaagggagacacgcgcggagaccgaacttaactggaaagctgatgagcacttttctccccgtgtgttgggcaaaagttggacgacgtacgagtaaacgtcgcacgaaacgcctcggtatccctacctagaggcggtacatttttcgatcggaaggccaatgctgtgcataagggcattagcagtgcgcggtgagtttttatggagccttcgtatgccaactaagctcaaaaacacccaggaatattgttagctacatgctacacagtgcatactcctttaagtgggtcccactgtctaccctcacttttcatctctcctctatctattccccaccagccgaaggtagcgaggcagtggcagagaaagcgaggcggcgaccggagcggggcggggcggtcgagcggcggcggcggcaggcgtttgagcatcggcggagtggtggcggcaccaagctccacgcctccatctctcctcgtcaggcctggaggcgacgatgcggcggcgtggcccaagcttcgaccgcaccgggtgaagctccccatctggcgcactgccgcttcctctccccgtccggcctcctccctcggtggcaggcatggatcggggggcggcgcggccggtgagtctcggccggcgcagattggggaggacgacaacatcggcatcgacgcttctcccctccctccctcttcttcacctcttctcttgtgggccccaaagctgcgattctgacgaagaacggggagccaaaattggcgaggctccaagctatgcctaggtggaggggagtctctgagctggctgcatgagagagaatgacatctacgtgcactgtgaatagcctcagtgcgtgccttccctccaggatacaatgcgaaagagtattttctgaacggaattgctatacatcttacgacagtttttgaagggaaaatcttttgatttttgggccattgatccatcctgacattcgtgcatagatagattgggaaaaaaattaacagggatgacgtgagctaaggggatcaatcccgcttgctctgtcactccattgaaccatcctcatcactgtgctagcactagttttacactccacaaatctacactctagttatacatcatgtaggtacattgtactatagtgtactatactgtaagtgtagttatattgtaactacactaacttattaaagtaatataaaaaaactccgcattcgctctcacggcatagaaatctcatattaatcggagaaaaaaaataaatttcatatagaaacataatttaaaaattacctaaactcggaacaaaataagaaatattagaaaaagagactagagtccatacatgtatacgatttagagctaagagaaaattaaagttcatatagaaataaaattttaaaatagcctaaattcaaaattaaaaaaaaaaagaatattgtaagaggagactagagtccattcaggtatgctatctagagctaattaaaatttagaattaaacaataaggaaactaaaagtagaagttagaatccatataaaaatataacttagaaataactaaaattcgaaattaaaacataaaaaatatttaaaaaggagtctagagtccatatatgagtacaatttagaaataaatgaaattcggaattaaaaaataacgaatattgaatgataagtttagagtacatatagaaatacaattagaaataatggaaattcataattaaaaataacaaaatattataagaagattctagagtccatagaggaatttaaaactaattgtaagccagacttaaaaacattaatttagagaaaactaaaattcaaaataaaaaataaaaaagactaggagaagagtctagagttcatatcatataggaatacaatttagaaataactaaaatttaggatttaaaaataagaaatattaggagaagagtttatataggaatatacagtttaaaaataactgagatttagaattaaaaaaatattaaataagagtatagagctcatatagaaatacaatttagaaataacttaaaaaaagatcattgacggaagggtttagaatctatataggaataaaatttataaataatagagagcaactaaaaagtaagaaatattgtaagagtagacaaaagtccatatatggatacaatttagaaataactaaattaaaaattaaaaatagttaataactatcacgtatatacaatacaatattaatattatatattggttagtttggttaagttaatacaaaattactattttaatatattttaataataaaaattaaaaatatacgtattatttgaggaaaaaaaatataacaatattagccgtgcagatttcgcggctgtaacggactctcccagggcgggctcgcttacatctgatagcctggtgtgcacccgggaacaccaggaagaatttcccggtcggtcacccatcccaaattgctccaggccaagcacgcttaaccctggagttctttggagattgacttccggaaaaaaagttgcaacttgttagtatgagtattctattaattctattaagccctaggccgggatgttacaccctcgcccccttaagagagatcgacgcccccatcgatcaaccccaggccaggaacgtcctctcttggccacgtccatgtgtccagtgccagcgcatgtgccatgctgtgtaaccactcccggtcgtcctctcttggccacgtccatgtgtccagtgccaacgcatgtgccatgctgtgtaaccactcccggtctataccagccatgcgcaccatgcttgcgcaactgcgacacacgcgcccatgaaaccgactcacgcgcccatgaaaccgcgagagtcggctctgataccattttgtaacgtcccgcctctcccaggccgggcccgcttacacatgtcttttctttgtcctcactcgtgtgcacccgggaagaatttaccggtcggtcacccatcccaaattgctttaggccaagcacgcttaacccgggagttctttggagattggcttccggaaaaaaagttacaacttgttgatatgagtattctattaattctattaagccctaggctgggatgttacatcctcaccccttaagagagattgacgcccccgtcgatcaaccccaggccaggaacgtcccatcttggccacgtccgtgtgtccagtgccagcgtatgtgccatgctgtgtgatcactccgggtccacaccagccatacgcaccatgtctgcgcaactgcgacacacgcgcccgtgaaaccgcgagagcggcttatcatcctagttatgtcgtaactacattctaatctttatatatcttacatataaagattagatttgaagtttttcactcaaaagcagttttttaaaagtaccttttctaaataggtgcatttgcagttttgcatctaggctagggtactgtccattgacaagaacaacgctttttttcaaacccctcgattaggcgaacagtgtccattgacgtttctaaacccctcgagtggtacttagaagccaaattaagtgcaagtgttccccgcaaaatacaaaaatagaaaagaaacgtacgtcaatggacactgttcgatatatacatatactctatgactaacgtcaaagaattaagtgcaagtgtgcaacatggtctatatatatacactctataattaatgtgataaactggtactagtaaatatctagagcagcacctatcacggtgcgatcagtgacaaattttacaaccttatcttccggcacatcgtaaagctatatgcacgtcaccagtaaatttaaccaaccacgcatgcaactatgcaagagtatatgcaactacgagctgcgggatcgcaatttttttgtgggcgttgcccgtgccatgagcccatgagtcgtctctcccctcctcttttgctagcggaggaagcttcctctcgccttcctcctgcacggcctgaccgaacacctgacgttatctccctcgggcctctgctcgcctttccggccgccgcgagtagtggttcaggtgagaattgtgagatcggtggtgaacccgccccccggcgacgcatgcaacttgcgattgatcattcagaaaaaacgaaaaaaaaggttgggtacgagtgttgtgtgattgctgcgcatccacctgacagatgggaacaaacgcagccaacgtatgcgtgcatggtcaattgcgataaacatgtggccatttgatcggcaacatgtacatgcatgcgtgcgaggatcaggtaaattgagcgcgtgggcggctgctttgtgccatcgaccttgtggcgatatctgattgggattttgcgagatttaggaagtaaataattaatcacggcagcaatttggtataggaggccggccgcctttcgaattgcagctctgtattggagagggatagttatacgaggaataatcacgtaatatccatgcatgattcctcttgtattcacggcttgcgtcttgcatgagcatcacaccacttacagcggtgtcctcgatgtttcaggggtgtctgatcgaaccagcactcgagcgcagtattttgtggttttgtctgattggtatcttacgcgtgtatatctatatatgttagtgtactccaaatgtccacaactccacatactatgctaagcactctctgttgcaaatgttaggaacacatgctgcccaccggagatgccgaaaccacagaaacaattcattatctgcataaatgggagagttaatttatgaggggatatacacacattatttgtatgtcatttatatggtttagaaaataataacatagataattgtgcgatgtatttcctccgtttcatattataagactttctagcattgcccatattcatatatatattaatgaatctagacatacatatgtgtttatattcattaacatctatatgaatgtggataatgctaggaagtcttataatatgaaacggagggagtatcactttatcaatatgcaagtttaaattcgatctgcatgctaaaaaaaatcttttgtttgcgaggaagaaaataacgaatgaataatacttctactactcaatgtgtagattgtttctcctctcatcctatgaagaaaattttaagttattcttttgggggtgatagttcattaatgcatcaatattatcatttttaagattttgttataggtatttgggagttacaaacaaaaataaacataaggacatatctttaggggggggggggggaaaccagttccccacgaagcaaatggtcttccaagaaatgcaccatgagaacttccaacctaataagttagtaataacttgccatggttcatatctatactattttaaatgatgttagtggtggtgtccaagtctacaccaacaccagaaactcaaactagctatcataaacataaggtacccacaacatgtcaatgactctagaattattaattcaagaaattataaggggttacatacaaaacctttaaattcacctttcatctacagatgaattataagcttctaatcttgtattatccgaccgtacgtataacttgtggaaatagataaaaagaggtgatctagcagtatatttccgtagggttgcttgtgaagatgaaattatatgcctaattaactaactatactataaacctgtaatttttgcttttacttttatctttaaaaatatccgttgcaacgcagctagtttctcaaagaaagaacacataatgatacttctagaaagaacacatatttatgcttctacgtatggttattctggtttgatttctagctagtgattgtcacttcattcggaacctcaatcactttctgttatttagaacgagtcatttctcattaaaaagagcggaaaacaaacaaacttttctggctgttacctgctagtgaccattggtgactaactcgccaaacatgcatggactgatgggccattggatcggtcgatccttctgacggaaagcaagaaaaaacagaaaaagtagggtgaaacttcccctgctgcgtgctgccggccgccgtaaaatacagcacttcgcattgcgagtctcgcgccttcctccgctatatatacgctcgcacactcacgctgcctcctcactagctaagctcgggaatcctaagtaagtgaaagcttagctagcttcgcataaatccagctctctcttgctaatggcgggcgtcgaggtctccaagccgtcgaggcgcctgtcgccgaaggggagcttcaagctgagcctgcccagcctgctggcgtgcgggcagtgcaaggccacggccgtctcgccgccggagtcccccacgggcgtcggcgcgaggtcgttctcctcgtcggcgtcgtcgtcggcggggacgtcccgggggagggagcgcgaccgcctggcggagctccgggagatcttcggccacttcgaccgcgacatggacgggcggatctccggcgacgagctccgcgagttcttcgcgtccatgggcgacgactccggcgccgccgccgccgccgccgcggcgatggggctcgacggcgcgccgggcggcggcgagagcggcggcggcggtgacgggcttatgctggcgttcgaggacttcgtgcggatcgtgcagcggaagggcggggaggaggaggagcgggaggacctgcggcgcgcgttcggggcgttcgaggcggtgaaggggtccgggaggatcaccccgcgcgggctgcagcgcgtgctcagccagctcggcgacgaggcgtccgtcgccgagtgcgaggccatgataagcgcctacgacgacgacggcgacggcgagctcgacttccacgacttccaccgcatgatgagccaagactaagctatagctccgccgtgcgtgcgtgttccgcgcgcgccgtccgtcgccgcgtcgtcacgaggaaatttgcctccgcgggttcgatcgtgtctgttcgtgtgtgtgctgttgtgtacgtgttcgtgcgggttgtgggaggccggctgtgactatgtgagatggagtgtgtgttttggtcgcgtgatcgtatcgatgtgcgtgcgtgcgtgcgtgcgtgcacgccgcgcgcggcgcggcgtcgtacggttgtctgcttcgatcggtcgatctatgtatatggtgcacgaacgcgggacgccttagcaatttagctgtgctttgtttaacacgaagccagcatgagtactagtaaaaaaaattcccttgtacctctagctaggggcagtatctgttttgtcttcttccactgatcggtgcaccgatgccacgagttgctttggctcgccatgccaagagtccgtgacttcgccttagtcgaggtcgtgctttcgtgaggctacttagtgtcttgcagagggtacgggtgccctggttgagctaaggtcattagtcagggtttacaaaaccgacaacattctttctgaggtcatagccaacgctccagcatggagcgtggtctcatccttcctgagacgaatattcacgccagcttgatcgataccacaccttggcagagtgccgcgacacgcagtagagggccaggtagtttcatcagcttatcgttgtttttgggcgaggaacgggcaaggagccgcgttggggagatgcctcaccccaagccgttgccccgcgtcgttgttgctcctaccccgagaagaagatggagagggagaggagagtcgccgtcggggagggaagaagagaggagaggccgcgatgccgccgaggaggagagctcgagcagagggaagagggtggaggagctcggcggagctcgaatggtgaagtaggacggcgtggggagaggggattttggggtgttggtgggaaaaagggggagggaggagagattttatattaatttctgtatttttaggtgtttagcgtaaaatttaaacttctatatctctattttttttacttaaaaaataagagttgcttccatcgtctgtaaaaaaaccatgggagaaaaaaaccgtgcgaaaaaaaccggaccaaaaaaactatgtccgataaaaaaaacggacgaaaaaaatccgcgggcgaaaaaaaccgtgtgaaaaaaaaaccaaacatgtccgataaaaagggcgaaagaagggaaaaaaaatgagtccgatcaaaaaaaaagtagggacgaaaaaaaggaaaaaaaaagaaacgaatctgactcggtctacacggtaaaaaagggtgaaaaaaggaaaaaaaattaaatgaatccgactctgtcgacgcggtaaagaaaagggtcaaaaaaaaaaagtacatgtccgattccaaagaaaatcgaatcctattatatgtgacatggcgtggtaaaaaaacaaatcgaatccgattccatcgacgcggtaaaaaacaagcgtaaaattttttttgtccgattccaaaaaaaaaagttgcgaaaaaagttttccgtttctctctctatctctatctgtatctctatatctactacttaaaaattaaaaagtatttccatcgtccatccgtgaaaaaaaagcgtgaaaaagaaatcgggcgaaaaaaatcgaatctgattatatgtgacgcggtaaaaaaaattaaagacgtttttgacatccgtagtaacgaaaaaagggcgaaaaaatgaaaaaaaaaagaaagtccgattcaatatctatatattcctaattaaaaaaatttgtatggcttatgggttatagttttcatccataaaaaaattccatcgcacgtgcgatcgattccgctttaatccctctccgatggcaaaaaataaaaaaagaaaagaaagaaaaaaatgagacaccgtatcaaatttggacctaaattctaaagaaaacactactacaagaatacaagatcagattcaagaacaccaagaaaacgccgacaccggaaggggagggtgtcgtcgtcgctgctgaaccgccaccgccgtcgcagggatgtcggatgtcgggccgccaccacattgttttgagagaggggggaggggaaatgttttagggttagggtttgggctgttgaacttttatataggtcgggatgaccgtctatcagatcggacggctctagcttctctcgtgtcaggccgaacgccattcccaggccgcccacacggaataagttcactttatgtcatttaagttgttcctacccgattctattcccaggccacccacactattgggccgcctcatggaccacgtgtacgctccgtataaaacaagttcactttaggtcacttcagttgaacttttttatttcattataaatatattttcttaaagagctcatatcatgtaaaactaaaccttaatcatataatatttttatatttcttataattttaattacccatcgcaacgcacgtgcattttttctatgtcaaaaaaaaaagatcacgacatacgagtgagagatatatatcacacacacccgcaggctcatgtttaactgaactggcaacagattttcaattacaggtctaattgttttatttaggtgattaaatttgttttcatttatataattagtttgctctatttaagccttttgaaaattgctaaaatttgagaataacttttcctacttcgtattatattattttttgctaatggaattaatagaaaattaattatatatttttatctttttgaccaaaggtcactgcaattttattttattaatattattattatgattatgattcctttatttttgttccaccagtatacatgattaaaattacctttacccattgcaacgcacgtgcatcattgctagtaaattggaaaattgtgagtactaaagtgaaaaacactaggggctgaaataaaaaacgagactaccacatgaagcaacttgcaccgtgggaaattaattagctttttgggggggtgttgccccatctacttgagcgtatcccttgcgttggccatgccttaaaagctataggctgggtttgaggttgtgtcgatgttgtgaacagatatactccctactaggttgttatatgatataaactttggtgggggaggagctcccttttttttttgtgagggcctggaatgggaaatagcaaatggcaaaagttttggtgacaacaaaattggcattgcaaaaatactagttagtgtttaaatgcatcttaaagttgtcattttagcactaaagagagagaaaaagagagagggtgtggtcccagagcactttttagcaaaatttgctaccatgaactagcaaatgccaaatatcaaattgccaccttttgctgttagtgtttagatctaaaatgacaaaaagaactctaaaatatcaaaagttttactattttagagtatctaaacaggccatgagacttgctggttagctgctaaccccagcgtgtgtagtgttttttttaacttaaatcagcgtgtgtactatttttcttttacttaaatcagcgtgtgtactgttgccttgggtttagctgttgtaaaaaaaaatgtttatttattttgggaaggcttggtttctaaaggtaggtaatggatgtttagctgttgtaaaaaaatgtttatttattttaggaaggataaagtaggagtaaggggtgtttagataaggggtataaagttttagcgtgtcacattgagttttatatagggtgttgcatggggtgtttggacattaaaaaaaactaattacagaatccgtcagtaaatcgtgagacaaatttattaagcctaattaatccatcattagaaaatgtttactgtagtgctacattatcaaatcatggagcaattagacttaaaagatttgtatcacaaattagtcgcaatttgtataattagttatttttaagcctatatttaatattttataaaggtgttcaaatgtttgatatgatagggtgaaaaattttaggatgagatgtaaacagtgcaaacttctcctaatagaatccttgtgtttctgagcaatttctctgcaattctccgaagacaagagtgtactcctactcggctacttgcacgacacaacacgtgcggctcgaccgtcgtccggactcatgacgagtgtcacacggcgcgcgtataaaaaccgcatcgccggctccaacggtcggcaagatccaaaccggttcaaatccccaagccaccgtctcttcccatctccccatcatcccacccccccgaatcgacacccgccgccgctccgaaccatcaaatcaaccccctcgccgccatggatttgcccaagcgagttcttccgcatggtgagtgggtgctgccgcccggatctaatctaatctaagtctcctctccgcgtataattcccctcaattttcggttgcttcgtcgctcaatccgcttttacgcgccgtgtgcaggttccccgcgaggaagtcccatggcgacgaggcgaagggacgcggaggcggacgagaacgtgagggcgtggagcgagaatccggggcgtctcggtgccgtggcggagtggaccgcgtctctggagaggaagaaggtgctgggtgagaggaacggcggaggcgacgggagcggggaggccgcgtcgccgccgcagttcttctcccaggcgaagcccgcgacgagcccgccgtcgctctcctgccgcggcgaggggccgtacgacccgaagacgaactacaccacgccgcggccggagttcctgcgctacaaccccgagaagcgccgcgagatcctcctccggctggagcgcgaggcggaggacgagtcgtccagtgccacctcggccacccccacccccaccccctcggagtgcgtgtcctccgggtcgtcggtgagaggcggcgaagccgaactcgaccgcgccgacgccaaggaggaggagattgagattccgtctcctcgtggtctcgaccgcgccgacgccgaggaggaggagattgagattccgtctcctcgtggtgggtgggcacggcggctgcttcttctgctcgtcgccgcggcctgctcttgctgctacatctattgtatgagctcctctccctttcctacctcacaaatggggctcgattttgctggaacaactgggagcgtgcatgatgctagcgctcatcaagtaggttctctggagttgcgagcaccaactgagatgatgggttcacatcatgtgtttgaagaagctacagatcaaactgtgcccaacggcagtgaaaatgcagcccaactgtatggccccatgggtggttctcgtaaaaacttcatggcgattgctgcgatgggtttggcagattcatgcccaaatgttccattcggagaatttacatgccaaattggggacagagccgtggaggatgtgcagaattccaaggaagattttcaactgagtgaattgatggttgcaacctctgagaatgccgagcaattgggtgaagttgtaagcctgaatgaaaatgtcactgcagattccattggttcaacctacaccgctgatatggtggagggagagtcagggttagttcatcaggaggaggcaggggaggatcactcgcaacactcccagcagttggcctccatggagaagacaatagaacaagaaaacaacgaggtagggtatgatggagagggcctggaaaatgacagattggatcaggcaaccgagctattggagtatgagaatccagctgcagctgcaaaggcaatagtagctatggtaaaatcactgtggccttcaataaaacttcacttgatggagatcttggcgtgcttttctgttgcagcatttgcaattgcagctgctatgctcaagtgtttccagaggtctcctaagggtgcatcagtgtcaacacgtaggcttgaacaatcccctttagctccaaatccaagattgccagtgctcccttcaccacaatctgtgctacaacctgtgcaactgacagttcccaaagtagaaccgcctgtcaatttgaagatccctacactatcacctttgcacaagcctgacctatttgccagcttcagggaacaggtgccattgccagagcccataccagtgtcatctgtcaacctcaataatgctgtgcaatttccactgcccaagcagattgattccgggaatcgtcctcagaaagttcaccaagatgatgctggcagtgctaggattccagacagctattctgttggccgtagagacattgacagctcgagacctccagtggtggcattgcttggggagttctcacttgtggatgcaagtagctcaagaggaagctcccggaaaggatcaaatgaacatgctggggatgttgcagttcaggaaccatcagtaactctgagaaaagatgtggtgaagatgcagaaggaaactacagcaattaaaagccctagtgctcgaaaaacgaaaaaggaggtaaaattcagtgtcctcaaacacttatctttacacctacaggctacacatagtgttcagatgcttagataagtcttttatcatcatactgctgacattaatatgtttccataatggtcaagcatttgttttagtacacaatatcgagctgtgggtagcagtgctacttattcacttccttttgttttctgcatcaggaaaatgctgcaaaggtggagaagaaggatgttaccacgccaactccattgagacgctcaaatcgtctccttaaccgggtgacttctccttgagccagaatgacacattaacactgtcaacagatgctgatccttactgtggagtggagagagtttcgggactacaactcctggctgttacccaagcaagttagcttttcttctgtagcacttcgcaagttagttgacgtacaagactgcagtaataactcatttagtcctcttctctcaaagtacccgcggaatctcattcgctatattcatgatgctttgatgttcatgtactactcattttctactcctgacggtaaaaacctgtaactgatggatgtattggatatatggttgtgtcctggtttacctaattgagtcaatcaatatgcttctgaatctgctgatcgcttaatgcgccgtgtaaagactttgagaagagttggtcagtcgattgatgtaccagtaacaaaggattattactgtttacctgggtatttattagtgtagtaggtatggctaactctatggattagagcggactgggagtataactaaccatatcttcacagcccacggattttatttcaattttcatgtcaatgcgagggacctagtccaaaaccacctgtacactgttctctctaaaaaaacacagccgtatgtggaagtggaaccctggaattggcaacaacattatcccgaagcgtcccatccacgcgacgcggcacaacctcccgcgcccaacacactcaccattccggactggggacatgtcacggggaatgtaaccgaatcccaatcccaccattccacggtacaaaagagagaaaaaaacacccgccgcaacgcaaacacacacacacacaacaacaacaacaaccaaaaatccaagaaaaaccccaccgtctcgagaggccgctcagccatggagctcgcggaggccgtccgggacgagacagccatggccatgcgcctgctcggccacctcgcgcgcgccccacgcggcggcggcggcgacaaaaacctggccgtctccccgctctcgctccacgcggcgctggcgctcctcggcgcgggggcccgcggcgaaacgctcgaccagatcatcgccttcctcggccccgcgggtggccccgcccacgcggcgctcgcgtcccacgtcgcgctgtgctccctcgccgacgacagcggccccggcgatgaccgcggcgggcccaaggtgcggttcgccaacggcgtctgggtcgacgccgcgctccgcctcaaggccgcgtacgcgcgcgtcgtcgccgacaagtaccgcgcggaggcgcgcccggtgtccttccgagacaaggtgagcccccgcgcctgactaacaaacctctcctccatctccatgtgattcatccatccatcgaaatattttggttcttgccgcaaaaattacgatataatctctcttggtcgatggatgcacgtacagctagaggaagcgaggcgagagatcaacgagtggttcgagagcgcgacggccggccggatcaaggacttcctgcccaaagacgccgtggaccgcgcgacgccggccgtcctcggcaacgcgctctacttcaagggcgactgggaaagcaagttcgacgcccggtccacgagcgacgacgtcttctacctccccgacggcggccatgtctccgcgccgttcatgtcgagcggcaagtggcagtacatcgcctgccgcgccggctacaaggtcctcaggctcccgtacgcgcgcggcggccgcggccgcggccgcgacaccggccgcctcttctcgatgtacatctacctccccgacgagcgccacggcctgcctgacatgctgcgcaagctgtgctccgacccggcggcgctgatcgagagctccgccgccctgacggagaaggtccccgtgggcgccttcatggtgccgaggttcaccctgtcgtacaagacgaacgcggcggagacgctgcgacagctcgggctgcgcctgccgttcgagtaccccggcgccgacctgtcggagatggtggagtcatcgccggaggcggagaagatcgtcgtgtcggccgtctaccacgagtccttcgtcgaggtgaacgaggaaggcaccgaggcggcggcggcgaccgccgtcgtcatgacccttggctgcgcggcgccatcggcgccggttcacgtcgtggacttcgtcgccgaccaccccttcatgttcctgatcaaggaggacctcaccggcgtggtggtcttcgccgggcaagtcaccaatccttcgtcctcgacctagattccgatgtggtgaagtaagcagcgaagagaacacggagcggttcgtcagatcatgtccctgtagtgatctttgcgtgtaaaaattccggatcaccggtcaattctgtgatattgtagcaactatatatcagttatgcagcaaaaggaataagtacagtattggtgtctcgtcaaaagaaaacatgaaaatttgttaactgtgcacgaaactggaagcatattattcataagcagctgtaggaacttagtatcattcatgcaaaattgtttactgtgcacgaaactggaagcaacgaggttacggaatgtgtctacgcgacaatcatgttaggtcgcttcagcagtcgtctcctttggcaaaatcagtgcaattaggcattcggtcggatggggcggaagttctagcatcccacaggcctcaggcgtgggaggaaggataaatagtagccttgaccacaatggcttgacagatggaatcttgatcacaccggcgcattctctctgtttcagataggatataaaatcccggaactgcaagataaacacacataagtagtgaagggttaatgtggtttcatataaaaatagatattcaggtagtggggttggcagtgtatataataaaatcatacccctttctgatcaccattcgaacagggtaatagccgacagacctctctctgcaaagtgaaataacaaacagtaaacattattcccctgcgagatgcgatagataaaagtagctcgagattttctctctgcaccacactgaaatacatcagccccatcattaatatatgagtaaatttcacactgcaccatatgttttgaccaaagtttcacaatgggcaagggccaacccaaccttttcacttagcaccacatatctttgcactagttggcactttggactagggttgagcaaatcaatggaagttgtcagagaaaagctagttcaaatcatcatttttagttccatagtattaagataaatatctttagaaagaaatagaaaatcacaaaacaactttgttcagcaaatcacactaaaataatgatgcaaacatgtttaaaagtggcacaaaatgatatatacataggggcaaatgaataaaaataaaatactagaaaagagttaattaccactcacactaaaaataaggaagaaaacataaaatgttttgccttttataattatccatgtgtaaatcatatgaagttttctcacattcccttgctttgctcacccctagtccaaactgaaaacttatgtaagatgtatggtgttaagtgaaaacaatgatttaaccttagtccattatgaaatcttggtcaaaatatgtcgcccaatgtgaaatttactcttaatatattaaaaacctttctgtttaatctagataaatcgttatatggacgcatttgccccacaatgagcaagtacttaaattgtactccaaagaaaattcattgacatatcaacttccacatctgaaacatagccatgctaacctacaagtggcttatcatcattgaccgcacaatcggctataaattagctgctcacggcttatggcttaatagggggtaacttctagtagcaccatcccattcctaacgatctgctgcttttcatgcatacatagtgaactgaactaaatagcaaaagatgctatttgccagatttcaagttcagagatatgaccatgcaccattagctgaattaaatatcaagaatttcaatttaaaaacaacatagaagtattagcactgcatttattaaaaaaaatctcaaaatagttattcccttacatccaggtataaaatattcacttattacttaattttagctcaatcatctcaaataaaaccaagatgataaaatggagatcccttatgcaatgaacttgtgccaaattaacaagcatcaatgttgaggatcctggcacctaaattcatatatatcaaggacaaaatgtagaaatgttctcatggtgcagtttagatgaaacatggtataaacacacaactataaagcatgattggtgaaaatacaagaacagtcttcagaaaagttatgccaacagaaagaaagagcctgaattatggtgagactccttaaactgtaaaattacactaggctagaagtatttctgaaatagtacatggccttctagagtcttactttgctaggtggagtattggagaaagttgtcttcacatgttggtaatccgttcgctttgtcacatctaatcttgaaggccacctaaatgtgcaaacaagaatgttttaggagaatatgtaatgttgtaataatagaatgtgtaggctggattgatgtatctcttaccctgtcggttcagaaactgcatgttcatatctacaagcatccaactctattctacttgcatagattgaacagtaatgtaaaccactttttgaaagagagccctgccatcgaggatgagaacgttgctttgtgagtcagaagggtcagtagcaggttgaagcggaggaggggaatttgggggtggtggcacagaaggtggctgagtaataggtagtggtggtggagatggtggtgggggtggtatatcttgacgagtaaatggtgggggggctacatttggtggaggtggaggtggaggtggccttttctcagactgctgtgctgaacctccaggaaactgtgtaagaggggtaacagaagatggtataaaaggaagaggagcaggtggattcatacggaagctacttccaggcatcattcgaggagaagcgtgactgaaggatggatttggggtagtattttcccacggacttcctggaccaggatatacaggacggacaaaagaagtttgaataggtggcggtggtattacaggaccacggtgtgcagaaacaggtgggcatggaaggatgccttgtggagctctgggagccgatggacctgcatgtcaaccatactgttacatggagccaactcatgcacaaactcgcaaaatttgttaaattaaagaatactagacttaccataaattggtcgctctgttggtactgtgaagcctgcattataccctgaaacccttggattcctgcagatttgattgtttcatagatgtgtaaaattaaacaatcaattgcatacagcagcaatgtgatactcccaaggtgcaagcaacaaatgactttcaagcactcaaaaccttaatttaggtatacaaattactaaaatataagcagatcgtaaagagcagcataacaaacaacactagttgacataatgttctaccatgagctcaatggaaagggaagacatacaaatcagtattctggaaaatatttaagcttgacatacccacatggaaaaaaaaaacccatgttacagagaccatatattttttacattctgcaggttgcagccttaaccaaataatttcacgatcatcaggtggcactgatatatgaaagcctaagatgacgaaatttttgtccacaggcctgcttgacgtcaatattagtgcatgtaaaacctataaaaagactttcatgcagttggagaaatgcaatcaaaggcaaagctaatggaaataccggctatatgtatgaagctttatatttgaaaaagcagccactagcatgatacaatgcacataaggcaccagcaaacaactagggactaagcagtgaaggaacaaccatgtaatggtaggtcagtagcactttggaagtttgacattatatcagtatttgacatacgagcgccaaagtatatacagatacatgcatagttgcacatacaggataggaggctgcagcaccaaaaataaaggatgggtactaaatggcccaatacccaaaatatccaacagaggatctaaatcagcaaaaaataggtatgtcaaatcagcgatagcatcctacattctaacagtgcattttcacaagattcaagatagctggaaaaaaaataacatgctaataaaacaggtgcacaaatagatcgatggcatatgcaaaccaataccacccactgcatatgatcgtacaaatcatgggatgactccaaattgcattgaccaggtctagaaaagttgcattaacaacagaccgacttagcacactttgggagctatgataaaaaaaatatacaagtttagaactgttgcaaccatcaaccatggttatatctgtacaggattaagaagataagaaaaggttgagctaacctgatctcatggtgactgctgtcagaaacactcggggctagcattggaacagaaggcgacaaagttttatcatgcacagatctcgattcaacactaattgacttcagcccaaatcttgcaccatgcaggtgagattttgcagtggcagcagcattaggtgatctataatctatcaagcagttcccatcaagcttattgaactgccaccttatgacctcaccaaatcgtgaaaatgcattgataaactccatgtcagggactgaattgtctatgttccgcacaaaaagttcatgaccagaagtattcttgtcctgggaacagacatctggatgaagctggcgcctaatatgggctttcgcagcagctgcatcagttgctgtctcaaattcaagaagcaaagcattttcactggaaatatctgtaaagctacatggcctcttcaaccctgcggcctttaattcatcaaacacctcatctttatcttttttgttcttaactttagcaacataaatatgacgactttcaccaacagctataccactagcaaatcccttgctgcctataagtctatctaaataccttatttggagaccaccaccccaaacagaggaaccctgcatacatccatatgcatgaacagcatgcattatgttcccgtactcaaccaaggcaaaattctttgggggataaaataagaagtttgctaaggggccaaactcctcaaatttcgatctaactagtgactctgcagcactatttcccagtgaaccaatccaaagttcctttgaaactgaaatcacatccctcgagaaatgagcaccataaagatcagatggttctgaatatgaatgcttcgcctttccaaaattctgccccggagaagtgagagttgcagctcccccagcagaatcatgtgttgattttggtgtgtgcatatcaagtcttgcagcttgat

SEQ ID NO: 988 - DNA, 38057 bp, Oryza sativa
  unsure (1)..(38057): unsure at all n locations
atacccccctgaattttcatcaatcttgtccagcactgatgattcactgcccatgtgacttttattgtcttcaagttgtgttaaagagcccaaaacatttaaacacgatgatacctctgaaaccacatcagttctacaggaatcacacagctttttgtacctcaataatatccagcctttcaaagatggatgcctagagatggcctgcaagtgaaacctagtaataacattagataaataaacataaagaacactaatgagtgaaactacataacagtcttttaccacatataattaagtgaaaaattgcaaaaaaaaagaccccttaaggataacacatttataaaataattgtttattgcctggcaatctgtatatcatatattaatatacgctcataatactcatcctgggcgcataaaatttccttgcccccataatttgttgaattaatgacaaaacaaaccatttgatcaatatttatgtcacagagtcaaagagtaatgaataatggctagcaaaaatgcaaatgcatttcactcaaatgaatccattgccaactttcactgaaatgaatttccacacagaagaatgagctaaccaaaaggcctcgtgcaacacccaacagtaatgaagggtcagaaaggcagcacagttaggaaagtgattaacaagttgcacataaaataggcactttgaaacacactgataatatatatatctttgttatagcaaatctagcttataactttgaaaccttctggcttacttttagcctaagtgtgtgcagatccttatcatggataaggaaatgaacatcggtactcatttgactgtccataacccaaccatcctattggtgaaatgcgaaataaatgggcaactaatataaccactatcaaattggtgcttagtaattgactttatatgctagaacccatcatcatttctaatgggaaaaattcaaaagtacttgaccgaaaggttaaaatgcttcatcaatcaatagtggtccataccattgtcatgtaacactcatttggctgcaacatagaacttcctgaaacaccaacactatgagaagatagattggaatcaacagattctttggtgctaggatgatctacgtccattcctgtacactgggagattccatccccctgaacatcgagagcatcagttatgataccactgttcagatggcaggttagctgctttagaaagtacaatccttctccgtttacatcttctgcagaagcaatcagcgcaaaacaggcatctagtatgttctctggaaataaaagaaatatgcatagcaatgaaagtgctctcagttcaactaaacagtcgtctgcctgttggttgtcaccccctgaatcctgctttagaatgtctaacagctccacagggtcctgaagatttagaagttttcttgagcctatgtgatagatatccttcccatcaaatgttgaaatgaagaatgtgaggacagtaatataaactgcagagcagattcctgttaaaacagatgatttgggtgcttcacaggatgctgtggagcatatgtcagttaagccaagaatacaagccctagcagtctggtatgccacaccatccacatcttcccctcttgttacaatggccaggttccatttatacatgttgatggaaactttggtagctgcctcaagtgcagtagggcagtatgaggcatattgaggaatcaagtcagctaaaatacgttgaacgcttgtacaacctgcatcgaaggtaagggaaaatgatgaggatggtttttaagcatggtaaaacagtaattgctttcaatatatgaagttttatccatgtaatcaagtacctacatgccccagtgattacattaattaatgtctctattaaacacacggaacttcacaacatcagagtctttcagtccgatgctacaaataaaagctaagtgataaatgaaaaacaattcaagttttatatgatcatcgtcttaagataacttggcaaattaggttgctacaataactctcctagagatattcaacctccaaaagttccattctctgttaatcaaattggtaaaaatataactgaaagagtacagaaacatgaatgctgccaaaagaaaattcgagcatagctagataagctcaaacatgtgagattaagtttccaaatataaagagcatttaaccctaagcagtttttttctatgttgttggttaacatgtgatgatcaaaatgtcgataccccacgaacttacttcagttttacatcagtgatgcagtattatttgatcaacttttgcttctgtttttttattaacttggaaacctggatttaatatatttgttatccttttgtgatgcatgcttatgattcacacaagcatacaatcaataaatacagttggacactgattttgataggagttcatcactagtaaggccaacaaaagctctaaggatcgataaacaaacaggtgctcctttaaatcagtcgtggtgatgaaccagttgtggatacaccaacaataatttccatactgttggtcacaagcatgtgactaagaattattctcaggaactacttccgaacaggtaaataagtagtgcctacgccctacagtacatctcccaagcacatacctctctattgtgagcctggatcaaatacgtacacagcttgttgacctaagacctaaccaagtagattaaagtttcaaactacacacggggcaggagtacagaacaggttaatcatgtgaaatttgttgctggatattttattcccatggcagctcatatggattatggatccataaatctatttcactataatatgctggcagtaaagcatccttttagtcaccattaaccactgtatacttcctctaatgatataatccaacacccatgcaagccttctgctttccctcacctgattaacacaaacacacaacggagcaagaaaaataggaacgaggtgctcaagtaataagtaataaccatcaatcgagattagagacggatcagaactaaattctactagcttcgagcgtagagtggtatcgagaaaacgccacatcgactcgctatacgaatttcggcactttccaattgcgctatcttgatgaagcgtgagtgggaggggagagtccatgcacctcgagagctggcgatgagcgagaggtacacctgctcgagctcgggcaggaggcgcgcgtccttgcgctccacgcagaggcggatgcggcggtagcactcgaagaggccccgcagctcctccctgttgcggcgcttgcgtacggcctcctccggccgcggggaggcggcggcggctagggtttgtgggggaggcggcggcggcggcggcacgcccggagggggcgggaccggggaccgtggcgaggccggcgcgggagcggaggaggaggaggggctcggggccggggacgggacatggacctcgacgagcctccgcttcttcggcggcggctccgccgacgacgccatgatcggggcgacgcgggggagaggagtctacagtgtcaactccgtagtccgtttgatgacaccccgtcagttcaggcgtgtgtggcctgtggtttggtgtgtggcatgtgtgcctgtgtggtgtaatggcaaacggacagatactaggaatctgttactcctactagcaatgaaacactccacgccatatccatttcataatgtaataaatctaaaaagtcttacattataaaatagagaaagtaggactaccttagaatctagagggatgcgaccagattcatagtcttagaatatgttacatacctctaaaatcccttatattatgggacggggtacatgattataatggatttatggtgaactggtaagataaaatttgcgcttacgttagtttgggtaaaaaaaatacttaggaaaaagtacgaattaccccctgaactatcgcggtcaaccgaattaccgccctaaacccaaaaaccagatattactcaccctaaacttaaaataccggacaaattatcccccacagcccaatccggagcggttttgtcctacgtggcgtacgcgtggcaatccagtcagcaaattatttattacaaaaaatgtgggtcccacttatcatactcctcttcctccctctcctctctcttctctcttaccgagcagcgcacaggggcggggaggtgggcggcggcgtggtgatgggcaatgggctggaggaggcgcggtgctggcacctgcgggcggtggtgttggcggtggagggtgccaccgggcggcggctacacgccgcagaggccgagctggggctcgccgccgatgaggggatcgacgaggcggaactacggcttgtagaagatcgggtcatagacaatgacccaaccgtggccggagccaaggcagttgctcctttcagggaggagcatggccaacctctcgtggagcgcggtggagatcctcggggacagcaaccatgcgttgtggcgattccgccagccgcccgcggctgcctggcgctggatctaaaatcgatgaaaaaaacaacaaacaatatttcttacatgatagaaaagggagatcttagatctaaatcaataaaaaaagcaacaaccagtaattcttacatgatggaaaatggatatcttagatctaaaccgatgaaaaaactacaaccagtgatacttacatgatggaaaagggagatcttagatctaaatcaatgaataaacaacaaccagtaattcttacatgatgagaaaaggagatcttagatctaaatcaatgaaaaaacaacaactaataattcttacacgagcaaaataggatgatcctccctcttcgagaggcagggcagatcgagatcctagttctaaataaatgaagaaacaacgactaataattcttacaccagcaaagagagaggttggcgaggggctcgttgccgccttatccctccatctcccctcttattcttcttccatcttcctctactccatgggatagggggcttaggccccaagtactcgcgttggatccgccactgtatagaggggatgggaagagagagataattagggaagaaagtatgagtataatgaggggagatatagctaaccggtgctagagaaggataatcatatatatacctcacccttttatagagaaagaattaaactccattctaaaactagaatataattagacagagcgaccatagacacatattataattataataagagcggttagatatccttacagattaatatagtactatcatcgctagtattagctttgtgcttactcgccctcggaagtttatatgaacaaaacatttggaaaataattagaatagttgtttgacatgacataagaaaaacacaaggaacaattataattttccccctcaaaatccttttgcaatatttcatactaccttatgggatattgttattgtgctgtaatcctttccactcgttcccattcctatttcaaaagtgcattaaagccagaggctatgagacatgttaaatactccatacgcaagtttttttataggctctacacgcattttgaatatggacagtgtcgtttttttccccttagaggcttagatatcgaatttcctttgcaaatggaaggtatcagaatttttcaccaaagcagggttctcgaagcaactttgctatccttagcccaacggccgacgcgaaggatgttttgggccgacttgctagtcagcccagcccaacgagcaccatagtactacacaaggggattatctcgcgcgcgggaaaagggaaaaaaatccccaaaatctcccgcgttcagccggccgcagcttgcagtctccctccggacccaagccccgctcgagcgagcgcgatggcctcggcgagggacctcgccgtagcgtccatctccgccgccgtgggcgccgcagccgccgcggccgcgctgcgcttcctgtcatcctacggggccagctctgccaagcagcggagcccgcccacgccgtgcgccgagcacctcgcggtcaacggatgcgccgccgagcgcccgccggtgcagtcccccttcgatcccgccaagagggaagggttagtcctagtcgccccaccggctcaccctctttgattaggtgtagccgagttaaagctcgtttttggcatcttgtgaggatttgttgcgttcgtttctgcaggtatatctcctgggacgactacttcatggcgatcgcgttcctttcggccaagcggtccaaggatcctaatcggcaggtaaagtgcatcttcgttgcttgctaaactgcccgtgtaaggattccaacgaacgattgtcgacgtttaacgtgtttgagctcatgcagtcatactgtttgtagaaatgcctcaatgatactatactgtggagaatcattaaaattgtcggagagcagtggactgttgtggttgatgatttttttcgggatgatgctaccctttattatcctactttagaagaattcacctacctatttggacttgactttctttcaatcttttttagacaataaggcatgactttctttcaaccttttgccaaccatacataccagagtggcaaattttacccctgggtaggatcatttggcaatacaactataccaaaatgtcaagtagtaatgcttcatttcatctcaagtttgttcacgtatatctttcttgctcgttttgcaaatgtcatgtaatggaagaggaaggataacatttgttttgaatgtatttgtttgttgttgtcataaagcaaactttaactcaattaagcagctcgtgcatgcttgattagttcattatttcacctatttcattaatgatttaatcaattcatcagtatgttgtatgcaggttggagcatgcttggttagccaagaggggataatcctaggtaaagttgaaactcaaagaataccttgttcagggttgaaattttatagcctttttgcattttagtaggttagctgcttatttaaaaacaaaaacacacaaggttaatccatgtaaccattggacactgtacacatttttatgctatatctgaaactgatttttcataaactagaagcattatggtcacaaatcaaatttgatatgcttttcactcttaggaagtgcactgaactgccttattatatccttttcttgtttgttgttctctccattagaccacatgattggccagtgcagtactgttttgtgtactgagatagtgctgtgctagtgtgtgcaacggacttcttctcgtgttacctgcctaccccagtgtcgatatattattttgtataaattccattttgttactgctttattgaggggcatttgttactggttagatacactattgatatccctatccagttgtggcataatggcatgacatttcagtcttacatttttggctcttcacagcaaatcacaaccagcatggcagtcctctttttaattacatgtttgcttttggactcgctgctacatttcagtttttttttttggtaacattgatccagctatattggtttttcaacacatgctacttttttttttgaaacatataataatgcacccttttatttggtggcttcagactgcagcattgctgtgaaatgtatgttgttttggcaggcaatgcaccattaataatatgtatatcatgttgttctgatagtgtaacccaatcttaatgcaatcaggaatagggtataatggatttcctagaggttgttctgacaataagctaccctgggcaaaggtatattttttctgaagctcttttttcgtatgtaacaaggactactaaattaattattgtactgttagtgcaaagtcaaaattcatgtaaggtgctcattttgtaattatttagcacatacaagctgccacatgcaaaagagtcccatagcttaacatctatcacttctctagtattttcctaattgcttgtcatttcagaaatctgccaagggagatccattggagacaaaatacccgtaagtcatgaatttattttctacactagtttgattagcactatcccttttctttgtgaacatgcaaaaggattgtgggccaaatatattaaaggaaacatgagcaaatacaacaaaacgtcaatattctagcaacaaggaggaaatgccttgggctgtgtacacctttctaaggtgtagaggccgggttaataatccattatctaaaaaacaaggaggaaatgcctatagactattaacacgataagcaccacctgggaagcatgaaagagcaactggttggaaacatcagtggagagacattgacagtatcttttattgatacactgtagctctataggctttttgggatcagtacgggcaatttactttagcagtgatgagataattgttttgtaaatatggatatcctagatataaccatgagctctagttctaaatgtacataatcacttggtgccacctatttggaatgcagaagcttaaactatgtggtagatcattgacaaggatctttcttcaaaataaacagttaatgcaaatgccttttatttcctactccctccgtcccataatataagggattttgagtttttgcttgtaatgtttgaccactcgtcttattcaatttttttttaaaattattatttattttatttgtgacttactttattatctatagtactttaagcacaactttttgttttttatatttgcaaaaaaaaattgaataagacgaatggtcaaacgttgcaagcaaaaactcaaaatcccttatattatgggacggagggagtatttgatttcataatctagagaggagaaaaccttaaactgttgggtggtgtatgtgctgagctgatgatttgcgtcccagcccaaaagtctcgcatacaccagctgacttcacaaaccatatagagtaagagtgatgatatgttcaaagaatgaagagcataactgaatgcaaaaaaggaagggcggcgtggatgggatcctgtgtgttgactgttaataactcggggaaaaaagttcccagagacatgcacatggcgatttttttttattttcagctatcttgtgacctgtgaggcacaaaaaatctaaagggattagtctacaactctatatgtgacccttaaaaattatctaaagggattagtctacaactctatatatggcccttaaaaatttacttctatgctcctgtgtcaggctcatatctactgatccttgttgttctagactttaagattttttactatccttgaggttatgcagtacggccgttgatctggcaacaccctacggtcaaaaatcgtcggtacctcatggtaccgcaccttcccattgaagcggtactgtggatgggagggcagttttgtactttcgtctttattccgcgtcacgcacgcacgcggcatctcttcctcctccgtctctgcatctcacagggcaggagcagcgttgaactaaccggcggcgagagatggcggcgggagcaggggcatataggtcccgaaccctagatcggaaacccgacagcggcccagatcggcgatgggtggcgggaggaccgggatagctgcaagctgcgtcgggagcttgatgatggttgcggcgacgattcatcggcgacgacggccgcggcgatggttgcggcggtgatttgtcggaagctcgatgtgacggtggccgcggcgaacttgatgcgacgccggcacggggatgcggcaaagagaagagaggggaagagggtaaggccggcgatggttgcaacggccattcatcgggagcttgacgatggttacggcggcgattcgtcggaagctcgacgcgatggctgccgcagcggactcgatgcgacgcggcggcggccgcggcggactcgatgcgatgcaacggcggcagcagcggactcgatgcgacgcgacggtggccgcggcggactcgatgcgacgtgacggcggcagcggcggactcgatgcgacgcgacggcggcagcggcggactcgctggcacggagatgtggcaaagctttggagaatacgagagattcattcattcatggcacgtcgccgacgagtatcttgtcgccctcgtcgtcacgagcgtgtactcgccggacgccgctgccgctgtcgaggagcccggcaatcgcctcctcgcctcctcccgtgcagctcttgccgccggcggcggcggacatggttgggtccctttgagccaccacgagcaagcaagcaaaacgccatcaagagggtgagggattagcgccaccctaaatttgtttagcccgatcatacccctcctaaatcaacggttagattaaattggtacctcatggtacctcgtacctcatagtacctcgtatctcatggtacctcgtagtacctcctcaaggatgggaaagatgctcttagactttagttagcttgtacccaatccagttgcgtaaaatttgtgtgagaagccctggtgttaattcctctaagctttacactgtgctacactacatatgcattccttgaatacaaaaatagtctcctatagcaaggcttagatgttgaattctaagtccctaattgtgaccgtcatctttcaccctgacagctatgttgttcatgctgaggttaatgctattttaaatacaaaccatgcttcagcggctggacaggtttggacttctaatctcctacaaacttaaagcatctcattaatttgcctttataagctaagaataatcttgtgttatcttctctttgcagaaattatatgttaccatgttcccctgcaatgagtgtgctaagattattatccaggtttgtttctggatagaatcagtatcttaaagttaaaatgtatttttgtcatcacctatttaaattactctcactttgaggaaatgcattataacaccatatatctcaatcatacacttcataaaacctaacggcacattttagcttaaaagtttcatatttactgcatgctttgccggttaaactttagttaatgtatacaaacacattgcattttattaataatttactagtaaaccgcgccttttcacttgaagaaattggttcaacactaactataatacttatctttcttgcagtcaggtgtatctgaagtcatatattttgtagagaaaaggattgacaactctgattatgtttacgtagcctcgcacaagttgttatcaatggctggtgtaaaggtttgtaggattgacctatatgaatatggttatactgtgttggaatgagttacatacgttcttatgcttcatggcaggttaggaaacaccaaccacagatgtcacaaataccaatcaagtttcaggagcctcgaaacggtgagccttcaatgaacgcagcaagtatatttagctgatcttatctttgtttgttgtctccttatctacatatacctttactgtgcggttatgtgtaagatttctgttgatcatggcatcaaagaacaaatgcttgtcagtcattcaacgtcatcgattgccatatcctccggggtgctgttgaccgtcttgttgtaaacttgtaatccgtgagactactagatcatcaaaacaaattatggctgtgtttagttcagcgcaaaatttagattttggttgaaattgaagatgatgtgactgaaaagttgtgtatatgacaggttgatgtgatagaaaaggactgaagtttggattcaaactttagatctaaacacagcgtatatatatacttcttccaacaacattacaatttgtttgacctattgatttaagttcaaacaaattatgtgttgcttaaaatcgtgtctggattctggaacaatttatgtactctctcagttcctttatatttgttgctaagcacaatctatatttaaacattgaccattcgtctattttataaaaataatctaaatatttaaatagatgtcaaattatcaaagtgtattacatacttaaacataagttttaaagttttatttatcatcataatctaatcatctaaaaattattttccgtgatcaaagttgcaacggtgccttacaacggtgacaaatatactccatttacgggcaactcttgcttgcgcaacgggccttctgggccgttaacggacaaatcggccgcggaggacgaacccatcaacccaggacatccagggttgttcaaggcggccgcgcttccacgccccacgcaccgccagccgtgatgaccggcggcctcccgccgcctctccgcccgtccaccgcgccgccgccgccctccgtcacgcgcgcgctgcacgcgatcaacacctgcaccaccgccgccgcgctcgcgcccatccgcggcgccatcctcggggaccgcgcgctcctccgctccaccgccgtcgtctccgccttcttcctcgcctgcggccgtctccgccacctcgacccggcgctctccctcttcgcctgccacccgcgcccccacgtgttcgtcttcaactcgctctccgtccctcggccgcgcccccgcccgctccccgctcccgctcttccgccacttcctccgatgccgcggcgtccgccccaaccgcttcaccttccctctcctgctcacctccctgtcctccctcgccgacctgagggccgtgcattgccaggtggtcaagtccgggttcgggcccgacctccacgtccgcaacgccctcctcgcgcgctacgcggactgcgaccctgacctggcgcacgccgagcagatgttcgacgaaatgccccgaccggaggttgtcgcgtggaccactatgatcacctcatacaggaaccgaggccgcacctttcacgctctggcgaccttccggcggatgcttgctgctcatgttgcacccaaccgcgttaccatggttgctgctcttggcgcttgcgcggcccattgtgcggtcgacactggcatctggattcacgagtacgtgcagaagcagggatgggagatggatgttgtactgggcacagcgctggtagacatgtatgggaagtgtggaaaagtctcagatggaatgcatgtgttctcaaagatggccaagaggaatgtctatacttggaactctatcattggagcacttgctcttgcacaggatggcaagacggcattgcagtggttctctcggatgcagaatgatggtgtccagccagatgaagtcacacttatttgtgttctttgtgcctgtgcacatgccgggtttgttgacattgggaggaaaatatttaacctggccatacaaggtgagtatgggtttcaacctgggatcaagcactttgggtgcatggttgaccttcttagtcgctctggacacctcgatgatgcctttagggttgttgagacaatgccatcacagccaaatgcagtgatatggggcttgctattaagaggctgcagggcccgtggcgactcatggttgagtgagcatgtgacaatgaggctggtggagttggaacctgagaatgcatcgcattatgttctgttatcaaatttgtatgctgagacagggaggtggcaggaagctcaggggatcttgcattggatgaagaagaagggactgaggaaagatgcaggctggagccttcgaatgttagaggacaagtcaaagaagtatactactgatggatgtttgttggagtatgttgagtgaggaacaacattggaaggtaattcaatatataccatgtagagaatcatgcctttgctttccttctgagtttggatgtgatcatgtaagttgattcgggagcaggaattgtagaaaggtgcttctttactaagataacggttttattggtcacagatagattgatgagtgcttttggcacatgcacttcatgagatgtggggtctatacttgggaagcaaaattgataatgctctattaattcaatgccatcattaacaaagagtggttaattttggtggaaatcagacaattccgcaactcccatttcatacaatctatttccattttttgttggaggtaattgactaattgtacaggttatggtccttaggcaaaatgttaatggaaattttgactaagcgatattcttcaacaatgacttttcttgccttctgtagtactacttcaggaatgactttcttacccttgtgtatagtttctatttgtactagtgtttccattatactccctccgtttcatattataagtcgttttgacttttttctagtcaaaagtcgctttgacttttttctagtcaaacttcttctggtttgatcaagtttatagaaaaaaaattagcaacatctacgacactgaattagtttcattaaatgtaatgttgaatatattttgataatatgtttgttttgtgttgaatttggtcaaactttaaaagtttgacctggaaaaaagtaaaaacgacatataatatgaaacggagggagtaatattttagcttgtaacaggaaggttttgcaaggttgtttaatactgttaaatgaaaatagaaccaatagaactcaatgcccctgttagttagacattgccttgaagaataaatatccagctgtctagttgtaaatgtgatgcaaaagaagataaagttagactgttcctggtattggggacatggacaagttagcctgaattggagcctattggggacatgggctccttcagattatatttgaatatttatcacaaaaacctaactatgtgcatgtttggtagcataagtgatgcatgaagtgcctgtggaaaacaccgatgaatatgacggcccaagttggttggtaccacttctgatttctgaactagaaaatatctcatcatctaagctctgagtggcctatagagatatgagggaccagcaggacaattcttacttgattgtgaccactatcttaagtacttccaaacatataaaataattgctaggttaagatttgcttagtttcttggaaatattttaataagaggatttatcacttatttttcagtgcactttcgagatggagtgtatatttgaaaccattccttcctgggattcctttgtctttgctcattttgtcgttttttgcctgactcattgctatggatatgctatcattatatagaagcatgagcttccggaaggatgaacctctgatcccttccctccctgcaacagaacatggctcttccaacaccaagattggtagttcctatagatgtgagcaagaagccatgggagcaaaaagtccctctccataaccgctggcatccagatatccctcctgttgcagatgtaactgaaggggaattgttccgtgttgagatggtcgattggactggaggaagagtcagtgatgatactccgcagatgacatcaaattcctggatctcacaattgtaagtatatatatcgctcctgcaagagatgccgtttaattttttttatcacagcgcttattacaaaacaagatatcagcgaaactgactattgattcccacagactcattatcttagtgggcccttaagaatagttgatgctgaaggggttccagctgcacctggtgatcttcttgctgtagagatctgcaaccttggtccacttcccggtgacgaatggggatatactgccatatttgaaagggagaatggtggtggattcttaaccgaccacttccctagtgcaagaaaggcgatttggtattttgaaggaatttatgcatactcccctcaaataccaggtagaattttttttttggtgttgttctaaatgaagcttttcaatttaggatacctcaatagttccattgtgtgtatatcaggtgtccgatttccaggattaactcatcctggtatagtggggactgcaccatctgctgagcttctcaatatatggaatgagagggaaaaaatattggctgagacaaatcatgagtcaatcaaaatctgtgaagttctacatcagaggcctcttgccaacttaccaacccctgagaactgtttacttggaaaggtatgaccttctgccagattagtggttttacttcagtgcaaggattaaatgaaacattgtttgttgcagtacctacaattattattttcatctggtccagactgtcagtgcagcaattttacatatagatatcaatctaagacatggttattggttaaagagccctgtttgtattttttttaaaggaacaaaccatgtctataatgcttgttgcatgattcagattcaagaagggactgctgattggcagaaaatcgcaaatgaagcagcaagaactattcctggaagggagaatggagggaattgtgacatcaagaatctaagtagaggttccaaggtttatctcccggtatttgttgatggagcaaatctgagtactggtgacatgcatttttcccagggtgacggcgaagtctcattctgtggagcaatagaaatgagtggatttcttgagctcaagtaattacattttttcttgtctataattctgagtacttgttaagatgcacccaaacaactacttaaaggtgaacaaaatccactaacactaatgtaactaatccttgtattgttaggtttttcacaattcctataaatatactagacttgaacacctgcatagatcatccacatagacatagctgcttgcttgagacttttcatctgaatgggcacatcaagaatgttaatttaaggatcaaggagcactgctgtcaccactcaccaagtcaattgtgatggtctgtaatattccatctccatggcactgcagtagtttatgcttcttttctgtcatcaatgtaagttaaaatgctctaatgatttctaattgagacattgtgttggtttgcatcacttttggttgtggaaatcagaatcgctccactaatgcatatagcaccagttattcctaaatcatgcatcatagttatatcgtacttgagaaactacatttccacttgactgtgcaagagatgctgagtgcttgtgaataatctgatcatgaagatttgcttctcgtgttcttgtgaaaaccaactgatttcattcttacattttgtgtaggtgtgagatcataagaggtgggatgaaggaatacttgactccaataggtccaacaccacttcatgtgaatcctatctttgatataggtccagtggaaccacgtttctcagactggttagtctttgagggcatcagtgtagacgagtctgggaagcagcattttcttgatgcatcagttgcctacaagcgtgctgtcctcaatgccattgagtacctttccagatttgggtactccaaggagcaggtagacacaggatttttggttatcctgctaatattatgtgatctgaacattatcctaaaatcagatattaacggattatatacaggtataccttttgctatcatgctgcccatgtgagggtaggatatctggaatagtagactcccctaatgcagtggcaactcttgccatccctacagcaatatttgaccaggtttggtgccaacaaccgaacacaatttcccttactcagaatatctgttaccaatctgtaattatttagttacaaaatatatcatactccctccagtcaaaattaattgatgttggaacgtcaaattttttttactagagggaaccagggagtaatagaactagactgacacaattataacttgttcctttggtctgatcttagatctaactatgtaagataggctaacaattaattgtgaatgagtactctccatgtattacaagttcagaacaaatcgatatcattcctggtagacacttgaaactcctgtgtaaccatcaaggcatttaaggctgatggcctaggaagattagatttataatctacccataatgctctctattcaattatagagtaatctttctgattaaggttggttacacttcgtgatgggcttgaataatcaaattacccgtgactcagtgatagaagagactcaaaacagcgtaaaatagaactcccctgatgatttctgacttactactgaggtcaaatcacaagaactaggatacacaaggcacacagataaaaaacatatcatttgtagttatgctttggttaaccttattaacatattgcagtaagaactagcaataatccagctgctattcattctgatctaaaaataatggaggttttttttttttgggcaagtcactagagtctacaatatttccttcataaagatctttttaagtaggataattttattttagaacttcagtatgtgacatttgaatggttggctaggatgtaaaaccaaaacgcctgagtgggaaacaaggaccaaagttgagaaggcttccagatgttttgagatgctcgtccgatggacaccttcctgttacacaggacccaagcggtacaaaggcaccttaactactgcaaaatgcgtggtcatattcacaatccactatatgattagtaattataaatctaaataatcatatttattattccaacatctatctagtgtaatccataatgtgggtcacatgttgtattttctgtattgtacgtgccgtattttctgtattgctaccaagcaccaactcgtgttatctgagttgtgcaagcaactaaatttccttattgtcccaaatatcacggcttgtttggcaacttgagggaagaggattgggagtttacacgagggaattgatggtgagattaagatggaaatttgatttttcatcctagtctcttgtttggtagaggtggtagaaattgatagggagtttagttggagattaggtcattaatgaaaacggatggctgagatttgtttaggcgaagtaaaggaccccctacccaggtattgaaaaggagggagttcattcctcaattccccatccccatcccaccaaaatttccatgtctcctaaccaaacaaaacatttaatagcctcatccctctaaacttccaatccctcctaaaaactccccctaaccaaacgggccatgagtgcaagcagctcgtcttttagttttttttttaaaaaagaaaaatatcttatttgactgttaattagtactgaattctgtgacaagcagacatgggagagtggagctgtggtagattggaatcgataggtttttgcacaagtcattggcagtggcaatgccatgtttccttttatgtgcaagctatagcagttttagccccataattagaatcacttgtacctactacaatattcatgaataatttaacgattgaaactggtaaattaatgttctgtgagaggttgcaagttggatgagttcaggtaggattcaatttatgcaggaagtgttgcgtatttctctatatcaaaagttcaaatctaaacataaggtgatacttttgtctgttgggaattatatgttgtaccaaacccgggctaggctgtaagcagtgtactagtgtagcaagttacagaactttttccctcccaaaaacactgtttattttagagtcatgcattacaaaatagggagctacgtctgtgttgaaaactttagcagaaaggatcatgctgtagtaatagaataataagagcgatttaaacatatactccactataagtagtgtatcctagcagacatgggtgacgctgtaccaacagacatactctcatggaggaacatgagtggggttgaattcctggggtgtcagtgtcactagttcactcccatttttgcacaagcagaaaaaagtacatatgggtcaacagaagtagttggtagatactccaacaaggcctattatgttattcggccaagaatgacgttaccagcttaccccatcacaaacactcgccatttccacttcagaaataacatctcacacatgattacatggtaactaccactggacagcatgatctaagatcaaagaagcaggcatccaggagtatggccctgatgccctctgccttaaacacgagaaattacacacgcactgacactgacaccgactgtataagcactgggactgagtgctggtagtagtagttgtagtagaaggctatatatcgttgtgtcgtctagctcaactggaccgtgtagtgtagtgagtgatcacttcttgtgcgggctgtatttggggcaagccgggctgaagtgcttggagatgacgcgcgagttgagcagctcgatgatggggccgaaggagacgcagcgcggcgccttgtactggttgatggaggcgccgcgggagatggcgtactccatcacctcctcgaacgtgccggcgcgcaccacccggatctcgagcggcccgatggcctcgccgttgcgtccctgcctgtacacggcgttgagcgcctcctccatctcgaggcagcaccgttcgaacacgccgcggccctcctcctccgccggcggcggccacgcgccgccctcccgcaccatcagctcccagtacaccacgtagtgccccgggatggtggtcgcgtccgcctggctcgtgtactccacgatgctggcgccgtagggggacagcagcgcggacgcgcgctccaccgcggcctgcagctccgcctcgtccgtcttgtcggagtcgatgctgaggagcacgttcttgcggcggacgaaccggaactgcggcgccgcgttgtggaacccggtcacctgcaggatgtcgcccacgcggtagcggcagagccccgcgtaggtggtgatcaccagctcgtactccctcccgacctcggcgtcggccaggtcgacgagccgcggcggcggcgcgtcgcggggcagcggcggcgcgtccgggtcgtgcggcataagctcgaagtagcccatgttgggcatgatggtgtacgacacctccgacgggtcgcacatggggcgcaggttgaggccgaagtagcactcggacgacgcgtacatggtgcacgccatggggagcccaccgctgtagaacttgagcgtggggatgtactgcgccatggcgcccgtgacgatcacgtcgaggtacttggtgttgggccacatcctggtgatgatcccctcccacttgtccttcccgcactcggcctccacgaacgcggcgagctcggcgtcgggcgccgcgagcacctccgccacggcgtcgcggatggacggctccgtcaccttggcgctcagcgtcccggtcctgatgtcgtgggcgagctccctccagtggagctggaggaagcggatggcgcggaggaggcccgaggcgaagacggcgccgacgcggagcacctcggcgcgcgccacgaggccgcacagcatctgcgcgtacatggactggaacgcgtcggtgcacaggatggccgccgtcgggctcgtgtacacgttgtaggggtcgaaggggcggtgcttgaagtgatcgctcttgtagtagctggtcagcaccggcctcgccggcagcccgccgggcgtcttcgtctccgacttgatgaacaggaagtagagccccttgcccttgtccagccctggcacgtacctgtcatttttttatttaattacctttagttaatttaatctgagataaacatattaatcactagtacagtactatctagctataatactagtttactactacagtcattcagtcagctagcagctggttggttatgtcgttgaatcgttaagcaggaagggatcaacaatgatcatgcagtgtaattgatggcccactgatgctgagttctgcatgccggattaattaaagattcaggccgatgttgacataacctatgataagatatcagatgtacgaaagatttagcattgtgatggctaattaacagagatacaccggtggttgcaccattcctttcagctgggatacattaatgtgggattgacacagggcacgtaataatgctgataaaattttatgagcatgagcgttagtaccattaatttacgtgtgtgtttattcaagcttcaagctaattgaatggttctgaaaactccctttctcttagcttattttagcgcaacaaggccggtagccgatttgtcgctttgtttgtaaggttacactccaacttcctggttacgtatgcgagcgactttgagctgctacataatcttattttaggaagctagctagctatcgttagatgtcttacaaattagaaaaggaatctcggtgcctaaaaagtagagagacacccaaggcagcagcacctctagcgtctaagacacaaacacattatattttaggctcaacgtgaatgattaattagccacacctctcgcaagttgcggtgtttcttagccaaacccttgtgaggtcaccaaggctacaaacgcatgactcgctcgccccggtcattacatttcccaagtattatatttagcatatgaaaaattaaacgtactgtttcttgatcggtcgatggtaaagtttaaacggaaaacggttaggtttaggtttgtctctgtagattagattaattaggccttaaactaatgcatcgatcaatgacactagattaagaaatcatttctttcttttttattaaaagaagattaaaaattgcatgctagaaattaatacggctacttgtatcttagctaggtagcttcaactgttgccgggagtcaagaaaacgtcccaatcaaaggcatggtgagaaaaagaaaacagttagatggctaaagtaggataatggccagagattcagagatggatcacccacaagttcatgacgggcatgaggaggctgtagagcatctgcctcctgtccagctcatcttctatcgtcggcattagcttcctctcccccgccgaagtccccgagctggatgcacacgcacgccaattagtaagcaagaacgatcaaccaagcaacgaccaaaaactaatcaaacaattagttggagtcaatggcggagccgagccggcaaatgaaaggccggattaattgaaaaaagaaattgtttgggttagctagcactactatacacacctggtgaggaactcggtgatggggtgggaggagatgatgttggagcggtcgccgttggcgatgcgctcgatctccgggcggaggtcctcgtaggtgacgacggggacgcgcgccttgaacgcctcccggtcggtgcgcccttccatgccgtggcggcggaggtactcggcgccgttgttccgcgccaggatcgccgccagcacccgctcctgcaccgcgtcgaaccccctcgtcatctcctcgatgaactccagcttctccgcgtcgcgctcgcacgccgccacggccttccccgccaccgccgccgccttcgaccccgcctccgccgcagccaccgccgccggagccatgaatatctctctcccctaattagttggcgttgcttgccggctagcttttgctattttttctcgctcgcttaggcttagcttggagtgtgcgatgagaggaggcggttgcaagggaggggtatatatagcggcgggagggggggaggaggccgcgcgccatgcacgtcgcgcgcgcgcgcgcgggcgagcgaggcgggccggtgagggtggggactggggaggcagggcgtggcccacacgggcgtcactgcccgagcgaggagggggcacgtgggcccgcctggtcggccacgtcggacgcccgggccccgcgacgggacgcgcggccggcgcgccccggcagcgagcttagccatcggcgctgacgaacgagagctaaattggttttaattacccgaccggtcgggttgtgtagttgttcgtctccggattaatcaacggcaatttctcatctgatggagaaattaataagtaatatacgacatgaataggtttataaaaatgtattatcaaggttggacgaaaagaaaatggaaatccaggagagggggtgttttgttgctgcttgggtatgtgtcgacacagtagtgtgcagcgccacacctgaccagatcatcagagagaattatgtgctagtgtgagggtattaaggaaatggtaagtggacagggactgaaaggagaaatgggatttttcttccttaatacaagtgagccggcagctggagatgcatgcatggaacaagcggggcattgacggacaagagaatttccacaagaatatttgacattttagcattgtagaattttttatttgcaagtaaagtaatgtaatgtaagtttgaaaagtttctttatgctaggaattctaccctttcatcggtttaaaatttttcacgatcgacatcagttcaaattagtaaagtgatgactgacgacgggctagtgttccaaaatatccatttaaaatctaacacggctctaactaaaaatccatttaaaatgtgttcagtattacatatacatatacatacatacacacacacacacacacacacacacacacacacagacagtttactaatcacacacgacccacaaataggatcttctgctagctaattaacttcacgtcgaaatatagactgccgggctggacgtaattaatcatgtgaacgtgttggctgcatttgtcgactcatcttccatataagctcgttagaatataattagcaaatccttccaaaacctctttataaaattagcacgtcacaaaaataatttgtggttgatccacagggtacgtacgtatatatacatagtggtacttgtacggctggatagacctacgggctacagcaataatcatattatcatatatacatgtggagacaataatgtactaatccagcttgtaccgcgcgtgtcggcctatctatcccctttctgtgatcgcgaagagccaaacgtgttttacgtgtcgtccatcgaatcatccatcgatcgggtcgaggcgtagaaacgatcactatttcccgtgtcttgacttgtgctagctagtacacccaattattttcgttaacatcggttcaattaacgcgtctcatgaagtagtagctagctagctaatagctaggatacgatcgatcaatcggatcgatctgtcgatcgagttgttcctttcaatcaagttttaacctctcgtgagtcaattttggtggctagagatggttttgtttggttctgagcccccctgtaaggctgtaattagcagagtctgatcttttggccacatgttttaactgattttacattgcatttttttttcactgagaaatttacgatcggtgttaccgcgccggtccatttcgaggatctacagtaaatctgcgtgtccactgtactaggaggaaaacgatcgaatgggacatggtgacaggaacaagagcgggcgtttgcaccctcagccgtacagggaatggaacaacacatcaacctataatataaaggacaaagctaactagcgaaagagagagagagagagatcgagagcagaaatactgaaatacgtacacaagtacgcaaccccttctggccaagtgtacagtacaccacgtccaatttaacaggtcattcaggtttcccttgtcagaacgtcagtcttgaccccgagatcgatagagaccgacgagtcgtacgttcacttcacagaccgatcgatctacgtcgttgtatatcccaaatacgcgaactctccataagtcatgtcctaaaatataacaatctaatataaaatataaatattcattcgtaattactaaaatactttatgttacatcccacactaaattattatattttaggatataaaacaattaacaacactactatactacgtgttgggtactgtcattacacgatagctgctatagtatcagcaatatcgtgcagccttgtactactactaaaaataaatggtaaatttgctagtggaaatgtctacagtactgttgataaagtagcagacactgatatttagactcggactcacatgttattcactgctattgtatgagtaatattgcaaagaatcttgtatctgtaaatttatcgtataagtatgtttattattaaaaaaccgtataagtatgtttacgaattgacccaaccataaccttagccggcgcagacccacggatggatcagcgatattggcacttttttctcaggcgagtgtgccgtggactcgcggggtgggcggccggggcacgcgtggttctcgctcggtcgctcgcacagtcgcacgtacgtgatcggggccgcgcgatcgagcaagcccatatggcgcgcgcgtgcgtgccaacgtgccaagcctcgagagccgccgttctttttgcgcgcgtacacggagcgcgcgcgcgcacggaactcccgcaccgcgaatgcatgggcaatactgtactacttgttctcgcggggaacagcagggtgtggaactgtggatacagtcaatcgagtagcttaccttttggctttcgactctgaaattcagagacgggcagtactggtgattggtgaatatgtttctttatcaagccatgctattgctgtctttgcaacggaatacggcatggtctttgatgtggaacaggggaagactacagaaaaaaaaaagtatactggattgatactgagatgacgggagcaacatattaattcaaaaaggaaaaaaaaatactccgtatatcctgtacatacatatattgagagttattctcaatgaggaatgctctggtctacagttaattaagaactactctgtaaatgatatgataaaaaaagcgaaaacgacatgacctattttttatgtttgtacatttcttagagttcagatggcttgtttttaatgcttttatcagaaaccaagttaggttcttctctcaaaactgtggtagccagcacacaagagcttgcctgtcattctcgtttcatctagaaatcaagcaacggttgtattctactattatatctgcagattggtgaacagtacacatataatatgacacctattccattcccctctccgagataaactaaaatccagatcgagcaacccagcattaataaaaaaaaactaaaagactcgtcaactaggctagtttaattatctggaaagagacaagaggacgatacctatctagcaggaacggcgtcatgatcgatcgatcgatcgctctgcctgaaccaaacactagtattttcccactgcacctggtgtctgttggaatttgcagctagctggctctcgtccgtcttctctacaccaagtcaaaatctacaaacattattcaattctatacacgtagctagctgctgctggaagtatatgccagcacctggacgcacacatgcaaatccaagccagtacgacatgcatgcatccaaccatgtatccatccatgatccatccatgttgcattttgtgcaccacgtatgtctcacgattcagggtacagagcatatacatatgcaagcatgaatgcatcatccatgacacacaggtgacgctgaagtctgaacaggtaggtggtggcttctcccagtaatcccagtggcaattagtttactcggggggagatctgagacaaagatgctctgtctgcctaaacacaatgcgtgtgggcgattggcagaggacgacgagctacgcgaggctgccggttgcctgttctctctgctgcataagcaaggagtacgtatgtgcaacttgcaactagaagtaatacgagctaatttaagctaagctctgcttagttagcctcgagttagataggggggaatccccaacctcctaaacaagttaactacgctataatcaggagatttttttttaagccggcgaaaccaatggttagccggatgggaccggagcagcgagcgattcccttgtctattaatcaatcgttaccatgttacggaacatagatgtagctactccctccgtccaaaaaaaaaaaatacaaatcctgggttttcgtgtccaactttaaccgtccgtcttatataaattttttttataattcgtattttcattattgttagatgataaaacatgattaatattttatgcgtgacttgtctttttaatttttttcataatttttttaaataagacggatagtcaaacgttgggcacggaaataagggtttgttttttttttgggacggagggagtaggttgctagctgcctagctagctgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgcgtgaaggaatacagagagccggagagcgagagagagttcaggctctagaaccccttcgccagagtcccaacccccttcccttcttcttcttttctctctctttttaggcctgggcctcctttttatctggtccggggtcaccacatgggcctcctgctgcctaagaagggaaacatgctttttacaatgagggctagtttacagccggaagtgacatctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttggcacctaacccgcgatctgaccggtctgtgaccggtcacacaccgcgaccggtcacggaccggataagcgtgcgctgcgccgcattaaatgcggcgtggcgcgctcgtccaacctgctataaatgcggttaggtgagcccgctgggctcacctaacgtacagacgtggcgccaaagccacaggggtcggggcgccccaccctcggggccgaaacgggagcggcccgacccctcggggagacagagggagaggtggccacgtcaccctcgggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccggcggtcgcaaatcgcgcgcatcggcaagggaaaaccgaccgacaataatgagcggcctctttaagaccgctacattactcgagcagcgcgcgaatcgggacgagccggttcgtttcgcctggagacatgatgatgacgcttttcacggttggcgggcgtagttaatgcgcgcacgatctgccccatctcaaccgccacggccgcacatcttccgcgtgcgccgcaaacgggcgagtggggttagtggaggcgtgggcgcgagaaacgagggggcgaggtagtgggcgcgggaagcgaggagccgggcatagcgttggcaagggtgtaaagacgccaaggaagggattcgtttctttcctctcgccactcttccccttgccttcgccacttgtgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctgccgcgccgattcatgccggaatctgccaccggccggtaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctattccggtggttcttcaccgtacagccggtgtcaccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaagatcctggccatcatgcaggtggtcggggcgtcgggggagcgggccccccggggccacgaggcgcgggcgggagccgcagggggggcccgtccccccccgncgggcgtggtggtnncggcccccgcgacggcggcccggggggcagccgccctgccgacgcccgggggaagaggaagcaggagggtacccctcccccatctcctccccgagggggaggggcggtggtgccagcagcaggcgcccggagggtgccttgccgacgccgcagcccgagggggagcgaaagaagaaacggccccgcaagatgggggggatcgtgccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccccgccattccaagtccggtcggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccgccgggcctgggagtccgtccgggaggcagaggcggcgcgcgcacaccaggcggcctgccaaacccccgacccgactccgcccgaggcgacgatgacttccgaggccacccacgacgaggccgcgggcgcaccgctcgggcccgacccctcgggcgacgcttgggacgagccagcttcgggggacgcccccgagtccggcacgtcgatcggcgggccgagccgcgcggcacccacaccgagggggctctcccctctgccttccgctgccccactgagcgcggagcccctcctgcaggccttggccgccgcgaacagtacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagtccttgacgccgccgctgcccgagaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccacccgggaggcaacactggcggcgcacgaggccgcctgcgccgaagaggagtccgcactccgcctccgcgaggacgcgctcaccgagcgggggcgagctctcgaggaggcgaggccacggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtgtcccgtctagaccgcgccgggcggcaggcgggcctctggggcgggcggtacgcgaagtacgccgccaaccaggggggcctcgcccagcgcctctcagagatggccggggccctcgagcggctccccgaggagctcgaggagacgatcaagtcatcctcgagggacctcacccggggggcggtggagctcgtactggcaagctaccaggccagggaccctgacttctccccgtgggcagcgctggaagagttccctcccggaaccgaggacggcgcgcgcgcaggtccgggacgccgccgaccacatcgtccacagcttcgagggtacggcccctcggctcgcgttcgcgctcgactccgacgaggagggcggtgatgacggtgcggacgacagcgacgacgaggccgacgacccgggcgcgtcggagtgagcccccaggcccccgccaatcttaataacttttccttcttcttccgaggctttcgggcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcgtgcccaggtcccagcctcaaacggcgcgggtcggggctagtgcctggggagatcctcgtgtcgagactggccaggccgggagcacggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaatgatggcacagacacagtcctcaggaaatcgaaaatgcttttattgaaatacggaagagaaaaaaggtaagtatatgcatgtggtagcccccggccaaccctgcacgcccgggagggggggtgcagggttggcccgagcccgagacatgacacccgacccccactaggggtagaagcggcgaaggtgttcgatgttccacgggttaggcagctctgtgccgtcgcccgtggccagccgaacggagcccggccgggggatgccgatcactcgatacggaccctcccacattggtgagagcttgctcagtccagcacgcgtttggacgcggcgtaggacgaggtcgtcgacgtagagtgatcgggcccggacgtggcgctgatggtagcgccgcaggctctgctggtagcgcgtggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttctccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcagagtgcttattgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgtgcgccgatagagggtcccttccaccagcacgtagcacttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgttccatacgccgcacctggcgcacgtaagcgttcatctgcgggtcagagcactggtactccttacagacctggttaacgaccaactgggagtcgcctaacaccaggaggcggcggatccccagtccagctgccactctgagtcctgcaaggagtccctcgtactccgccatattgttggtcgcccgaaagtcgaggcggaccaggtatctgagggcgtctccgctcggcgaggtcaacgtgacccccgcaccggcgccctgaagagacagggagccgtcgaactgcatcactcagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaaaatttggccgagggggtaagacgtaactaccgtgacccgatgcgcctggaaataatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaggggccgcatctctagggcgctcttcgtccgagaggccacgcggggcgtactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggccttgggccgccgttcggctcgggggcctctcctccctgctctctcccgggtcgagtcgacacagggtggggatacgcggagtgagggttgtcctcgtcgcgctccacgaccaatgccgcgctgaccacctgcggggttgccgccaggtagagtagcaacggctcatctggctccggggtgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgacaaccagagtatgcatctagaaaacacaaaaggtcgcaccccgcggtggagtcgacaatctaatctatgcgtggcagggggtaagggtccttaggacatgccttgttaaggtcggtgtagtcgatgcacatccgaagcttgtcgttcgccttgggaacgacgaccgggttcgccagccactccggatggatgatctcacggatgaatccggcctccagaagtcgcgccacctccttgcggatgaaggcttgacgttccggggcctgccgccgcactttctgtcggaccggccttgcgcccggccgcacggcaagacggtgctcaatcacctccctggggaccccgggcatgtccgccggggtcttgccctcacggcgctcctgcctcttctcctcctcccacttcctcgtccgctcagccaaacttttgaccgcgcggcagagtccgcgaggtcgtggagggaggtgttgtgcacagtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccaggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgttgtaccgcatacaagtccgcttcttcgcctgggcgcggatatatgccctggaagttcgtggtgaactgctggcacaaatcctcccaagagtggaccgacgcgggtggtaagttcattagccaaccccgcgcctgacccttcagggccatggggaagaaattcgccatgaccctgtcgtcacccccggtggcctcgatcccggtcgtgtagatctggagaaactcggcggggttgacgattccgtcgtatttttcggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtgggcg

SEQ ID NO: 989 - DNA, 2422 bp, Oryza sativa
cccccccccccccccccccgagggggtcaggccacgtgggtgaccgcggctacccaagcctctagtcacgatacccccggccccatgtcaccgacactagctatctcaacgtacgtacgcatgtacgtttattttgcccattttgatgtgttctccaatcaaggattaagtggcacatgtttcgtcaagatagatacatactttgtctctgtcttaaaaaaaaattaacttctaattaactatgtatctggtcgttggtttattgggctatgtcccgtgtcaacggtggcagaacacagtagaggggtgggagcctgggaggcatcaggcgtagtactagctagctgcagcaatgacgtgatcagaacaattgtggttaagctaggcattggagctggagtggctaagctaattaaagcaccttctaattaatatctactactggttttaagtcttaattagcgccgtgtgttccacactgaaagcaaccgcggatccgatcgtggcaaattaacaaactcgattaatttctaatcaaagcgtcaaagtccaacggaagataggaattaattgaaaataaaaactctcgatcggactgattgattgattaattagctcatccgagtccaagcggccggtcagtgtacgtacgtgccggtttgttctggccccgtcacgatcagagttctcggtcggcaagcaaggaacaaagaaggggagaaagggatggggttaaatgtgcctttctggtggccctccaatctgctgatgtttgccgtttgcacgctcggatggaagtgttaagagtccaattcactttgatttagccttagtcttacacgatcatctctgctaaaacgaaattgatctaactagttttcttgtgaagctactgaagccgcgatctttattcttccattagttacaccgtataggaaaaacgggggtaccagctaggctaccagcttgatcgacttgaggtcgcacattgatcgacttgaggtcgcgcgctggtcgcagctgatttgtctaaaccagctaccactctatatagaggcaccatccacctatacttcaaatataattttctcttaaactactcatccgatctacgatccgattataccgttgtgttcgtaacaattaaatctttacaacaagatctcacatgattatattttgatgaaaaataacaaattacttttatgatatgtctaaattacttttagatttcactaagttacttcttagatatataaaagtaaattcagtaaaacctaaaattaatttacatatattataaaagtaacttagaacaaaataaaggtaactttagcatgtcatttgaagtaaatccgttgtagagataaaaacatgactctatctagaaaataaattaatcagcacaaattatggaattaactaaaataataataaaagtaatcacctcagagcattatgaatgtataggaagtattttaatcaaatctaaaagtaacatatatatatatatatatatatatatatatatatatatatatatgataatttgttcaatgaaaaaaaggcattaattaaagttactttctttctgttataagttacttctataatttaggtaaattacttttaggctttactaaatttacttttatatgtctaagaagtaacttactgaaatctaaaagtaagttagacatatcataaaagtaatttatgatttttcatcaaagtataatcatgtgagattttattgtaaagatttaattattacgaacacaatgatgtaatcggattgtaaatcggatgattaatttaagagaaaattttatttgaagcatagatgataggaatatttcccctacttgcttaatggattaataataaccaaaactcataaagtattaacacgtgggtgtctctggttaagactaattggagaggcctcttcaattagatttaccgtttctgttagggtagcgaagtccgccatcgacactggctggagatattaagtccctcgtagcgctatcaacactggctagacattaattgatcgagtgattagattttgggttttatcgcaaatgtcctctctcctctgtgatttatcccttttattcaagtaggactcaagggtttatctcatatttaaaatcaaaatctgtttgtggcattgaacgacaccatcaacgccattttctcctacccccctccactcttaattatgatgtaatccctatgtaaaccttcgtaactcttggtctcgcgtttggaatgaattcaggtgggaaaactctatccctcggtgatttggtaaaaagaaaaaaattgtttgtgtcacacgagcaaattttatctcttctcttcttattcggtacgggataggtgggccctttccgaacgatccgtcaacaacaag

SEQ ID NO: 990 - DNA, 13726 bp, Oryza sativa
atatatatatatatatatatatatatatatatatatatatatatatatttacaaataacaaaaatttgatattaaaaataattaataactaacacgtatataaaatacaatatgaatagtacacattagtagttttgtaaagttattgcaaaatttaaaattatgttgtcattttaatatatttgaataatataatgaaaaaatatatatgctattatatgagagaaaatataatgatactagccgcgcaatctgcaaatgcaaccgtgctagtttacaatgaaagtagatacggtgttatcactacattcttttagtataaattacacactacacatgtaacatcgtactcctacattcacaaatacagtggtggagtgaaggcccggtcaccatgggcatgtgcctgggctcccccgcattagccagtggattatcacttaataacagtgcctaatttgcttcttttagtggaggttacatcagcagctgttaagcttgctcgtgctcaaggaaacttgtaaatccgccactacacaaacacatctcttaacacacacgattaaagatgcatattctactaaaattctttcaagaaacacattaaatatactcttattaccaacccatgcatgtatacatactacttgtggcatcaagatttaaactctggaggtggagtcatatatgcacgcatgacttcgcaatcacactacagtattgatgtaagtatgatgtatcccatcaacccaccatatttaatcagtgttaatcacgcactgagatgtacacaagtcaagattaaggcgtaaccataattattaacctcattatgtatagtgttcagtatgcatgtgtcaacatggacaggtacgtgagcaccgggattggctgcagccgtgtgttcatgagcgcgacttatccattagctaattaatgatcgaacgaatgaggtaggagtagctagctaagagcacccgcaatggtaaagtaaggtgttctctataaaacatgtgcatctcagcaatagactagattaatagtaaaccacctcaatggtatgtctacatgggtatctatagctctctaatgcattgtctcgtttttctctatagactatctctaggttagtagatagctttgctctctctcttcatttaatctcttccaagtaggaaaatatgctgatatggatctcttgtagagagcctatagataaccattgcaggtgccctaaggggtgttcaattagttcgaaacggtagatgaaaaagctagtggttgattagcccggtagaagtcattcgcgtatgtcgctagattgactttgtggcagcactgtctctgctttcctgggcataattggaggttccctgaagtggaccggtacgataaagaagggtagttacagtaaaaaaatcggctggtctctcatcatgcctagccttttcagcgacggcgtcgtcactgatgagttgatttcattcgtagtgctgcaagctgcaactggcggtggttgagcaagacgacggcgctgctagtccatcccgtgcgtgaattttcttggcctatattctggtgtctggacatgtgtcgagtggtaattagtactccctccatctaattttaatagttatatttctaaatctgaaaaatttatttttgataggcatatttcaatccaacaacatatcatcttaatgactttctcggatttaatacatgactctccattcttccacatatgatttgctatatgggcattgagaaatgtaaatattaatgaatcgtttgtttacgaggaatgactattagcatatttaaatggatgataagtagaattatttatccttggtctgtgtgtcaagatgaaatatgactatcaaacgtagatggagggagtagtaattaacaagtgagacgatgtaacttctctgtgaattgaagatgatatatataggttgtatataatgtgtagtagtactccccttccataaatatttaatttttaaataagatttaattaaacttcatattatttgaaaatcagttttataataaaatatattataaaaccttattaatattacgacggtaatttttgagacaaatatattggtgtcgattttctatatttttaggcgaagcattaaaaaaattaattggtgggatctctaagttggactaaattttattcaaagtgatactccctccatctacttttgatagtcatatttcatcttgacacatagaccaagaataagtaattctacttatcatccatttaaacatgctactagtcattcctcgtaaacaagcgattaattaatatttacatttctcaatgctcatatagccaatcatgtgtggaagaatggagagtcacgcattaaatttgacaaaatcattaagaggataggttgttggattgaaatatgccaatcaaaaataaaattttcagatttcgaaatatgactataaaaaataaatggagggagtatttctttaaacccgtacaaggcttgcacaacgatatattagcaagaaaaaacagtttttataactgccacccactaagtcaagtcctaggggttaccgccttaccgggagaggggaagagcacactaggctaactaagaaagaaaggcaaccgatcagcttaaagcaacaaggaaaaagagaattcataaggaattctaactgccaaaaggaattcataagggactaggtttcgctacaaccaaagcttcccttcttgcacgatgtgattgaccatagtgttcaccgtgaaaaacatcccctcaaatacgccagtgtttatttccaacaattggtgccagtaccaccagaacgaaggggttgaaccctttccaattttgatcttaactgtaaccgccgcgagaggactctcaccatacttgaaacgaagcttctgacagggtgagagggaggccagtcctatcttgtactccgacaagatatggtgatttgttttcaatctctctgtagacataacacatagtacggtgtaactgcctatttcacggttgcacatttttggttggccgccgctaaagcgcaaggaaaaagctccgggttgtagacgcagggggaagacatcgagtcctcaaagaacgtgttgtaagcaatgttttaaatagcaggctaaggcatttagtgattagcttctcaaatagctatagcggcagctatagcgggctaaataaagatatagcggctaaattgtacatgagagtaaatagctagaacccttctcaaacagctatagcgggagatagcgacagctataacgagagatttaaaaccctggttgtaagttgaggtgacgctctacccatcatccgtctaatgtcagatgaacttatcttgaacagagtcttacattgagaagtcatgtactctatctcatgttctaaaaaaaaattgtactctatctcaaagtgtaaagaattaagagagcatccttatcgttagggcgttggtaacgtcaatagccaagcattgccagcgaagccagaccagagagaggtattgtcatgcaccgatgcacgcaaatcggcaaatgctatcgcgtcctgcatgtctcagttaacattagcaagacgaaccagcctctacaggctacaatttgaggtcgcattaacaaagatcaagcttggaccctgtcggcagacacgcctgattcctctacgctcaaagaagacgcccttttcattcctgcccatcacaactcccccaatcctatcgctagctcgtagcacggtatagcatccatcaaagatatccttcgatccacgcctagcggctactgtgtagtagctagcccatgtcgtcaggtccgaaccgaatcctgatcaaaacgacgccccgtgaaaacgaaagatggccgagcccgaccgtccgcatctagcttctctatagtagcatatatcgtgtgatcgatcgtgtccgatggacccagacacacggctaccgctacgtgcgtgacgcgccacgctacgactccgattgattcggcgcgagaccgatcgagctaccgagactagctaaatccacacacgcacgcgatgaggcgacgtacgcgagacgcgcgagcgggcgcgctgctatacggcgacgtacgccgtctaccgccgcctatgctacgcacgcgcacgctggcgctacgtacgagagatggacacacggaacgcggcaggacgtatcgttcacgtggcggtgtcgggcgcgcgatcgaccatgacgtgaagaccgaataccaccgcgccgccgccgcgggagcgcgcgcgatgttcgcagcagcgggctatagcttagcgcctctcgcgtgcgtgcgtgcgtgcatgcacctatcgtcgtcgtcgccgtgtgcatggacggcagcacgccacgccacgctccgcgcggagcggagcgcgcggcacggtctctctccggtacgaccgctcgtccccacgggtcgccgtcgacacccggcaccctggacagcgacgccttattaatttgcacgtctaattaatccaccatggtcacgacgacgaacgggcgagagagtcgtagatcgactcgctgatcagcatgcaggtgtgatcgaatggcttagtacattgtctctgattgtcaaggccactgagtgtacgtagtacgtagtgtatcctgttcctgactagtccacgcgtgaacggggactcaacacgtacacgtgaaacaacccccgagttgtcgatcgatcgcaaggtgataatcggccgaagcgtcgaatcctgacttttttgcagtggggtgagccagtgagtgtacccgtaccgatcgatcgaggcgagactaacgtagccggcctcgagcgaccgatcgatcttagagggatcggagggaggggacagcacggctctgcggcctcgggaccaagggacagcggcatgacaaaagcccgcgagggtctcctcccgggaaaatatccggtaaaaaataatacggagtatcgaataaatgaaaaactccgtggaccatgttataaaagctctctaaaattttaaaaagttcctattaaaataacatccacaaaatttcaagtcgtttctttcgcaaacgcgaaaaaaatacacgtcaatatattagaataaagccgaaattcagttacacaatacaacagccagagacaattgttaagggaacacaaggaaacgactagggaagaagaaaactctaaagggagtaaagactccgaaaccattgaccgaaactggcaaagtatcaaaagagtactacgatcctcccaacaagactcctagatgagcgacgcctacgcttgaccacaaccgacctttaagcttgatcgattcgaatactgcatggacatgcgagagaagaattgaaaaacctcaagttccttcttcctaagttgctaagacaaaatttcaaatccagactcaatttgttttgggagaaaaaaaaaacaaatgaagctatatattgggattatgtacccatgcattaggaaataggaaggtatccttcgcgtgacgattcgctccaccccactcatcctcctcatgccctcgctccatgacgccacgtgctcgccttggtcgccacccaatttttacgttgcaccgaacaccttctctgctatacgcgttgctcttcgagtgggaggggaaatggggggagggtggggggggggatgagggatggtgggtgaatcggacgggaggtcgctccgtgtcggcctcgtctatggcgggccctccgcagagagatgatgggaaacatcgttgtcatattcatttcgtgttgagggaggatggagagcatcatagttctaccatctccatcctttcttctctcatttctctcggctagatctgatagctaatgggtattggtttataccaatgggtaaaaagtttagtatcgataggtgtcggtctgttactaataaggtatcaactgagacctaacgggtatggttcagtatgggatactagatttaacatcgtatcaatatatctgatattatctcgaatgagatctcgtaatatagtacttcctccgtttcacaatgtaagttattctagcatttcccacatttatattgatggtaatgaatctagacatatatatctatctagattcattaccatcaatataaatatgaaaaatgctaaaatgacttacattatgaaacagaggaagtagcctccttccggatatttcccctcgcaccggctatcacccagccggtggccgcgatcgatggtggccatggcgcacgcacgtacgcgcgcgcgtgtgtggaccgagcgcccgcgtctcaccgcgtgacgacgtgggcgcggggagacaggccgtcggatcgatcaccaaacgctacggactctagctagcgccagcgcgcctcggctcgaccggggctgcccccacgagacgttgctgttcccgtcacacgtttggttccccccctccttggcctcgagcccctgtactcatccgggcgagcgacctcacgtcctcaccgcaagcgtgctctcgatcgatcgcttggtggtgtcgctgtcacacgaggtacatgtcccggtggtggacaaaccgaagtttgcacgttggatgcagacgggtagtactgtttggtggtatagtagatactgcagctgcaggtgcccaacagtaaagggaacagagttcgatcacgattttcatgtacagtgtatggacatgttctgctattgctatggccatcagccaataatgcgcacgtagtatggactaaccacgtatgagttttgtctaatactccaacaggggtcgttatttgattattttcgtaggcaccgaaaaaatatattatatttagtattcatggaagcttaaataggacaaactatgcatatgtggctgaatatcattttggagagtacgtgttcctgatccataactccatatatgctacattgtgcttaacttctgcctccaattcctactcttgctgaattttcctcctgcaaagtgcaaacaggcaggagatcgtattagttgctaatatgaaattaacaaaacttctaatttcatgcaagccgtcgctatgccaattactcatctctgactggattacgagattaattaacctcgttcttttcagtcaaagtctacaatttccaaaacaaaatcaacacacaaacaaattgtcaaagactcagaccttgaaataaacgactgcttatctctggtcaagaaatcgccggaataacaaacaaacaaacaaccgggaaaatatataaacaataaaagggagaatgccgatcgagctagctcgtgcattccggtccaaaaccgttggctgctcgaccgaatcacctaccgtgaaccagccgtcttctttaccttcaagccatctccaacgtgccagtatacaccttcatcagctcttctccccctgattagacagtacggctccctaaaaataacaacggtacgatcagtggctgacttccaatggtgatgtgagctcctgacctgtctttccttggctgccaaatctcttttgcacaaagctattgctggttgtcaactgtgttgactttgcatggttcggctaccttggtttcgtgctgtgctcaccactgtctcctgctcttgagataggcagatacatagtagcttgagctgtagtgtagtagacttttggcatggaagcaggcaggcatacgtgagagctatgttaacttgacaagtggctgcgccgacctgcttgctccccttatgtttcatgcttaattgctgtgctgtgatgtgcctaccacctcagaattttctctcttttttctcctcttttgtgctgtgtgatgtgtttaactcctttgtgtagttacctgtattctgaaacttcctcatgagcctaacttacttgatagaatcgaattttatgatcttttgcatgtgtaggtagtagcagcgatctcagccactgagactgagatcctgggagaaacatcggaaaattccttacgctaaccctaggaaacggacaatgcagattacagctgtagattggtgattttatctgttgcagactcgcagtccatgtaaaccacatagcattgtttgtccaagtctgaaacgatctcagcagcacaagtctgcacattagctcttgtgcctatttcttcacctattgtctcctatagagtagtaaactaattggataagtgaacttacctcatcccatccacaagattctctgtcagcctaacttgctttgtagagtagaattttcaatcttttgcaaccagacagcaaggatcatggtcatacaattccttacgctatcagttctggaaacagattcaacaattgcacggagcattgcaggccacggatatgcacaactgaggaaacattattgaggatttacaagtatcagggatgtgacaatgatcaaaagctgcccgtcgtcgaatgacatgagttgttaacatcacggtgaattttgtctaagcatgcgcatgcagacataggaaatggaatctggctgcagcacgccattatcaacctgatttgactcgacagcctgattgcatcttcttggctcggcaatcattttttttcccgaaacacaatagaggctcatatacacacgcgcatgctcggcaatcatattggaagagattgttcaagctgcgcataagcaggcatttcggtgccaatggcctcataagcaagaaaataaaggaagggggaaaagattcctagtacttgtgcatcacctacaacaaattgcctctagcaggcaggcagggaagctgcccttgctagctgacgaattgtcagctctgcaagtctgcatctacaaaacttatcaggcgtatacgagagcataaactcagagttttgtacatgtctcaatgaactgcacagcctttttcataaggcagcagtacactaaggcagcagtacaccgaacagatgctgattccgttgtctttggtttagtgtgcaccgaacagaataatatatgcattgtggaactcaggtgtcaccctgttttccagaattatctgcagatctcaattctctgttcatattatctaggtagcgctgcacagaaagtaaaaatctttttaggaaaacaaagtatgatagtcaatgtcactaagcagatgttcagctaaatgaactatgagtactggttttcaataataattacataatcgaaacaacgaagtctacaatgacgtcatttggtatttgttgtatgtacctggagtatgcaaaccgcagcaaatttatctgtcattgttttggtttcaactgggtcatgtagtttcagaggatgtaaaagggcttctacacactggagacataaacagatcaatcaaaacacttcaccataaaaaagtacttgaaaagtaggataaaatggtcacatgagtaatgcaccccatgctaatatgtagtttcatgtttgagagataatgggcaaaaaagtaccatcaccttcgaggtaaaattttcatcccaataggtgtaactcatatcatcaagtttcccagttttacagagctctccaacaagaagccttacttgtaatgcctgcttaatagaaaaaggaaacatcaccaaacatatagtgagaaaatgaggtgcactatcccaggctcccagcacaagagcactttacatttggactagattgaccctgcaagttgaacggatagccgacaacaaagcctgcaagggagtattttgagacctattcacaaaaacaaagaaaaggaattggcttccatgtatgaaaaatagcaaaacatgagtgcttttaaatgttcaccagaatctaaaatgaaagaatatatgcatcatgagctgtctgtaacttctattgctaaatcatttatgatttctttgtggacaatgtcaccctcgagtattttggaaatgtaaatgacatgagtaaattgagcagtaaagaacagcatattagagaaggcctgtaaccctggcttccataaatgcatcgtaacctcaacacacatgctacaaaattgcttgtgcagtatgcaggcatgcgatgcagccatgcaggatgatgtgacatggcacattaagcactcgatctgatgtaggatgatgttacatggcatattaagaactcgatcttttggtaagtgattctacaatctgattactccagaatttaaatgtcagtaaacatattcagcataccaaagttacgaaatcatccgccatcaagctgatgtttgtctttgtcctgctcaatacactgtaggagacaatgcaattgttaatcccaataggaaaatccatttctttaagggaatgcatgcagatcatatatcccatcactaaactatcatagtattggccacaaaaaaccaggtaggcaggtggattgttgcaaattcaagagagtcaatatctgataaaacaggggtgttatcctgagataaccttatgctagcagtgcagacaatgaccacaaaattctagataaacgcatacttcagcaaatctagatccactctgtctgagtgcttaggtaggtaaaaggatatcagctttagccaagtgcagtccgtccatcttaacaatggtaagtgaagaatttctcgtgaagaaaagccttataaggcttaaatatgttaaagactaatatttttaaaaataataaaggtacactatgatagtagggataagatcttgtgtatcgatatattgtaaattgcaaataattttccttaaagtttgaaggcaactacagttattttctaacaaaccgaagtttagtatagtcgaattaatcaaagagaaggacctaatacaacagacacagcacaataatagactgtcttacaaaagccagagaccatacaaactgaaacaaattctgatagttggaagattccaatccaacatgataatgatttgaatgaagtacaacaaaaaatgccgatccattgaaatgagttggaaactcaacattcctactaatccatgagaggaatggaatatagaaccgcctgcatttaaatcatcacatagaaagtgatgttctaatttttatggacacactggaatcacttgtgctaaatatgttctggaaacatctcactatctcagtgaaacctttggatcaaggaacacaatattcagctacaatagtttgaagtgcataccttagaggcaatgcgatcctatttttgtcgtcggaaacagccagcccaacatacttactaccaacgtcaagcccaagcagtcgagattgctttctccacccgccgtcaatgactttcctgaacaactgatccgctttcaacagcctcattgtatatttactccaatttcaactgcaagcacatgaatcaacaaggggattgaattgaatgacaactgatgccacgatttcgacggcatagattatcccttttaagccagaatcctagaacagtcagagacaaaaggtaaatactaacaggaaaactagtactgaatcgggcacaaattaatgctcaaacaaaatgcatgcataaatgcacaatgctaatgtacaacagcataacactgtcacccgcttgaacagatgcaagttgaatagtagcacatacacacaaaattaaaacgtatacgaatctgagctcgtagtaaaattacaaaataacactgacctgcacaaacacacacacagacgggacgagccggcggcggcggcggcgcagcgagccgagagcagacacacgatcccggatcccgaacagggaggaagccagagggcgaagctcgcaggaacaggccaacaaggaagcgatggagacacggcaacccaggagcccgcgcgacggcggcgtctagccggtgaccggcgagcgggatgcggcggtgagacggtgaggtcggaagggttgcggtttcgtgccttgctcttgttggcgacggatcgggccgagcaggtttgggccgagaatttccgcgagcggatggaaaagctttgatgggccggagcggcaggcgaagcaccggcccagcatttctgggcaatccagaagtgccggttgccactgaacagcaccagattcgcctctccctcccgaggccttggccggcgcgaggtcgaggagaggaagctcccatggcggaggaggcggcgcaggagcagcagacggaccccgccgcctcccgccccgtccgctgcatcgtcaaactcggtactcgcgcgcgctccgtcgctcccttgtttcctctctgctcctctttagcagcttcgatggcgcaggtggagcggccatcacgaacaagggagagctggagagcatcgacgcggcgagcttgcggtcggcgtgcgcgcagctgcggcaggccatgtcccacggcggcgcggcggggaaggttgtggggatggactggagcagacggcccggcgatccgaccggcccggtcgtggatgtggagggcttgtcggagatgggaggcttggggctcgactccaacttcgtcgtcgtccatggtgccggtatgcatggctcctcatctgaactaacaactgtgcctatctgtcattttgtattgctgatgagttcatgagcagaactgggggatcggtggtcggttgggatctggagacgataggatcagcttgattgctgtattttggtttcagaatactactacggctaagtgaaaatttggtgcgaaactgtgaaccaagtaccattctcaatgtgtatcaatgacaagcaattgtaaacattgttcacgacctgcttaaccggtctatattcggaacgtagctgaccttcgtggaatatatttgaataaatctgttttgattggtagacaccctgaaaatatagttttagatcatagaccatcgggcccggcttttatagaaagccagaagcggcacagtggtgggggagacccacttacaagagttcagcacaaaaacacagaaacagggcagaaaccaaaccatgccaagggatacaaaggggttgaagctaagcgaccaaaagcaaaagacaactcaggcacctctaaacaactcaacagataacagctaaccaacagcaccacagaaaaagcatcagtgcttaccctactccagctctgggaggaccaagggaggagactgcttccataagtttgctagccatggcctccagcttctcagcatccttcctgcttaggactttccactgcatcaataaagatttgatttgaaaatgtagtcctaggcaaccaggggagaataaagaaaatagctcacacttcatgatgcctgtaatactggccgactataattggcctgttgtagtttaaaggatacagcccacgattttggtggtgtaatagctgactacctacatctgctacctcagggtcttttggtcacttccaagcaagtagatctggagtccataaagggggtcttcattcaacacttgtgaaggctggctttgtggctacaagaatttcagtaaggctagtttttgaagttctcctttcacgttcatattataatctatattttttttctccatcttactttcagagatatatctttgttgcccagtatatcgtcaacatatgtagtgcttctttgatgcgcatgcttgaaaaataattcttatgatctgcatattacaattcaggtcacttctctcaaccaggagattgttagagctcttgcaag

SEQ ID NO: 991 - DNA, 9838 bp, Oryza sativa
tgatcttgatgcattgcttcagtctattgctgtcggtttatcatcagtagctaataattaagtaaatgtcttttttgaactgtgtatgattttgtagaaggaataccgtctgttgggatgtcaccgtttgcttgtggatggtctactaagcaaagaaatgtgagaaagcaaacaattaactaaatttcttctgtttctttggacatggacttgacattgcaaagttcttgaagatctatgtctaatcctatcaacagagatgccctttgattttttaccttccagttttgcacttacagcttgaatcagtggatgcttctcaaatcatgctatcactccatgttggctttgtccctgtaagttattgtacttcataatcttgaataattatttctctagaatttacaacgactaaagttttatattaagtaatgtagttatatgggtcacttcttatgtatccatattgtaagaaaaatatggcgtttctggaatatttatgtagtatgtaacatattcattacacatgttatgtgcactggtaattcttctaagttgcatcctattttgcaatacattttctataccaacttagctgagattttgtactggtaaataatgaattagttcagatatttgaacatactatgagtaaacttttgttcaggaaatgtttcaagaatagggaaagcattgcatacttccacagctctacttatgttttcttcatctacattaaaaagaacataaaaaatttcttccaggttttgcatggagatgctgttcttgatgaattgctggtgagcttttggattgaatcacgcccatgtcctaatttacacttacatagaggtctctctggactatgacacattttgtgtacttctcaagacttatgtggtataattaaatgaccaggactgcaccattttgagtggggatgtcattatacgccatcttgcacagcttctgagtccaaaatatgttgtatttctggtattgctgccttctcacctttgccatgacttgacaatttatattatgtatgtgagatggtgcgtgcatcaaattatttacatggatgaaatgtctttattctaatacttgaagttcgtattgctgttatcacttatcagacaggccttgttctatcacatttctgtgcaccactctttgcatatgttgcccatccttcattatagttgcttttgcatagcactctgaaaattgagatgtagacagatgtccatggagtatttgatcgtcctccatcagacccgaatgcagtacttctcagagagataggttagcattcagtactcacctactggaattcctgtttgatatgcatcagaaattgtagggagcacacgaaaagtaaaagatatgcaattaccatttgctttctgtcttaggctgacctgtgttgtttgcctgtttaaacagcggtggatgaaaatggcagctggtcgattgtaaaaccagcattgaaaggcaacaagaaaggaggtataatttatgtcttccttccatgtgtacgctggtggttgagttactcatagcagttgtactgagtaactgatgcaactattttcgttgtaacaagttcaagtacataaaaaattatcagatcgtaacaggcacatgattaagtagctaccggtgacgatttttcaattaataacttctaatgaacaaatacatcatttgttcttacgcattatgcagagaaaattggaagtctcaatgatttggatcaaatactatacttatggaggagtgacagtttgaaatatgagtattgggatcaaagctataatcttttaagccaggggctaatgaaattcatgataaagacacactgttcttttgaccagcataataaagataaactgtatgttgtagcttgtgtaatcctaacaaagataatctgatatgcattgcagtggagatatctgtagctgcacatgacaccactggcggaatggagaccaaaatattggaagctgctgcgatagctaggcttggagttgatgtgtatattacaaaggtctggtaactttttcctcccctcatgactttgtgtatataaaattttcaatgacccttttttttcctttttccgtgtgacttctgatgcaggttggtacagaacattcactgagagccttaaaaggggacacgagctcagaagattggcttggaaccgtcatacgatcttccagatagaattcttggcctatcattttcgggagtaagcatccattggcaaatattttatcaccattattgtaggacgattgtgaagctatgagctgatcacctgtcaaatgattcatggggttattattgctgaatctcatagcagacaatgaggcagagctcggtgttatgctacaagtaacagtcctacgacattataataagtaaccttattttgtttgctggaagttcacttgaccatttgacctcagaaacacaagaatgattcgccatttatcccgttacattatgttggtggaaaaagttctctacgttcatggcataaaaaagaatctttttttttccgaaaaaaaaaattgctgccggaagcttgttctgctaccgaatgacccagcctaggctgtatgccttatcctgaatgagcttagcctggctagccacatccaacaggcactgtttgcttgtctgaattagttaagccaggatggcccgaggttggttgaatacaaatgcatgcaagttggagatttttgttggttgtctgtatatattttgagtgtggtgaaagataggtccctcttgatggtaagtttacccctatagcttacatatattcttgtgtgtgtaaattaaactactcttaattgtaatatatacatgtgatattggataaaacctgctagaaacaataaaaactaactgatacccttgcattgctacgggatggttgtgtacacatcaatgaatttgaaaagatgtacacgctataaaaaaaacgaatgggaaaattatgatgtttagaggttagcaatagaacaatatatatattttttagatgaactgagttaagatgagatgtagtacacacaaaaaagatcaaatcactatttataatatttagaatatgaattggtatacttataaactgaaaaaatgctattccttttctttgttatgttcttatctccaaactaatattatgaaacatgtcaaacgctcattccatgttttcgaattcaactttaaacaggaagaactattgaaaaatcttgaaccaaggcttcaaattgccgttcgaagggctggtgagaacaaacggctacaatagatcgatcgatggcattttcaagcagaaagagaggaaaaactatatggttttgagtactgtcaagaacgagggctcaaagatatctatcatgccactgtgccataagaaattaatgaagaaataaagaaaaatatgttctagcacatacactttgtgccgtagcaaatgaaatagatgttcacaaagttcaaatagatactaccggccttatcttttagcttatgcttatatttatcagccaaaatatgcatttcaaccttaaatatgaagtttattttgggatttttttcatcgtagtttattttgtaggctttgctttttaaatcgttaagaatacgtatataaacgttatattcacaaattatttttatttgctaatatgtcatttgcttatgcttataatcagccaaacgatgtcgccctacttgtcgcaaaagaaggatccaccttctttgtactcatgaactcatccctcgaacaacatcagacattttgtacctaatgcattacagtactaatgcattacagtactgcacacgaataagaaaaaaaaaagacataacaaccacactctattcttaaaaaaaaaaaaacttaatctagaagggaacgtgacccttcctaaagcaacgaatgggtttttttttggaacggagggagtaatgtattgtatgagggtctcaaaactattgtattgtatgtacgaggcaccaggcgcaccagcacaacgcagtcagcgcatctctgtggcctcggtcactcggtgcacatctacgctggagtgctagacactaacgtcgggcccgtgtgcccgtgtccctaatgccaaatcggtggtccgttgccatatctgacagccgtgcgcctgtgctcgagtgcccgacgagtgtgaagaacaggcgacgagatgagcggggaaccgcgttcctccttttgggccaaaaattgtagggataattgcatccatgccctcactttgaacctcaactgctgttttactcctactttttagagtttgcaattttgcctcatctttttgaacatgaacccaccgtttgccctcacttttagccccgttagatgggtcccacagttttgggttaaaaatgggcctgttcggtggcactgggtcccacaaagagaaatagaaatttctttttatgaaatattaatttactgttgtacccttcaatgaatggataaggatcgagaaaaactatgggatggtgtaccgtctcaacggtatagtttataatttatacttactaatcactcaccgattctttttctctctgaaagcgtgtcgtgtgctgtcctttcacatggaggctaccgactagtgatgactgacgagaggtctcttttctcctacaatacaaaatagctatgaaatactctaatacagcactacttctacacctctttaggtccatatgggtctaacacctgcttcaactagtaaagttagaattaagcactagagctagtagcattagcctaaacaaagcatgtcagcagcacgtgagcaagtttggctgtactttctggcctagctatgcatggtccatctttttatttgactgttgaatagaagtatataacccataaatattagaattagtggtatcacatctgaagtctcgtatcatcacaccctatatttggtatcagatcctctactaatatgtatcaacccggtatctaggtattggatccagtactcataggtataagatcagatacccgatacccgggtatccgatctaatactcataggtatcatgcgcgataccggatccgatactcataagtatcaaacctgacctaggtattgaatccggtactcataggtatcagacccgatacttaggtatcagacttggtattcataagtatcatactcggtacctgggtatccgacccgttacatataggtattggaacaaatactcataggtatgagatcagatacccgatacccgggtatccaatctggtactcataggtatcagacaccatacctagttatcagatccggtacttataggtatcatgccaaataactcagcatcagatcttgtatttataggtttcatacttggtacctaggtattcgacccaatacctggatatcatatatgataatctagcatctatgtatcacatactagagtttctaagatgtggtataaccaagagcccaacatgacatatctaattagaataatccattgtatccatgtataatctaggtaattatttgtccggtctaatccgtgcatggtataggatacaacaaatagatgcaacccatcttagacacatagctaggctactaggctcctccataataagtaccctacatagctagggtacaggtctactagtagctattacagggatttggcatgcacaacaaccagctaggctagtatcaaaggcatgacttaggcatgctaggtactagctagctgtcaggaacaagactatacactgatacacacagcaaacctgtgtgataataatcctagcagcatgcgacatactcgggagaagccggcacgtggggtcgcggcatgagggataagtggtatataccgttgtgtagtctttctcataaggatccaagcaggcaagcacagctctgctcaggtcaagcaccgtgcagcgacggcgaccgttccggcagcggcgtgcgcggctccggcggcggctccggcggaaggcgcggtgatggcgacggcgagggcggccgccgtggcgagggcgggcgggcggcgagagcttgcacgcggcgcggcggcggctgcggcgagggcgggcggcggcaagggcgtgcgctcgggggcggcagccgcggcgagggcgggcggcggcgagggcgtgcgcgcggcaaccgcgtgcgggcgaccgcggcggctgctgctgctgctcccgtggccgctggcttccacgccgaggcatggtcgtcagcccccgcctccggctgcccccaccatcgtttttgctgctactgctcccgtggccggcgacgactccatcctgctcgacgtcgacgtcggcgcctacggcgccctcctccccgtcccttgttccaggtcctcccctgcacgatattgctggatgcagagggtatacatgtccctaaaaagtgaagataaaacagcaattgggtttgaaagtgggggcgtagatgcaattgccccaaaattgtaaccaaatcttgatgaagggaagggaaggagaaggcgaggtcagagaatcctaaacgttcgctggttcttggacggtcagtttcacccaagtgcttaacctgcagtcgatgcactcctgatccaggtcacacattctatccggtatcccgtcgacgaccgccacactttgagccagtggtagttacggccgagaagcgcgcggccctccccctttcttccccgttcgccgagactcgtcgacgcttccccgcctcctcctcccaccgaagcgcgcgccgcctcggccagaaaaggtatctatccttctctccacgctcgctacatggccggcggcgtagaccggagtcccattaggatttcttccttctgaaaagggttggattggtttcgtttcttcggttggtgatgaactgtggcttctttgattggtttcgtagcttttttttttttctggcgttttatcttgctgcgggcaaccccttacctctcccgtataacccattagtttttgaggattttgtttttttgcgtgatagtagagagcactgatagatattactcgaaacaaagcgtactggtaggttctagcactttattatttccaaagagtttgagggtttctttgcttactcgcctggaccacgttaggtgcgatttaccttcaataattcagaatagattgatcagtatctacggacaaaaaaaaaagaagatagtaaaatgtttattgcacatttacgatatggtagggttccaggcactacttgttagtttgttagttaatagtagtttgtaattatttagatgccacaattcaaagcctttcttagttacctagtgcattttgtactagttttaagcaaaatgtttttgttctctgcgcagctggagatgccactggcttgctgattgcaactgtcagtgtggtgattggactacatcagttgtgggaattgaactggtcaaatctcataccaatacaatgcaaggcatttttgcatgtggttcaatttcctcgccccatggatcatgttttagaccagcttgtcttgcagtggatgatctgaggttgttttacaaaataaattcaataacatgtggagcgtactcatggcgttggtgtgtgaaaaaactacatatgaggaccaatagaaggcaaatgggtactacagtgagaactaacgctaaatggctatttggaggagatgaccgtagcagtagtaatgcaaggctggaacgcagtgagtctgctaacgaagacatcttaatcttctacttccaattggacctacaaacccgaatacaggtgagttgttgcttccttaccatcattttctaaagcaaataaagttaccaatccagccggcaacgattcttttttcacggatcaattccatagactagtagcaatcggctaatgaaatctaccatcatgataattgcatcattcttagttgctggctactggtccatgcaaatgtttgatacttatctatgcacgtccagcctaactattaatttcttggttcttaccagtatgcattgaatatagagcaatttgatgtggcaaaacaattgagggaaaaactcacagaggtaccaaatgatttcacttgaagataaatgaattcattgtatgaggcttgctaaagaaaatatcctcgtctagattgaaacagagataattaggcaacgtgaagctaaaagaggctcatcaaagactgaagctcaggacaaagctataaaccttttacgcgtgcggtatgttaatagtttccatttctccatgatgttccagtgttatgtagcattggttcatttgagagatcagtagatcacttagctttatccatttgtttcagtgcggatttgcaaaaggctgttgacagtgaaaattatgctttggcagctgcactgcgtgatgaaattgctaaacttgaggtacaacaaaactgtagtgcaccgaccatgtgatggtaatgtgttaataacatattaacttcaaacatcatgtagacagagtctctggcagtctccgctaaggcccttgcatatcaaaatgtggaatatgcatttcgactagggcagaaagtacgtcataaggtacacggtgagtactgctatactacctacttcgtattgttgttcacacattatttctgaagctgttcagaaaatggataactactacaatttcttttcaaactttatatgaaaagttaatttttcataattgccattatccttaaatggaacatttgcatgtgttgaagcacactttatatcaaatattaacttcagtgaacacactttagtttctcttcttaattttacatgataacatcacctgctgaaggatatagagctgtgatttgtggcatggatcctgtgtgctgtgaatccaagtcatggatggagacagcaaatgtggaaaacttgtccaaaggaccgaatcaacctttttatcaagtaaatgctgcttgacttattccgatttagtagttcctcaatgcccatagttcatagaaatatcatttccttcatgtagcatcagttgtgacttatctatcatggatggcgattatgtgtaataatacctacctgttcttgttcttaatttgcaaactcacttatggagttgagatggtgatattcatcattgcctttttctcctcccttttggattttttgggtataatcaggccgttcatgatgcaattttattagcctgcaattgactgtttctctatgcaattaatgctttcttttggacgatagtgcccatgcatactgaattactgatgtgtttgcataatttagtcttttgagaattgagatgcttagtgatcctctgtgattcattgctgaaatcttgcaggtccttgttgatgtatatgctgatccagaactccttgttgcatatggtattgatttttcttttccactattttgatagacatgaccactggtggaaattctatcttgagatctgtaacttttaatgagcaatcttgttttgtgtaaaatggcagaagaaggcaagatagtaggctatgcagtagtcaattgatcaaatccatcttcacttactgttttatgcctatgctgcgccattttgagacatgttatgtctgtgtaatttcagttgcagaagaaaatcttgcagaagctgaaatatcagagaaagtgagtttgagttcttcatttgcttggtggttttcatttttggtcaaattgaactaatgctgcccccgtttataaatagggaagatttgatcacccctatattgaa

SEQ ID NO: 992 - DNA, 2708 bp, Oryza sativa
aggtgagcttttcacttataatgaggcgttcgtttaattggcaagtggaccacgtacttaatataatctgtccctgcgtgatacattcaggtaggcagcaagagttgttttgatgccatttccgatgccttaccaccgactgaattccgaaatgatgaaggagcttgttactatctgatgtaaccacagcgggctaatgtcagtgaagactggtgactgggctaacccggaacctgaacaatccacagcaatctgcaatgaggcaatctgcatttgatatactgatatctgaccttgcagattcacgattgagggtgacacccatatatagtggccaatccatgaagccctttacgtatacggttctaaagaagatccttatggatttgcaatctgtacttcccctagttcttctgtaactgtgttccctctgatgggaattttgtagataagctgcattcgtcaaacctgcaactctgcagctggagaggaagcaaagggttgacgtacatctattggaaaattggaatttacttccgtggaaaactggaaaccacagaattttctacgctcagggaaaataagaagggaagaccccaaaaaaaaaaaagaaatgctccggcagtgttggtgttgctgatgttgaaatgccgctttctagaactagataaactctgccgtgcctgagaagaagggagtgcaaaaacgtcgtagaatccccacttgcacgaccggctgccaagtcgtcgtgacagggacaaccttcccacgtttgaagcggcggatatcgtcaggatgccatgcttttacatattggccgtgtttaggccgagtttaacttttaacttttaaccatttcttcaaacttataactttttcaacctatcaaaactttcctgcacacataaatttccaatatttccgtcacatcattccaatttcaaccaaactttcaattttagcatgaactaaacacacccttagattcaaacttttatcttcaagctttcaacttttccatcacatcgaatgcttggacacatacatagaacattaaatatggacagaaaaaaaactaattgcacagtttgcatgtaaatcgcgagacgaatcttttgagcataattacgccatgatttaacaatgtggtgctatagtaaacatttgttaataacgaattaattaggcttaatatattcgtctcgcagtttacagacggaatctgtaatttgttttgtcattagtctatgtttagtactttaaatgtgtgtctatatacttaaaaaaattagcacataaactaaacatagtgtttgcacagctaatggcctactagcactactagtagtatagattccgttgtgttagactagttgcttcttaatccgtacccctatgtctaaaaaagccaatcctaacgacaaacatggagtggtacacagttgtaggggtgtagcggctaacctatgaactaatttataagtcaaaatagaacaggttcatagtttattttaacttaaattaagtttcgtggactagtactacctccgtcctaaaataagtgcagcagtagaaatccgtgtccaacgtttgaccgtctatttgatttaaatttttttaaaaaaattagtcacacataaagtactattcatgttttatcatctaataacaataaaaataataatcataaaaaaatttcaaataagacgaacagtcaaacgttggagataaatagtgtaaaactgcacttattttgggacggatggagtaactaatacccttacacgaccagcaaaactagtgtcgttcacatggtaggagcacttttttatttgaggggggatgattctaatctctcactctcaagggaatatgctctcatataattttttttctcaagtataattttaaataatttaagaacgagtatattaaagtccaccactacaccaaaaatcatattcaaattcaatctacacatttgataatatcttaacgtgtgggttgagttttgacttgatttttttaaaagtagtttatgtctatatcataaatgttagatagtgttttaataaattagagggcatccactcgaagaattttaaaaaaataaacggagacatcaggagtttaaaacacttttcatgtttttggtgcctcttgtgttttgtctcagttgacggtagcagaaactattcagacctggacctggccattcgtttccgcctcgcctcaaacccgaggcagaagctgacgcgtgccgtggtgacgagcctcacgctctcccggccctcctcgcgccacacaccacgcgccgcaccgtaccccacaataccaaccccgtaaccccgtggtacgccgtgcgcccgcgccacctcacctccgccgagaacacgggagcaaaaaagtgaaaaaccccgacacacctaacgtcctcctggtaccggcaccgcccccaattttcgcagttttctcacgccggcctctctaccggacgagacgagacgtcgggacgttttaagtccctatcatattaaatatttaggtactaattataaatattaaatatagacttttaataaaactcatccataatcttagacataatattgaactaattcgcgagacgaatttattgagcctaattaattcataattagtctatgtgatgctcagtaaacattctctaattataaattaattaggtt

SEQ ID NO: 993 - DNA, 3192 bp, Oryza sativa
ctctgtttggcgttggtggtgtagtagcatatagcatcttcgtctgtgcgatttgtgcattagtgctttgcgaatcgagaccgggttagcgttatgctttaattgatggattcatgaatcgtatactatccgattcgaggtggtctctggttcggaagaaaaatgaggaatggtttgatgtcgagttgatggttgagaattggtctcctagttgggaaatattttctctcaaatgatttcttaacaacatggagttgattgtgctaatgattgtgcttgccagctttgacttaaagccatactgtagttttgagttttgattagttgaatccatattatggttttaatcattgtgtgatgccaaggatgcttaaacatgtaaatttcatgcaaggtattttgccatttcgaccaaaaatcgtgggcagctggtgacttgaccaaagtctttgtgtagaaaactcaacaaagggtgaattatttttcttgtacgactgctgtagtatcaatccctgaatcgcagcaaaactttctagataaacatgtgcaccttttaaaagggaattgacttggaaaccaaagaactttttttttctttgcaagggacaaataacatattgataacctggttaagtcattatggcactcctacaaaacctttttgtgttacatcaaagaaattaatacttttctcttgtactttttgcagggaggagaaacagaggatagatcaaagtgaaatactgaccttggacaacattagaacctccttggttaggcaagaagacagcatcatattcagcctcttagagagagcacagttttgctacaatgctgatatatatgataaaaatgctttccatgtggatggatttgatggctctttggttgaattcatggttagagaaaccgaaaaactacatcaacaggtagagcagggttgtaactagcaatataattgttcattgtatgccaaaaattgcaaaatgttgatggttctggccatcttgtgtaggttgggagatacaagagccctgatgagcacccattctttccggaggatctgcctgaaccactgttgccacctctccagtatccaaaggtaatgcataaactcgtgttcttagacatctagttcttctctgtaggctttcagcattccttttgttagtataggcaaacatagtccttcattgactaatcactaatatatcaggttttattatttgggtttatgcttgcctctctctccctatctctctctctgaactgacagtagatgaattggttatgcatcttatgtattcgtagatgttgaattcttctgtgtgggcttgcgtagcttcttttgtcagtgaaggcaagcatgtacctttgttgactgaccactagtatatcggttctgtggtgggatatcgtgcttactgtccacctgcaacataatacaacttttgatacgaagtggagtaccatctattgagactcacattgctaattgattactgtgctgttgtattgttataagtaaatttggataaaattcatatttttgttcttgtcttttctaggttttgcatcctattgctgattctattaatatcaacaaggagatttggaaaatgtattttgatgagcttcttccaagattagtgaaagaaggaagtgatggtaattatggatccagtgctctttgtgacacgatctgcttgcaggtactacagttagtataccaaatgttctaataatctggcctcgtactgcttctggctactgtgctgtagctttcatttgctcaaaataatttagcattagcaaaataattcttgtaaaaccatttcttgttgtagtattgcttcaagatgttctgctgccagaattttcaccagatgtcattttcatagtattagtactatactgttgttcactggtgactcgtgcaattaggcatttttatattgggaaattatgctcacctgttcttgttttcctgttctatcatccaggcgctctccaaaagaattcactatggtaagtttgtggcagaggctaagtttcaagagtctcctgaagcttacatgcctgcgataatagcacaggtttgtgttctgttttgctgtataatctgtctttatcatgggaagcaaataaattccatgtgttttcttgtacattactttaggtacatatcaaagttgagtctattatgcaagcggctaattatttttatctgggaatttcaggactgcgatcaactaatgcacctcctcacctatgaaacggtggagcgtgctattgaacatagggtggaagctaaggctaagatctttggacaggaggtggatttaggcgggaagacaacggcgctccaccaatgtacaagataaggcccagtttggtggctgaactgtacagctacaggatcatgcccgctcaaccaaggaggttcaagtagcccacttgctgaggagattggattgattgtttacgattgtaaactgccagcttcggtttcctggcatcaaagaataaattaggggaaagacaaccataggtatccattttgggacaactgaaagaaaatattttattcgggtttacactatattttgtggcaagaacaagcagaagcaggatatcacatgaaatgatatggagatgttgcatataatataatagatttataccatcttttttgcatcgtttttgtgtactggaattgtttatgtaatgatcggtcgcagccatcggttgcgatgatctggacatgcgcatctccgtaatgtggcagaaattcatcgcaggtttcctaaacttcaggccgtgcgcactcctgaaaattggtagggctccagcatgttgaacttgaaaactattattccttcatccaaaactatagcaacctaatcctgaattgaacatattctacaactaggatacgataagttgccatatttgggagtctccaaattcataaatttcatataataatagtagtaggttatgttcaacagagggagtagtgatttaggattcatgcagtctttagtggagagaactgaagcacttctgtgtatcgcctgggttgtacaaactacaaagatccttaagcacaggtaatttaagaagagtggtttaaccagagatcatagcatctcgctaaatatcaatacaaagacaaatatagtagtaggg

SEQ ID NO: 994 - DNA, 10983 bp, Oryza sativa
  unsure (1)..(10983): unsure at all n locations
acacaaaagtaaagctatgaaagggagcttttacttcctttcaactaaggttagcatcaattgtgggaagtatagtgtgggttaagcataacagtagggtgatgtgggtggatggctgtcaaagatgttggatagtgtgctctcaggacatcatgctggaatccttgataatttcgtataatgagatgacaatctcgataatcagcagtataatgacaccccactccagcaaatctgatcttctattctggagaacttcttgaagaaaatgaatgttgtgctgttgcaataataaagtgtaagcacgaatgggaactcaaaattttttaaaaaaatcagctaatacactgaaaatgaacacaaatcgaagaacttacctccacaaatttcaatttgaagtcgaggcttccaaaacgttggttcagctcatattcttcccgaagatactcaagtatttgagcataatttgaatttttccaagcgatttcagacctgaagaaaaagtcattcttttaaggggctgccataagatacgcaaggagaccgtatccacgatgtcgtaaaattccctttagatcagcttttatccatatttttttgtcatggtagtcttgggttcttatcaaaccatgtggatagttggcaaattccaagccttacaactggaaacagccagttgaggacaccaaaatgttttgcaattttcataagctaagcatgatatggaaagaggaattttattaaaaggtggagtattatggcaaatcagcattaactaatgagacttccgacaaaaaatgccaccttcactcggaatataaataatttatgttatagaagccatataattcttcctttccttcaattattcccttacttaaatggcaaatgagtatgcttccttaagtaaaatggcatttgcagagctagggttaatgcaaagcatcagggaaaacaataacataacatttgtataatgaacaaagtgcttttataacacagaactgtggcatgtaaactccaattttacagttcagagctaaaatgcattaaccttttaaacacaccagaaaagaatatcaaactacatgcctccttcccccacagcatagcttgtcacaatgcacgtaggattggtatacaatgagattacttccatacatgataaaaaagagaggaaattatgcaattgcaacggaagacatgaaccatctaaaaagggaatgtggtacttagattgtagaagagatacctgtcaaaaaggccaagtctgatgataacatcagcaaggttagaattagccttgccaacaagttggaacagcttctttctttgcatggtaaagttcccagtcttctccatgacacgattaatttcagtaaattcctcaaccatgtcatcgacctaccaaaattagtgttttttagaaccttaagaacaaaatttcaaggctaccaccacatggaaaaagcttgtcgaagttgccccttttcagtacctgccgtatgtaatgatcaagagcaatactttggccaagaacacttgcaatgatgcgaattccatctgtatctaggcttttaagaactatatagtcaagacctcctttcatccatgttgtcagggagggcttctcaactactgcataatctggtcattgtagaattgatatcatgtgaggatgtaatacaatcttaaattcttaaccttacacgctacttcactactttgcaaatgagccagttttgtcccagtgaaagaaaagcttttgcaactgtttagggggtagaaggggagctactcaactctaaatgacttcacatattaccagcctatgaatgcatcacgtccaatatcaatcagatgcatatggactctcttgtagttctatgggattttatcaaaatgtaattttcactaacatagaaggcaattgaattatatgctagtcgtacacacaatataatggaacagtgtgaagaaaactagaagtaccgagtaaaatgtctttgttcacaaggtaaaatatgacaagcaagatagtgaatagcatgtgtaataccatcttttctcatctccggaagccatcctgaagcatgtttcctgatgatatcaagatagtgctcagcctcatggtcagcaatgttgaaaagcacagccgaaccatattggaacacaaccacatagcgatagcaaaatctgttgtccttaactccaatgtcctacagaaatgttagccaatcattgcagagaagttaaattttgcagtgcagaaaaagagagatttcacaaaattgcgttcaacaaattaccaaggtggagttaataacttaaatttgttgattcaaaagcatttggaccaggaactatgtgatggtaaattggaatcactaaccatgatttcttgagggaattctgagtatcggagtgcaatgtagttcaatgatcgggtcgacggaggtaccacgtcgctcccatggtccgcctgcaaactcttcaaatcaatgctgccacagggggaaagaaaaatcagacaaacaaaacatcattttagtcctctgcatctattagtcgtgcccatccatcaaaatggcataaggaagattgaattagcacaatatgatagcaacatacacctttgaaaaaaaaaatcaacaaacacctgtcgtgcaagcacgcgcatatgcttccaacgtacctggtggagaggaagtacgccttgacggggatgcagcgcgcgaggccctcatcctcctcctcttgctgcggaggcggggccggggccgactcggccgccgcccggatccaggcccagtaggccgagctcccgaggccggagtcgcgcgcctcgtgcggcaccgcgacggcgaccgccgaggccgacgagaaggccctagcggagaagcacgggagagtctggcccgtcgtcgtcgtcctcggcggcggcggcggcggagccggatgaggaggcctcgtctcgaggaggcgacggaggcgggtgcacgcgcgcagccgccccatcgaagcgttcggtgcgtgcgtgttttggtggtggtgtggtgcggcgccgcgagccgccaagggctctctccctccctcctctgcggcttccagtctcgtcttggacttggagaggaagaagggaggaacgtggtgggtgggcccataaactgcaacacggaggcctgcgccgcaagaaatgggccagtactcctcttctcggtgggcctgagtacgtacttagcctccattgatagatggcccattgggctcgatgacatttctcttccaaaaaaaggccaactgcatatttgtaacgattttgctatatctcactcgaaagatttttttcttatctcttactcgattttctcactcaaatttacggtgcattttcttgtaagttacagtgtaatttatgaaagttacactgtaacttttgtaagttacactgtaatttttaaatcttcgcatgtaaattttaaattttgtattggatttggtcttttgcttgaggatatggtaatttagtgtccattatagtgtttcttaattgctttttgctttttattatatctattggattttaattcaaagattaaaaatctatgtgatacgatcataaaaatctttcgaaaaatgtataggtaatctctatttgtaactgttttgaaccggtattttattaaatttacaacttaaaaaacgtaattacatgcttaccatcaaaactgttggcacccgtaaatccataatacttgccattggattcaaggccaggaataacacgattagaagatggatttttccaaaaattggtagaataggccatcctacatggtgattcagaaattgctgaccccttccccccaaccctaattggtggtacctcctccgtccaccattgttgctgctcttgctacaaccctaccaacttgctagcttgctgctgctcccaccgcgggcctatagcgagctgctgcacgcgatgctcccgatgcaggcatgttgcaattgctatcacgagcgacgcgggatcgcctccagcggctttcgtcgacttcctagcacctctagcaatattgctctagaaaggtgagatttttccattcttctaatttcttttttataaaaaatgatatttcttttaaaatttgactctaaacttttttaatccattcttctactttttaaatctgtactgaatgtgatatttctttttaataaaaattaatttaaacaaaaaatgtgttatttcttttaatgttttgacttgtatgccgtacattatgggttcaaatccttgacatatcaacattttttccattaattttgttcgttggccgatgttttctttcagtttggtgggtaatagggtgattagtaccgtatatatttttttcaaaaacagaaatcatcattaatcatttatatgtacgcacggagattgaagatttgaagaaaaaaaacaaggaaaaaaaacgaaaatggctgacctgggattcgaaccctagtcctaaggtacaccaggcaaaggaacttaccattgcagcagtacataactaattcattacaagacatcagtctgtttaccatgtataaggggtcagcgccaaatacatttgcgttggtgccatgccacgtcgctcctcgcccgccacgctggcgcaataccagcgccagtcctgttgacgctgacaggaacaacctcagcgctaacaactttggcgctgagccaacagcctatatctggatatagtttttggcaaagactaatttcgaaataagttttctacaaggatcaatttgtcaaaaaaaaaaacaaactttgtatacgtatgcgtatataaagtttgtatacacgtatacaaagttaaattgtatatacgtatacaacatatacatgtatgtagtttttatataggtaaaaaatgtatgcatatccataaatttttatgtttattcgtatgtgaatacattcatttattgtatgtaggaatagtagtaggtatagtagtatagtagtgctagtatagtagtagtacagtagtactataggggcggactgaccgcgggcgcgcgcccagccgccgatcagccgcccccgcgcaacgggaagaaagatcaatgaggacgcacgcccgcatgcaatgcaagcggcagatacacgatcgatcgatcagtctagttgtgcagcgggttcggtccgctcggcacgacccgcttggacacgtcgtagcgcgcgtcgatctcctcgccggcgcggctgggcggcggcatcggcacccgccgccgcttgccgacgccgacgccgccgccgccaccgccgtggcgccgcctcgcgtgcagctgctggcaccacgggagccgccgccgcgtggccccctgctgctggtcgcagagacggcccaagaactcctcgtctggcatcgccggtgcagtcttcgccgaggcggcgacggcgacgacgaggaggagctgcagggaggccaccgccaccagcagggtacagacgccgacggaggaagacgaaggcttcatctttgctgctgttcttggagagcttgttgatccgagaacaatggaggcggcgcgtgtgagagatcgatcgagacgatgagaggctaggcgtgtctggagggtagtggggctttataacagggggatgagaggagatcgcgaaagcggctggaaaatcggagacggtcggggacggagagcttcactgcacggttgcacgcgacacgctctgaaactgtgaagcgaacaactgcagtgtacaagagagtagtgttttcgagcgaaatttgttgggatcaagggaagtttgctaacggatgacagttcgcggtgctactggattgttattagcggatcgaatgcgaattcgggcctaaagttgggcgtgtacgggccatggcccatggcttgcagccttattgtaggatgtagaagggctgaatctctccactaaacatctaaagcttaaatacaagcataatatttacttactagcactactagtatctccatgtaagcataccacatcaacccatcgaacatataaagctcaacatttaaacatatagtaattatgcctataaattattttattctaaaactaaacaaacacatgctaaatcatcattatcaaatcattgttataatatttcaatctaaatcatgttatcatttctccaatatgtaacatatatccgtagcaaaagcacgggacatcatctagttattatttgcatgtgtgtgagggtttgaattgctcctataaaaaaagtgttgaattgtagtggctaatgtttcagaagtacaagtatgcaggaatactagccaatagccagttagtcgcgtgactttggacgcctacaaaaaagtgggagggagggagagggagaggtgaggaaaaagatgagatgatgaaaatgttgttgacatgtgggttatatctgctaactgaataagtcagtcgtgatcatactgttacatcaacgaagatcattttctaaaacattgcaggagtagatttacaccggtttttgaacatgatggagccgttatactccattttatggttaagagagtgattcaatctagagacagcaacagatgagagttatgaaactcacttattccataatacaatgttttttctatttgaagcttagatgggtttgtacaggccatatgcccctgcccttcatattgtgtgtgtgtgtgagagagagagagtaagtggtaattattgatgcgcgatgggctgatgtttttatgtatatgtattcaggaacattgctggaagagagacattgatcctgtaataatatatactgctccctccgtcttaaaacataagctttttttactttgacacagtctttgaaatgttattttgacaaccaatgtatataaaaataagatgttttaaataaaaaagagttacatataatgccagtctgtttaatgataaatataataacatcaattttatataatagattttttattttaatagtgaatagttaaatttaaaaaggtatgagttggcactatgctaaaatattntatattttgggacggagggagtatttcgcagaagtgcagtgctgggcgttgatcgttgactttagactattttgtggagtcaaccgcaacgaagctcatgccttacattacatcacatcggtagaaatatcgttattcaaattacttggtgctgtgtagtgtaccaagagtctcatcggttatccatattctctaataagctaaaatgacttattagtaaatataaaaattaacatgtaaaacttttatatatttgttcgtagcgacttaaaagccaatgttaaaaagaaattactttaaaaatattttaattttaagttaaaaaatttaaattttgatttatacttttacttattaggccaaccgatgaggcttgaagagtcaaggagcatctaaggaagagctcctagcagaagtaacttctcttatacgaatacgagtaacaaactgagcggtcaccgttaaaagagcatcccagggaagcttttctcttcattaatttattttctttcaacttattttttttctaacttgaaaataaattccttcctcttgtgttatgtgatcatgattcatttcggtaacacaaaatttactatagaacatccaaaaatagtgtaattcactataagacaccacaaatacgtgacactgtcgatggtcactataaaagttgtctaattggataaggcgataagcactttctaactctggactatcagtctacctctttaaaattttaatagcagcacatcacactaaccctattttacacaattaatattatttgaacttctaaaaacttttacaaattataatatgttatttgttctaatatcagttaggcacatatttgtgctgataatgttgcatgtgttggacttaatgaacattatttactccacgatgaaactttgtatatgaaaggagataaaacatggtatttgtttctattagaagtattgatggtttttatgttccgagaaatattgtttccatatttgtatccaatcatattcaattctaattatttatattcaagataacttgtatttaatttcgtatccgagttattcgtatttatttttatatctagctatatgaaaatgaatatgatattatcactatccgtctgtatccgctgcagtcttaggacatccacaatattatatgcaaaatagtcttaaggaataaagcaatatttttttctacctttatgcattgggacaggagaaaacaaagaatattgctatggccaaacctaaaattaactctacatcataagaaataaaaaattagttcatgttttttgcaacatgcatggtgctttttcattcatgttgagtagaatttttttaggtcctagcttaagatcaagaaaagattatatgtaatatacatatagtatgtgttatatacaaaagaatataagaaagtggatcccatcttagagcgagtacaatagcaggctacaaatcagctataagcatatgtggatgagataagagaagagagagaaggaaagcgggctacagatttatagtcagctgcagcacgaactttaaaatattatgtatttaagatgtgcgatcatgtattaatggtgtagtatatatttataggtaactattatataaataagatattaaattaactatatatgatttggagctagtagttagctatactactccctccatctacttttgataggtatattttcaaatatgaaaaattttacttttgataggcatatttcaatccaaccacctatcctcttataactttctcggatttaatgcgtgactctctattcttccatacaagattagttacatgggcatcgagaaatgtaaatattaataaatcgtttgtttacgaggaataattagtagcatgtttaaatggatgataagtagaattatttatccttggttattgtgccaagatgaaatatgactatcaaaagtagatggatgaagtattaaacttgctcctattgctccagtgacattgaacaattaaggatgcctgttactatcatccaaccgatcacaggcgcagcagatcccaacacatgtgttggtttgtgacgttcgtcggtatgtcattcatgggacatcgacggttcgacggcgaccagcaagtgcaatgatttgtggaaccagtctgctagagcttgaaagagttggtgacaatattcgtctcgttaccaaaactgtcaaaatttcatgggaccaagtggaacatagggtgtgtttagttcacgtcaaaattaaaagtttgattgaaattgaaacgatgtgacggaaatgttagaagtttatgtgtagaaaaattttgacgtgatgaaaaagttaaaagtttgaagaaaaagtttgtaactaaactcggccatactaacttcaagtggcacagctgtacagagattcgttaattttggatatatatttttttttcaccttagaagcacagcacagtttgataaggtcacaaaatcaacataattcacatttatttgtctagccaaaatgtagtatcaccaacttaattattttgatgattaaggtccatctagacaccaataaaaaatgtccaaaactcagagggcagtctaattagtgagactaactactacttacaagttacaagtcgcaccaaagaacacttcattgaaatacggaccatacggtatataattagccaattagggccatggccgactgtctgaaactgattgctcactcttagtttccagctattagtttctttgtttatggaggttttgctgtctcaaagttttgaaaccaacaatggcactgtagatggttacaacacttgcctacaatatgcaaaataataaaaaagattccttgtgttagctaggcccttagtagataacctgcaaaaattggattggttgctcgtcaggtagccaatcctgcttatgcttcaagcttagctctaccctttttcactttcaggttgcctttgtagccaccacacacattctattttccttctcgcgaaatgttaattttagaaagctcacgccgtcacgcgtagtgatcattgctatgctatcatgcaaaggaacatgttgatcagtgtagtacgcatttgctagcacgaatcatcgattattccctcatccattatctacaaacaagaacatcttttttccagattatagacgttgctggggtccccgattaatagtgaattgtcttagctcaactattagttacggagtagtattacagaaaaccgtttttcagaagatttaacatgtggatgaataattaattgctagattaggtgctggttaattggaatgtacatcagccatgatagctcgtgcatcttcggtcactgctgacatacatcgatcgcttgcgtcgacgactcgacgtcgttgaacggttcagaaccgtccaagctgaacgaccggatagttttcttggtatattgaacgttttcccatctgatgtttcacctaaaagttgtacatgcattctttttcatattacaggtagttaacttgtcatttgtcaaataagagcgacatttgtttaatcagattagaggataaatttatttgtctaattaagaaagccataatagagattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 995 - DNA, 640 bp, Oryza sativa
ctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagacatgcaagtacagtacatcaccagaatcaaacctgcatatctaaatctaaatctaaatgccaacaaaaataaaagagagagagaaaataataatcaaccaacgcagagaaacaaagagcagaagatgctttactcatcgacagccgacttgacctcatccttggtgatcttccccccgagtccagatgcaagatccatggccccagacctcgacatcgcggcgtcgatcaccggagctccacctgcaaccaacagcagcaaagttcctcacggaaatcaggagcatccacctcctcactttcctcccaaatccgaacaaaccacacacatatatattccaaaaaaaattcaaacggtagtgcgaaagggatggatatgatttattttcttcaccctttttt

SEQ ID NO: 996 - DNA, 16835 bp, Oryza sativa
  unsure (1)..(16835): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttaaaccctagtgacagagacaagccgaatccaatcgagactgcgaaaaacgtgatccggaccaacctcgtgggagggagctggaggtgctccgtcttctcatcgagcacaaccctcgtctccgcgaagcagccgcaagggagttggagcagcgccgatcgtcgtagcgacttgcgagaagccatcgatttgggggagagaaaatcgttgggggcgtagagaatcgctcaactccttgccgatcggccgattcgggcggcggggaaattgggagagaaaagccccggaataaatgaaaggacgtatttgcaaacgaaaaataatttatgaataaaattttgtatatgtgttcttagtgatctaaaagtaaggctgaaaaataaacttcgatgaaaaaaccattaaatcagttctaaatttaaagttgaaaatttaaattttagctgataagtataagcataagcataagggaaaagatgaggccccaaagtttagatgatggcggcgttatttggattgggattatttggcctcatcttttcgtttatgcttttacttatcaaacaaattttgaattttcaactcttaatttggagttggttttggggttttttcattgaggtttatttttcagactttgcttttagatcattaagaacatgaacatgtataaaaagttttattcacaaattattttttatttgtaaatataccgtttggcttattcacacatatgtgaaacgatggggccgtatttctttgtgtttggggaaatttctttgggtaacacttgttaggcccggacttcataatttggtccgaaaggatgcattactttacatgggctttctcatggactagtaatgtagcccaatgtcatcgtcatggtcttggtagagtcccatctattaattgttttgtttagttgggatacatgagaatttttgtgggatagggatagagaattgagggaggaactccctccttttcaatacctgggtagtggtggtaattgggacggaattcctcctttactttgcctaaacaaatctcagccattcattttcattaatgaactaatctccaactaaactctctatcaatttccactacctctaccaaacaagatactgggattaaaaatcaaattctcattttaatctcaccatcaattccctcgtgtaaactcccaatcctattttaatctcaccatcaattctaaactcccaattcttttccctgcgttgccaaacaagcagtgtgcgaaatagcgtgtgaacttcaatttatactgcagagattgatttatacaacatatactatgaaagttcaacaaaagagacaggtccagacctgaacaatgttttgagtgcaataaacgaaactcataaagctcgtcgacgcggcgatgcttgcctcactatccacgtcaaactcccacaactcgcaacttttcgaacggcaacaatggcgttatagcaccactgcctaacactactgatcaatgtcaatggagccggcgcgacagctagacggcggcggcattgccatggagatagtcgaggaagaagacgccggcgccaccaggctggggcggctcagcctcagcctcgacctgaacggtggcggcggcggcgcgttccgccccagcacgctgctcgacgagtacgagcggctggccatcgaggcccagctcgaccgggccgtcctgcgccggagctactccgagccgagcccgtccgtctcgccgtcgtcgcgccgcaggacaagcagaaagccccgcggggcgctgccgtccgacgtgccaaggaggaggagaaaacgggagcgggacgtgcgccggcgcggaggttctggctgctgaaggcgttaaacaggctgctctgctggctcgggatctgcggcgcgtggggcggagggctcctccgggcgaagaagccgnccgcgctgtgcccgctggcgccgccgcagaggatgcagcttctcgactacctgactactacctccactacctgacgccatgtaactagccgtgtgatttgtgagtcaacagcagacatgttaaattgccgtgacgaccgaaattttaatttttgatcgatcaacgacgcaacgtgacaatccgcgtcgcatagttgcttgtgaccagtgtttagtttctgtagctttcttcatgatcggaagcaaattctctaacttaacatttgtaactttatcatagagaagttagaaaatcttaatcatccgtattacctgatctgatcttcctgatcgataatatccgatcaggttaggctggatccatccgatccaatcatggcaatctaaggacggggaccttggcatgcccagatagatacctttacagccatggcgagcaaaaagagagggaaaaagtgacagtgtccaaggacaaaacaaactgtgcgagatttcggttgaataatcgagtcatatgattcactgccggtacattggattaggccaccgcgcgctcacggtaacatcagattcagatagttacagttagctgattagctcgcgatccggtcaaagagagcagcttacccaccgccaccgggcaccatggcgaggactgacgaccaagaaactgaagtaaaccgtgtccggtgcaccaattcttctgacgattcaagaaacataacgatacctggagctgtcatcaatgcttcagagtagtactacccttgtctgaagatcattgtcctattccagtcgccgaaagaaatttcagtactataaactcatacacaaaaaaagcagattgcagatgtgaactgagtacaaaatgatgatgcaacaaaattttcttttgctgttgcactgttgcagtagagtttcatgccaccaaccattacatcatcataactagacgtcactgacgttccaattgaaaacacatgtttataaaacgtttgttacgtactctaattaagcttgagataagtttgaccggcgatcgacaaactttggtcaaagaagcaaaagcaggctgggtcgcagtcaacaactgcaacgatgggatgaactttccacaggcagggattcaaagtcattcaacatctctaactgccacaggcagcagcaaatattacatcaatggatccttgcaacttcagcgacatgatctcatcacgtggattagaacattggacaatctatgtgccgacaagcaacaacaccacttggcactttggcagttggcacccaaccgaaatagctgaaatgtttgactccccaaaaaagaactgagtgacacacgtttattattgcataatggagtttacaaggcgcactcaacacgctgcttccatccaattagaaaacgaaaagtatctacaacctggttctatctacagttcacccttcccttcttagtactactgaagggagttcataaggccatttgtcttgcaatatatgagattacactaaaaccactaggctagcaaaaacaacaaacaaatcgaagtgaagagaagagaaaaaaaaatatggacaatcaaaaaccctcaacaccagatctccgtaaaataggggaaggcgatttcttgatagagcttactctagggtcatccagagcacagctggtccttggaggaagcagtgcagacgtggatgaccttggcgagagcaaatgttggtttcgcgaaggaggtgacggtgagaaggttacgacaggatggtgatgaatgatgccattgagacttgtagattttaacatcacctttcttggggcagcagatggctcttgcaaaggatatcgacatggaacctttatgtcctggacgcttgctagggactccacaacggccctcatggtaggcctctctgatggatctttattaaggcatctcaatatgatatctgctacaatccgagcagccttggtagggaagcgtccttttatacgggagtccatgattaacgataggcgactatcatcggtgaggaaaggcctactccacttgacaatattgcgttcttcttttgaggaacggacatcaaggttcttccttcctgttattagctccagcaggacaactccaaagcaccatacgttgctcttgggagtcagtacacctttctccaaggtttccactgagaggtttgcagcagcctaacaaagaatagcatccacggtaaacaatggcattgaccactatggatataatgcaaacaagtaaagtaaaaacacatcaaaatattaggatgtttgggactaaataatatcaatggcgtgcaacacagaatccatacaaacgaacagagtattaaccatgccaaaacacactacttgaatttacagaaagagatcaggcaaatgagttgggctctgataactatatcttctaaaatattttcaaaacataacttaccacagatgcatttgatatttcctcctcggtattgaatccaacacatccatatcctgatagctttgcagtgaaatctttgtcaatttggatgtttgaggttgagaagtcattgtacatggcctgtaaaaaaaataacatatgaataagagtttaaaccacaaggtcaaaaaccatcaaccaatgtactatataactaggtaaaataaatattcacttattggtaatgtcaaaaagaaaaagtttagaagcagtaacctgaaaaggcccttcatcatgtaggaaagccaggcctctagcagcaccaagagcaaccttcaaacgtgctgaccagtccatgaaacgaccatccgatcttccaaagagtagtttatctaagctgccatgatggagtcgctcatagaccaacatcctttcattagattcttctcttgcgtgaaagccgattagtttacataagttgggatgctgaagtgatgccaaggtattcacttgtgttttaaactctttcaaactctgcatattaataaaatgtgtgttgcatcagtaccataaccagttaaattgtaaataatagatcaggatggtccaataaacggtgctgcaacattaggtaacaccaaagggggtatcagatttagacacacacacacaatacaaagtctagtgaaccactgaattcccagaactacacaataacactacagtgattttttagattccttcaatactgaatacaagtgagggaagatcagaaccatgccaataaaccacataaagtggaaagcatgagatatcatatatcaaagtatcaaacaaacgtcaaaagaaaatctcgctagtcactggatatgattaggaaggagtggagaaagcatctaggagtaaagtgaagaaagaagatcaaacacatggtctgccttcaaagtccagagcatgttacctaaccccaccaatggtgtggtcctggtttgcattcacaaaaatagaaagagttatttctgctggagacagcatagctgtaacattaagagcatagatcacatgcctacaaaaccagtccgtgcctctagcctaaggtcagcttcttaatagaagaaatgctgcaaaatggttaaagccctaaaagagtataatccttacagtgtacaagcattttgccaagtcactactcactagcaagagagaaataaaagtaagccataacatgccaaccatctgtttgacaagctgaccaacaaagcaaaatggcaaagctaccgctttacatccaatacaacttccttccaggggaaaacaaagaagatgaaacacataattcaatattacggagaacagtacctgagtggaggagagcaaccgagatactattgcttcaatggtctttgggtcggtaaaatcatcctaaaggacgccttgtatgatgttgatgtcaaactttcggaacacactggtcaccagaaaaccattgccagctgatgaaagttctcataggagaaattcttaagcccatcacacttctttggaggaagtggcagagggcttgaagcatcgagtggtccacttgcattgatggctttgaagctgccaaagttcctcaatgattttccttctggggatgggagaggaaggggcagtggattagagaaacgggggccctttatagaacctcccttgcccctggagtcatcttgatcatcgaattcggcatatggaagaccatcctgatcaaccacaattaggctggaaggagcagacagcacgcgcgctctgctgtaagaagctttcttttccgattggtggattttagccttgttcctaaaactaggaggagcagattgtaacgatggcacatgcgcttctggctctgggagtcttgaggacgtgctttcccttgcatcaaccgatttcttggtgagagcaagaggcttcttcttcttggatctcaggacagtgaagcaacccatcatgtgtacaatgagggaaagctgctacagaatttcaaataggatcctgagttagcacatagcacaaaagtagctgccccatcacaatatagcagttagtcgtcggcaacaataaaaagttgtcatgtattgcatctgctaaagctaaatgcagtacaacagaaggtgcaaaaggcgtcgaaccttgcatcagcaaaaaaaaaaaaaaaaaaaaaaataactatgatatctctccttaagtacaacacctctcaatgtattctgaacttccaaaccattactggagaagaagagacagctaaactactaaaactgcctcattcccacaatcagttcactgatctatcaagagacaagctgagacgaaggcttataggagccaggtggtgtgatgcattggtccgcagacgcaacaatggacgttcaaacacaccactccatttagtttggtttccaatgcaacttcacagaaattgcgcgcgtctgcaactacttccatatccagagacggaatctagtagtcgaattctcaccaaaccaaaccaaattaacaattccgggtcaaaagtccaacttaaataagcaatctattgcagctaagtcattgaccccaacaaccaagcactgcaccacccccaaaacatttactggaaattttcaccgctccgcgatcataaatgaacccgcggttgcagcttccatggccgtgaaagcagaattcccaaaaccttcacggcattatctcacctcttactaatatacagcattgtgagcattcacagaatccaaacgaacttctgaaacggtggtgggggaaattatgaaattcgagggttttcaaacccccgaccttatatccaaagtcctagcctgccattcggcgaaaatttataaatgcaagagcgcaaacacaaacaaaaatatttaaaaaaacaaaaaaaaacagcagcgcgctttgggaaagcagcagatgataatccaaatgagaaagatccaggcagcaacggaaaaaaaaacatcagtaaccacccatgaaataaccccaaaaaatccacctataaccaagcaaaccgcacacaacaacagcagcagaggggaagcaaagagaccgcacctgtggccgctggaacgccgctccgggagcgcaaccgcgggggaagcgaagaatgggaggggggctccccagcggtgagggtcaggccgcggctggcatctaggggaggaggccgaggagcaggaggagaggggggataggaggaggaggagaggaaagcggatataacagcagcgaggagaggcgaagaggggagaaaagtaaaataaacggaggaggaggattagctatggtggtggcgaggcgacagagaggagagggcgcggcactggtcaaagccggtggaggggctccgaggcaggcggcatttttatattccgccccccgctaaccccgcttttacccaactaatccatgtaattagcagtaattaactacttttaggagcaggtacaatagcaggctagtataagctagctttcgagccaatatattaattatatagtatatgtttataggtaacttattatatgaattggctctaaaattaactatagttaatttgaagtcgacagttggctatactaataaacttgctctaacgatgcgtttgcaaaggtagggtaatgggagggtggggcaggatgcacatgagagtgtgttggtaatggtaccacccatcacagggtgattttctaaagcggtgaaaatcaaatggtgttttttttttttttgccttcacaagccgacaaaggtggtttgctcatgaacattcagctgcagtgctccagtattttcagaaacaggtttcaggttttcctttttcttctgaatagtgcgtgtgtcaagatgacgcaactgtgtgttgataggggtaacacattgcttgtacggttaattatagccactggttatggtttttcttttaaaaatgtttattgtgtaaccctttctcgcccacaaaattattctgttcaaagttaagcacgaagagttttgtggaagcgtccattgggaagaaatcaactttaaccatgtagcctgggttctacagctttgatcatcactataagcaaaagtgtaattgggaaactggaaggcaattcgagtgattatggtctgatgctcatattgatttgatgcatgcgtggtcgaggttgttcaccaatacaacttgacaggaaaagaaggatgacgaactgcgtgtgcaaaattctaacatgataaaagggcatatcgttctccagttgtttttctctctcgctaccattcttgttttgcttttcagagggagaaagatcgaataaaatgcgaccgcgatggcttcgaatgtttgacaagttgccactgcttgcttattcgctatcctgccgtctgaagatcccggacgaaacgaaaacatcaatgaaggatcatagtttatttgccttgccgtctgcggttcagtgtttttaattcttgttctaatcgaagaagagagtaagaaagtttgaagtattgacgatggaacgcaagagattaattcgccatctgcgaaaaggatgtggcatctcttgttttgaagtcactgtgttggctttttgctcattgttgaattgaacaagaaattttccttggagcacacagctctttcatctagaaatagctccagaatgacctggccattgccatactaaaatatagggaaaatactggtgctacatggcaagaacatgaaagagtttattcaaagatcggtgattcctatgttcaatgttctgagtctttgaatcatcgatgcgagatcgccagtccgacatttgacgctgcagtttgattaagagtgagcttcagggacaattattgagcttgacaagctgtctagtggttagttctgcactagtagtacatactgcattgctaaattatgacaactaaccgtagaggtagactgcttagatgaaaagaacaactgagactgaaagagattcagacgactagcagatgacaattctgcagcttgcccttatggattggcttcctgggagtccaaacataggctgtgtttagattcaaagtttggatccaaacttcagtccttttctatcacatcaacatgtcatacacacacaacttttcagtcacatcatcttaaattttaatcaaaatccaaactttgcgctgaactaaacacagccatagagaagttaacctaaatacattgcaactgaactatattaaagagttagcagaagcaaatccagagttaaatttggttagtacaagtcatgttgaatagtggaagatttcccgtagaaacttatgcagcacgccagcacgagttcttcacttcttctccctgagctcatggagaagaaatttcagaacaaagtccctgaggaacaagtacaaacacgaccagagaaaataaaagtatttttagagggtgtgggatgcaaaaatgtgcaagatttgttagaactagaaggctctcttgatcttaaaattagtcaaagagaatggccaagcaagggagaatatccacaaattccaagcgcaagcaagcaagcgtggtcatagatatggcattgtggtggcagtggggcccaccgccgacgctgacagcccggtcaaagacgagaaaaaaaaatccgcgagagagagggggtgcgtgtgtgtgtgtccagttttccaaggtgggccgggccgtaaggtgggtggagtcaaacgggaaagggacgaagcgggggatcggactggtcagcatctcggccgtccgttggtgcatcggacggcccggatcggtccagcgcctcacatcgccgggccgggcccgccggtcggtcgggagtaataagctccgggggaggaccacgcacgcgagcattgatggagctgcccgagggagggaggggccatgattgggcaatcatcgtccgtcgcctcacgggaagagtgcacgaatctcgaggcggttgaacagtgagccaggacggctgtacagtggctgctctaggatgtggttggggtaggctccctgtttggtgcgtaatcctactggagggtttggatggttcatgccggtagatcgattttggagggagctcatcttggcaaaaagaagaaattgagtttcttctttgaaattaaaatacttcgtaaaagtttattctttcacatggaaagaattcatattgtctccaatttcgtcacagtaaacttgctatactagtaaaggccctttttaattgtatgaaaaaatccgaaggaataaaaaaacacatgattatgccaggaaaatgcagatataaaacaatggactacaaacacaaaaaagctcatttaattcgaccacggaaaaaaaacataggaaacggatgagagatatattcttgctaagttttctccaaaatttttatatgattatctattccataggaactttaaagaataaaataagatttaatcttttgtttcaaatgttttcataggattttttccctataggattgaaatcctcccaaactccaatgtttcccctacaaatcaaagggatcctaacattgttttgttgttggttttaacttatatggctaggtagaataaaaattttatgccaagggatgaaagatatggaacggcatttcaaggtctctaaatggatttttcatctaaaaaaaattacttaatcctcgcaaaaaagcacaaaactttttgaatggtaatgtcctctgtttctgttagtgattctacaaaatatcaccaaggctaagttcttttcgccaacttgaaatggtattttcttgtttttcattagcaatgctccctgaacttttaatattatattttgtggaaataaatcatatagaagttgtttagaaaaaaccaaaaacaaatttattttctaaatttataagtcacgaactgtttcacctgaaatgctcaaacaaatgcagcctaagaatttgtttggttaaagggttgggatggattagattgggttgaacccatttttcagtgttttgtttaggcacatgtgggatatgatggtccccgacaaggaatatatcccctaggatacgggttagtggcccttaaaaaactagcggaccaatcgaacctacttttttctctcactaacttgtggacattccttcaaaagtagatcatcccatcccttatgccaaatagatagataggatcattccatcctaaaaatagggatgagtccaacccatctcactttgtttctaaactaaatacatgctaagttcgtcgtatgagcccctactacaaaatctatgtaacaagaaatttgtttcgcattttttaagacaaaagccagtagggctagtacacactgcatgtcctctttcatgctcaagcaaaacggtactacgtcaatttcatgccagattagtttaaggtcaaaaaaacaattccttcccctcctcttttcttcattgcatgttacacacagttcacacactcatcactacacacggatctgtcgttttaggcgtggctcaagaccatatcttttgtttgcagtgcgcatatgcaattagttagcactctctctggagtgtggatggaggcgcccccaccgtttaattttggccttaacgctggaatcttgggcttagggatggcaattttatccatgagttcgggtatctgtggatacccgacccgatggacatggacgtgggtgtgactttttacccatgggcacgtccgcccgagacccgaagacgtcatgggcaactggcgggtttcattttttacccgtaggtaacacatgcccgacccgatacatatgtattagctaattttgactcatttcttaattcttataccatttcttttggttcatttgtgatgctaactgatactaagttgtgatgtaattcaaattattgtcaataaccgataatttggtaaattattgattttatttctctttgttaaattacatatctttcaagttattattcatgcgagatctattgggtacccgtcgggcatgggtacaagcacggaattttgcccgctaactctagtgggtagggttcgggtgggcaatgttaggcattggatcgggcatggttttgctctacccgtacccgacctgacccattgccatccctacttgggcttggttcacgagctacctggctatcaagcgtcgtcgcgctcctgcccgtgcggtgcttggtttcacacgctctcctacttcccctcccccacctgctgccccgcgacaagctagctagacgctttgccgtcttcggttttcgcatgggatttcgctggaaggatggagcagaagcggcggcgcgagagcagtacaatagcactataagtcagctataaccacatatcaagaaaaaaattaagggagagaattatcccacctccttatttctcatcttgatttacttttatcttacatttttattactattaaatttatgattgtgtgtcttatgagagaagccggagatataacccattttcattttctaaaagaagagagaagaaagcgggctacaaatttatagtcagctgcaacacggactccaaaacgttatgtgtgtatgacaagtgagaccgggtattaatggtgtagtatatttttatagttacctattttataagtggactatttgatttgttatagatgatttagagacagtagttagctattaaacttgctctgaggtcgcgaggcgagcctgcgggcagcaggagccgggagggaggagggggaatgcgtcgtcatcgtcgttgacggttacagtgataacagtatcttttgccagcggtttctccggatcgctttcgccgtcgctgtctgccggcataattctagaactttcttaactataatataaaatttggtctccaattggtatcaatacaaatccattcatctaaaatgctaccctaccaaaatattgatagtgccaaaacatacctaagttttcgcactaccaatactttaatactttagtagggcactaaaccaaagaagcccggaaacggattcgccgccggtggctgctgcgttgcgtgacgaccggtcggtgagcagggcggccggcggtcgggacgagacgagagagttcttctccggcgcgctcagtggagctatcagctcgccaccatcgatccatatcgctctcgggcttacgcgagtgccctggccgcgacgccatatacatcgtttcacgtttttgcagtatgatcaagcgagagcgtgtgcttcacatgtttcgtggaattcgtggtcagacgacggtggttgatggtctatgcccaatttcaaaagatcgatgttacggcgtgatgacgctaatacgtcgaaacccgagtaggatgagccgtaatgtcgtactgtatagtattatttttgagattcgaagggtgccgctcgtacatagtagtagctcgtttttagagtattttgagaaatattactattcgaacaaagctaaatcaagatggacttttcagaatcttataccaaggcccgggattagcagcacgttgttctcgtaatcaggcatagatgtcgatgctgatagactgacagcacctgcacatgactaccttcttgtcagtattgcccgttgaatcacagaaaagataatgcgcgcgcgtttcggcccagagggcccagccccggcgcgcgcgtcctctgactttttttttccttttttttccaattttttcgttttttttcacacttttttctgtttatttttttaatcttttatcatattttgagtttgaaagtttttaaattttgagttgaaaattttcaaatttgaacttgacgatttaaaaacttttaagttcagatttaaaattttttattttttttcaaatcttgatttgaaagttttcgaatctcgatttgaaagttttcgaatcttgatttgaaagttttcgaatctcaaattgaaagttttcaaatttttcaaatctggacttgaaagttttcgaatctcgattctcgagttgaaagtttcgattctaagttgaaagttttcaaatctcgggttgaaagttttcaaatctgagttgaaagtttttaaatctgggttgaaagttttcaaatctgagttgaaagttttttaaatttgactttaaaatttaaaacttaaatcgaaagttttcaaatctaacttaaattttttttaatctattagtaaaaaaatctcccaaaaaaatcgtcagaatcttgtctaattactatcattaatgttaagtatattaactaatatagatagttaaaactaaagagaagggggagtgctcgctaactgatttcatggctcgccacccccgttgaatcattccttctacgggggagtagtatttactactacctctgtggcttatgccttggaaaattcccgtaaggtaactttgattgccacgatcgttttcgtccgtgctccagacctccagtaacattccaatagggtcactttctctcgttctatcatacagtacacgtcttgttgctctcatttatgtttctacttggtataggagaaccactaccacaagttcattttttttcttacatccattttgcattctattgtgtctgattgtttcgcggtcgtggccttgtatcaaccaaggaatcgaaaagagagaatttcttatatactattgaaaattagtctgattccttatatgccactcaaaattgacttttttcttatatgccattgtttcaaatttgtgcaccctctcatgacactcacatctgttgaccgtgtgttgaccgttaactctcaaataaaaaagacgtatttatcattctgattatataacgatcaacacacgggagtgacatgagagagtgcacaaatttagaacaatggaatataggaaaaaaacaattttcaatggcacacaaaaattagaccaattttctgtgacgattctctccgaaggaaaaggcctgacgactgtttgcatctgcagaaaacaaccccaaattcccaactccccatgctgagacgtcccctagcctgtagcctgtactccctccgttccaaaaataagtgtagttttagcactattcatgtccaacgtttaaccgtttgtcttatttaaaaaaagattatgattaatatttttattgttattagatgataaaacttgaatagtactttatgtgtgactaattttttaaatattttttataaattttttaaataagacggatggtcaaaaagctgtgcacgtatatttatggctgcacttattctctgacagaaaacaaaacaaaacgctgctgcttgtttttttgtcagagaatacgacgacgacaaaaaccggagatcagaatttcaacagtagtacgcaactgtggtagtttgacgtgcttgcaggccagtgagctgccaccacgttttcatgaaaggtttcacatatgtaaattagcagtaatagatactgaaccagaacagaagaccacagccacaaacaaaatagtggtagtactttgatgataagatgtaagataaacacgcacagatcgaccaaacttgtccaaggttcaaaccctggtcctttgggttcagcaggcagcaaaacctaactgtcaaaaagaaaatcagacgaaaactttgaactggaactcggattaggtgatcgcctcactactcggacactctgcattacaggtgttcaaatggctggcctactcgtgtaatcattaactaatagtactaataatctagtaatttacagcaagttttccacgattccatctgtccgtggcgaggcaattaccagatggttcacaccgattgtgcggtgtgaaactgagactgcaattaggcaatgtaatgctattgtggtatcttttgtttctggttttctggatcaggagagacttgtgaaaagttcagattagtcacctggaagaagttggaatgctccgagtcgatctgcgattctgcataatagaccaggacagcaggactgatccagaaggatataatcatataacaagcagcctagtacatttgaagctacgggcgggtagtattctcttcccttgcacataggagaatcgaagaattgaccggctgatcagacgaccactaaatttcgcaaacggcgaatatcaagtggagttgg

SEQ ID NO: 997 - DNA, 10383 bp, Oryza sativa
acaaatatattcaacttttaatacatccagacagatgcagcaacaaaaaagaaaatcccactttctgaatcaaatcaaatcaaaaacatttcctcaatgaacagctgcaaatcgagcatccagatttttctcccgcggaaagaaaaaaaaatcatctccagctgcacaaggatgaacgagcaaagtccctcaaaaagtgacccagatcaagacgggcggtgaaatgataggataggtcgggcggtgcctcacctgcttaagcgatgaggggaacatggtccgctcgcactcaagcggcggctgcacgatggagaccgcggcgtcccgccaccggctgcaggcgcaggcgtagaccaccacgtccagccgcggcggccaccaccgccgatgacgtcgcagtagacaggcagcgacacgagtgttggatagtatagggagaggaatattgcgtaacgtggatcacttgtattgagcctcaggggccggtatatataggagtacttgggaggagataaggaaggattacagatatggaaggagtccacacaaatcaatcctatcctaatatgactctaactaccatatactctaacatcccttcgcagtccaagcgtgagcagcgcggacacttggactgaagaagaaaccaacaagagtactcaatacggatgataaccctttgtgccgtagtcgatgtagccaaagcgaagggtgcgagggagctgtggtcgatgaagctgtgcgtagagtagctgtggtcgatgtagtcgaagtcaggaagctgatgtcgaggtagccgagccgcagggagcgcatgaggcgccgtagagtggtcgtggacgcacgggaggggcgtcgtggaccaaggtgcacgaggatgcactggagacgaagatggtgacacaatcgcggcagtcgtgaggaagatgacgccgaagagccgatgtagtcgaaccgtgaaggacgagacgtcacatagggtttgccagaccccgggacaactcgggacgaatccgcgcgccggtgttgccaataccgcgcgggcgacaggggaccaccatgaatcatatgccaatgttgcaggagactagcagagaaggcctccaagacggtcgcgacgcgagaacagcgtagagggagaattgccggagcagcgcgcagttgccggagaagagcgaaatgtagtcgagggagatacggcgacactggcgatgaatcatgctggacgaagacgaaggcctagtagtgagaccaacggcctggatggcgatgttggtagccatgtagaggtagctgcaccaccggcctagagtggcgacagtggcagcttggagatgcggtggcaatgctcgaagtcgaggaagaagaccctgagcggctgacgatgaccagtgcggacgacgaggttgttgatgtgcgaacggcgatgaagacgacgaaagcggcgaagctgcggtccgagaggacagcacagctgcagctccatgtcgatgcagcggcaagaagtccaccggtgatgtagaaatgctgaggagggtgcctcttagcactgcaacaaccagtggaggtgtggaccacaggcagcggcactgcggcccgaggggagcgaacgcagcggcaccccaaagcttgatggtgtagacgcatgctcgatgatgatcggttgcataagtcgttgtagccgggcgcttgaacgggtgatcaagctgaatatgcgcgaggcggaacgatgaagttgaagcagagtcaacaccgatgtcggagacacgtggatgttgacgaggcggtgggcgacgcaaacccgttttttgaaaaggggaaaaaaacaaggatacatgtagcagcagaacagcatcagtagcaagctcacacgtgcagctcatcctctcacacatggtccataggccaagtccacaccaccttgtgcaccacagcagggaccaaagtcatcaagtagcaatcctttgaccggtccatccaatgcctttccctgtccccaatcctatccatccacacacgcgtagacagatagaaaagtgagacatgaagcaacagattgatggcgaggcagacagaaaaggtcgacgatgactcagccggcgaggagacggcgagagccgcgaccctccaggaggggacggggtggcgccgggtggaggggacctagtggccggcgagcgccggcgccggcactggcggcctcagatcctagtggtcccgagcggcggacgtccggtgagccggtggaggatggtctcagcaggacatgcgaggtggtaggcgaggaccggcggcggagaagcagcgccgggagctcgtccccccagtcgacggtggtgctggagacagaggagtcgggggttgcagggggagaccggtgccggaggtggagcagccgagctgcgtcgtccgtctgtccatcggggctcgatcgttggccagtggaggcgacgacgacggcagggcccgtcggtgaggccggcggagcagaacggacgctaaagatgaagccgacgacgggcggcctgacggcgatacaagagtgccgcgcacggaggtcggcagaggagatgcaatctgttgctgctgcttgacgacgactagactcgacgaagaacaatcgtgaagatcgatctctccaagacgacgacgacgacagcgacaaggaagaaaaaagaaaaaaacgggtggccgcccccgggagcggcgtcggcggaagcgtgagagcggcgctagatcgcccgctctgataccatgttggatagtatagggaaagaggatactgcgaatattggacacattgtattgagcctcagggggccggtatatataggagtacatgggaggagataaggaaggattacatatatggaaggagtccacacaaatcaatcctatcctaatatgactctaactaccatatactctaacaacgaggatgacgaagaaggacaggaacgggaggctagcagcgtgcatcggcaccaggaagcgaggttagcagcgtcgggttggctcgcgcaggcggaggcgtggatcggcaccaggaagcgaggttgatggcgtccggcgaagggaagagcaggaggacggggctccccgtctcgagatgagggggccagaggaagggaggaggcggaggttggagagggaatgggcgaggagggggaggatggagaacgggttgcggcggagggcgtgcgggtgctggaggatgacaacggtggttgaggcgggttatggcggagggcgtgcgccgctccgctccctcctctcccgccggcgccgcctagtgccgctccctctccgtcgcgcctgagagaggagaggggagagagacgaagacatgggagatgtgaagaaaggaggaaaaagaggtgagaatgacatgtgggggcccacgtgggccccatcattatttatttatttgtgtgttaaactgacatgtggatcccatggggtttattatttttctggatcgaattgccacgtaagcgccactcaatgccatgtcagatgtagactgagtcgaattagctatgtaggcgccacgtcagccaaaaccgccatccaaaccgctgagggaccttatttgcactggttttaatagttgagggacgtgttgtatctggttttctggttgaaggacgaaaatcgaattcgttgacaagttaagggaccacaagtgtacttattcctcgccaaaaccagcgccggttattaaaatgtagctcgaatcttgtggctcggccagcttttgtgttgtggttttcttactgcgatacgtttccatgggccatcaagtttgtgctggactgctggatccaagttacgtaaggcctcgctgttaagctcatcataagtagagaaatcgatcttctctgggccaaaagagtacggagtaatctgtttcagtttttacagggcacgcaagacattgacgggccaagcccatatgtattccctcgttgctttgcttcgtgataattcttgggtggaaaagtctattttgcttttcctcaagtctgacttggcccctcccgacaaaatcatttcgttttatctccctgaacgatatgaacgttggttttgtcctatgtgacgtgtaaataacgcctacatgacacggagacttgatcatctgatgtgatgcttacataacacttcaatcaaagaaaaataaataaacaaaaaaaatcaaaatcatataggccctatatggctctcagaaaataaaaatgatgtaggtggcatcatctctctttccctcttctttcccaatgacgctagaagctcaaggttggatgcgtagttggccatcggacccctgcacgggctccctcaacaatggctcgttcgatgtcttctccatgcttttcccaccaagcagatcgcttctgggatcctcccggacattggtttaggatggcagcgacgacggcctcaaggtgtggagtccatgcgacgcacttggtaagtagaggacaacagggatatggcgcgaatgacatcctccatgccgagaggctagagctcacctacacctgctacattggttagcgtagtggatcgattttttgagggaggcattgtcacgctcaaaaatttaacccaaattttcagactattttgcgtattaaatccctgtccagaaccagccagggtacacaaaacgacaagtaatatacagttccaaacgtaaaataagcgtaaaatacttacagaagaggcacttagtcctcacaccgaaacaaaagcagtagcagcggaaaaaaaaaatgatcctagcggggcttcagctccactccacaggcaaaactcaactggggtctaagtcttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccattgatcaacgctacaccacgttgaacaggcccaaccaacccacctaaactacagtgtattgggtcgatttattaagatgagactaatcacggtgaatctgatcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccaacaaaaccatgcacccacagcccaccattcagttgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgagaaaaaactctaataaaaaccaagaaaacagtacataaaaactaaacaaacatgtagagctcaattttagatgaattttgcaagtggaatggctcaattcggagttcgaatgaattaggtatgaattttagaagttttaagccatttaaatgaatttctagaattaaactcgatttattgcgcaattattatttatttttacaaaggaaatggtcatcgctgacgtcagcaaggggtgaggcgcggaccacgtccacaaagggggcaggccccacacgtcagcggcacggcccaccgtggaccgagtccacggtggcgatcggccacgcggccgcgcacccgacggtctagatcggccaaggccgatcggacggctggggacggccgggcggcgcggcctggccagcgcgcacacaaggctggcggcggcggcggccgggaccaaagcgacggcggcacacaggccgggcgtcgcagggagcggcggcgcgcagcgcgggaagcggcgagaggaaacgggggcagtgagggagagggaggtggtggagctcaccgaggggcacggcgacggcgagagcagccggcggagggaggcggcggcgctccacaggtcgacaaggaggaggggctcccagcggcgaaaggcggcgaccgggcggcggatggggaagagcgggacgcggcgaagccggcgatgcagccgatgcgtcgcagcggcagccggggtgaaggcgaacggcgatcggaggcggaaaaaggcggccggtagggtggtatggcggggaggtggttcaggtggtggaggggaaaaagggatcggtggccgggcttgcccgcgcggcggcgaagccggctgcggtggtggcagggcgcgggatcggctcaggcggcgacgacatgcgactcgggtgcatggtggaaggggagtttcggcggaggtttgtgcaaatggagcggtggcggatgtgcggcgaggcatggcgaagccggtggtgtaagcggcgcagcgcggcggtggctacggcaacggcggcgtgcagccggagctcgccggaaagcagcggagcgcgggctcgcgcgaggaacacgggagaggtaacgaggagctcggggaggagagggaaacggaagaggagagcacgagggtgctttttataggctcggggaggagaaatcgtggccggacgtggcggatttgaagcggcaacggccggcgacgtgggcgacatcgtgggcgaagtggggctcgatttggcgccaaaaattggggaaaagtgggggatttggtgagaaggtggaggggaaccgattttatgcggtttgggcgcgagggcgcgagcgggaggagccggaatcggcggcgacgtgggtggcaatggcggcaatggcggtttcggctctagaggccgaaggtagaggaaggacctgacaggtggggtcgtcgggcccacctgtcggggagggagagagggaggagagccagggggttatttagactttgcgcgaggggaagttgatcggaccaaaaagggaggggtcggcccgagagggagaagggaaagagagaggggcgagcgggccaaggaggggaaaggatcttgggccgaaagcggcccaaagacaaagaggggaaaattttatttgttttctttttattttaattgattaaatgaaatttgtgctattaaaattatttctcgagctccgaaaattcacggaaaattccggagagtattttagggcacaaagaatattacaaaatattcccggccaatgatttttaagggaaaattttaattctcccatcaattcattcgaataaattgctttaacttttaatataatttctagaaatgcattattaattgatttttaatcccgaacgaaaatcggggcgttacaggcatggcgcctggcgatgctaattgggccttctttcctcctcttatctacattgagctcgctaacaagatgagaatggcgaggacggctgctgagccatgggcgtcgccgttcttcatgttctcgacacgacatgtcgagcccttaggaggtcctgtatccaccatgccaatggctagttcctcatgccaccaagaacggtcaagtgagcacgacaacggtttttcaaaggtcttcggttgagaacatgaactcgttcatttgcattgaagtcgggtgttactgtcatggttatgtataccacatacataatagtagttgactaagctcgatagggcccaccaagtaccaagtcttatacggaattatatctcgtatatagaaggagattcggataagcaagaacgaatagagttctatatggaaactataaggactactcggattgtatccatattagtctctctagttctacttagataaggggacacctatgactataaatagaccccctaggaggagggggggaggaacaaaaaaaatcaagacacgacatacaacagatcgagccaacacacgccaagacaagctgccggatatcgatatcagagataagcctagacaaactcaatatggtgtctacggaggccaacaaaagagatttagcactatctctgatctcgccgagtgcgaattcgaggaggaagactactgcgttgtcgactacgtgatggtattttaagccgccaaatcgacaacggttacataggttattccaaatattgtactggtgcgattatgatgaataagagcagcaataggagtagggctattacttatcagataagaggcccgaacctgtataaaaatccctgtctccatctcttttaccttaatctcgcatccaccctggtaccaacgatccccataccatgcaaatattgtagtcgtgacttcagacgtcgacaagggcccgacgagctccacctccacattgccaccatggctccatcgagctcatcgcaatatggtcacactgctctgcaccctatgcaggatgcttaccatgtgctttcaatcaccggttgttgaggactaggcagccatactaggtagttgcataaggaagagttggcagggatgcatggttgccactgcttcctccaccataccaccatagctgccttggtgtagcaaagaggaggggaaatatattaaagcggggggagagggggaaaagagggaaaattaaatgaggattagagcaattgacaccgtaatagactaatcggacctgaaagagaaaatatgatctagagattatgaagtactaccaagttttttttttctctaaatgtaaagcggtaaacaaaaaatccaagtaaacataagaggaatgtgtatcatgtttatacaactctctacacgtgtagtactgatatgtacatccaagaatctatggggtccacatatcgtgagaatactgcactcaccccagtcttggggcctgttcactttgataaaaaaaaaaaccttaccaaaatttggcatacttgccaaaattttggcaggatttcttatatagtcaccaaaatttgacagcaaactaaatgtagccacttttttggtaactttaccaaaatttggtaatgttgaaaatggtatcaaagtgaataggccctttgatgccattttcaaccttaccaaatttttggcattgccaaaattttggtatagttgccaaaattttggtaggatttcttatatagttactaaaatttagcatcaaactaaatgtagtcacttttttggtaaatgtatcaaaatttggtaatgatgaaaatggtagcaaaatgaacaagcccatagtactgcatacaaccttttttttttcaaaatacaatacaagtactcgtatacacatccaaaaagttgagattcacgaatcttgaagttaccatagttaccttgcttttaggtctacatagtataggtgcttatataaatgctcgtacattcacccctcatcctacctgtacaataaacgctagcatactcaccacttaccttatccctattagcacatctaaaaattaaatcttgatattgacagagttatcataggcgtctagttgttgatggaaacatcattctagtaccatttaaaaaataaattatcgtaaacatgttaaatctattacttaaattcggatggacaaacacattccatcaccagcaagtttgcaaccccatgttcccaactcctcttcctcgttttccacgcgcacgcttttcaaactactaaacggtgtatttttttaaaaaaagtttataaacgaaagttgcttaaaaaatcaaattaatccatttttttaaaaaaatactaatacttacttaataacgtgctaatggatcg

SEQ ID NO: 998 - DNA, 12458 bp, Oryza sativa
  unsure (1)..(12458): unsure at all n locations
gcagcccgatatgattctagaaaatccaggagcgaagccactgcccgacaaagcctcgtcggttccctgagcgtttatgttattttagctgtttccgtgtatctattagcagttcccgctcggtgcaagcatcaaattaaacttgtgtgcatatgatcccgcttgtaccaacaaatatacggtatttcctcgcaaaatgatactacttatacggtaatattacaagcctgtacgtaactgtaagcgtcctgtacctcctaacctccacaacaactgcccttgctagccaagatcgaaatcgaatggacggtggactactgtgagtaacctacaaactgaacagacgagcgggcccacccgtcatcctctcacagcaccaacgtcggaaaatatctcacggccatgggccatggcctggcccaaggagagatttttttacataggtccaaaacaagaaaggagattttttacatgggtatgttacactgggcccacagcggctgggggaagcgggggcccacctgccccggtcacgcgatgaccaccgtcacggcggcggcggcgggggcgtcgacctcgctccccggccgccggctgcccgcggcggcggcggcggcggttggtttgtgcttggtggtggcgccgtggaggacggagccccggcacgtggggcaggagtcgtgggagacgagccacgtgtcgacgcagcggacgtggaagccatggccgcagcgcggcagcacgcgcaccttctcgccgtccgcgaactcgccgaggcagatggcgcagacctccgccgcggcggcggggcttcctccaccacctccgccgtacacctcgatggggatgctcctgagcgcgcgcttcttgagcccgccgncggcgccccgccccttcacgcccgccgcggcgccttcccccgtcgccgcccgccgcgcccaccggatgatgagccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaatccgtaacacaaaaggacgtggacgtagtagcgactgccactagctaatacaaaaaggtgaagcttaactgttgctaaactgtaccgatcgatcgattgatggagtgagctagccaagtaccttctgtgatctctttcccacacgatcgagctggattagtatttcgggagatgagatgaggaggaggaggagaatcaacaacagcaagtggagttgagccgtagtagtagtagcagtagacagcgatccgtcgcgagatgccacgagagatttataatgggtgcaacaccaacaccggcacaccgcacggcggcaggtggggccaggcagatgtgggtggggttcggctccgggtcactttacggtgggccatccaaaagcggaggcctctctcctctcgcgtgacaaatatctttgcccccgctttggcgctttgccagttggcagcggctcgcgacggccacgcggttgctggctgtgcgggtgggcggcaggtgcgttgccacttgcaaatggatggatggacggcccacgccgccacgcgcgcgcgcgcggatggagatggagatgaaacgagactcggcgtgtgcctaccttggagcaggtaggcttagaggaggcagaaagcagtacacggcatttgcggtgcagctggtaggctgtcacgtttgcaagcttggagatgtatacaggagcccaaggattcattccagtggttatacctctctagtatggggcatgatcttcttgtcggtcggacaggacaagttttagggagagccagatatgattagcttatataaagtacagttcaatttgttacttagtaactctctcttttttggggggttgggagggaagaaggccagcagatgctgcgatgagtgctttgaagctactagaagtgttctccttttccgacaaaagcctcaatatttgttaaaaaggttaaaggttcagttataagcagatcatatcgatatcaagacagcacaaaagaaagagcagtttactagtatttctttttcaaaacaacatcaatatctcaggcaacttacttttgcaactgcgcgagcgtgcattagcctttattcattttgagggtgaaagatatgcaaaaaaaaaaaagaaggaacaggtgagttctagagtcctagcctggtctttcgaccattccacttatcagagaggcaacgtgcatgcttaccaggactccgctcgccgcagttaattagctagcttcgttttggccttttgggaagtaacaatcaatcgctgggttcgttttgtcgaaggttagatgctagctaggtttagatagtagtgcgcatgcatcagtgtatcggatcatgacactaatgagatccgcagccaaattaattcgtctaatctaatatgtttggcccccataaagatccactaataagaaaagttccccctttaaccataaaatcagtatgccggtgacagatcgtgtgtataggctgggcacttttctgcaggcagagatcggacaaggccagctcaaaaccttatctcctaattaaatccgactgtcacagtcccgaattaaagcactaatacagaatgagatgttaactaaggcgttaagcatgcagcttgttgtagacttgtagtgctcatctaatccctggataaacaacacaaaagcacccgtgcaaaaaaacggcagttcttacagcttgattctctgtggtactagctacagatggttatcatagctatgtctaattaggacaacaaatagttggactgaacaacaacacttatatgccccatgaaactaccaattgcaattttgtttttaaacatattttttatttcgcgcgcacaaaagaatagcatgacaatatattagaaggaaaagagtttttgttacacaatgcaatcggccagacaagctcacaaacctatgccaagggaaggaagaaaacgaaaaaacaagaaccgcaactaggtaaaagaaaggtaaactactacggataaaagctactcaaagctacgggagggtggaggcggagccacactacatccccaaaaaatctagaaaagtagcaacactagcggaagaccacatgcgaccctccgagaggatggactctagaaccacggagaccgagaaaagtgccgagtcgaaaactttgaagtcatgctccttccacaactgacaagagactaggagaaccagagagtcgaagccggtacaaaaatgctaaggtaaacaggccctagacgacggccaccagaccgctagcgagttgtatatgtattactttacctgtaatgggttcttttgacttaactattgtacaattgagttataataaagtgggatttacatatcagtgacttaattgcatgttcagttatgtttagtttgaattatgttagaggatctgctccttactttacctacgaagggtttgaattatggtactacagatattacatacatatgcacacttgataatattttagtgaggctagggatttattgccggtctttgtccatttaagtacgtgtagaagtgtgtgtacacgcgcatatatgtgtgctgtgtgttcagtgtaatcgaaaagaaaggaaacagaggttattacttttgttgcgctagcttgaactgggccataaattgaacttcaaagttaccgtttacccccgctatacagaggatccatttcggccgttccagcgtttacctaaaccccaattaaacatcacaaaagcctcatgcagaaacgtgggttcttgtcccagcttaattacaaaatacatatgcaccaagacacgaagtcattaagcaatataatatttaagccagtggcaagatcagcaacctttgtcatatgcagaactacaaatccaactaattcaccaccggctcgtccagatgtacgcgtcgtattgttagggatttaaaatttcaaagttaaaaagtcatccgtgcacggacggttcgacgatccccagctgttgttgctactgtcattgttgcacgaacggttagacatgtccactttgcctcctctgacccaggcatagatcgctttaggatttgcattttttttactcccatatcgcagctggttttacgtggattttgtgacatggcatcagcaatccttaacaactactcctattgaccagatcattgaagagctggaattgctcgtcatcaagaggcaagtaaacaatcccgatgagctaggcactggattatccgggattttatgttaacgttcaagctaatcgggaagctagagcacgcatcagcaatatgagcttttttttcctatccatctatcaactctaatccaaccaccaatttcgtgttaatttcatcaatttgagatgcatcttcccttgatcgcagagtatcaggtcttaagatctgtacgggatcagaacaaatccgagctccttatcctctatagtactcttcaagtggcaaatgtatgggacaaaagattaggatgtatatggacagcgtcattcaccataatcaaattttcttttcacgtaatcataatcaaatcttgccactaacacgctacaaaatgtcggtttctgtagtactagcattgatggaatcatcacagtagctagctttagttgccgcccacgtccatccctgcacaaacattcgcaccacctctctagtgcctatatggattgccggtttggcgacaaatcttcttctcccccatcttcagccgtggcttccttctatagggttgccgttgatgatgttggtcatggcgtctaactttagaactcttatcccaacggctcattggataacaaaagaacgcaccggaggtggataggatcggaggctgagttatgcacgaatctttaagtgaattggaccttaaggcttatattataagtgactccactacatcgtattactggtttaacttcaaagttagcgtagcttaacttgttatgttatttataatggaatatgttcaccagaatttaaatcataaacttaacatgttgatgcttgtatttacgaaagttctaaacttgacacgttatgctcgtaattataaaagtcttagacttgacacttaatatatgctggtcagtctctcgatgatgcttataagagtagggtgtgcatgtgaatagccctgcttgtgtacagtgtttttgaaataaaaaaaattatatgtacaccctcgctctgcttggttgtatttcttcttgtttttttttttaaaaaaaaagagctacctcaagctgttgttatggccgtaagtaaaagaaaatatgtaagtggtttataagatacaaggaaattaaggggagttaattttagaaagttgtaactaatttgtcaaaaatgtagtttgctacaagtttaactcatcatttcagagaaccgcaacaatagtgtaacatgggagttctttaataaagctgcgactttatttgtctcataaatttgagcccacatatcatccaaatatgtaatactcacatcgttttaagttggccttacacgccatacacatagagaatgtagttatagttttctaataaaatcatttgttattgttataattttgtgaaatacccaattaaaattgtagcaaagtgattagtgatagtttgaactaaacaaccatagtttttcaaaatttacttaggccttgtttggccatttcccatgaaaaaaatattagatgggattaattgaacaaaatcgtaaggataaattaacgccaggaacatatgaccatttggctgtgacaactgacaactaacgatgccagcgtggcagtttttccgctgaacatttgccatgaccacaacacttaccgtggacttcttctgtaaactttgcattttcttttggtcagcgcgacagctagacacctgatcagtgatttctgccaaactgatgctcgctggctggctagagtgacggacggtgtgaaagatatttgcggtggaccggggccatcttggctgtttacctccaccgaagggtaaagtgaaaatatccggtgctgacacggtaacactaggaggcctggcagcaagtacgtatccctggcccgttgtgtgcatggctcattgggcgtactccaactcctcgagctatctctcaagtctcactctccgcatcgttcttctatctctgatcaatcgtgtcatctctcggaagctcagtatctttttagcaaaacctcaaaagccacttgacaagactgcattagcattagcattagcgatgcccggctggctgacggaggaaacaaaggcagccgcctgctattcgcctagtcttctttgtcgagtatcctttcgttgcaggcagtagaaggtagtactagtactagtactatagatttactagccggcacacgctgcagaaactttttgtacaacatgggcccttttcttcatcaccatcatcgtcgtgttcgactgttcgtgttgtcatcggcggcattgttgctgtcgggttcgaatttgcaatcaacggcacgcctagcaggtgagaaaaaaattcgtcgggtgatctacaccgttaagcttgttgaaacggacggtggagaattaggcgcgattctctgtggccgcaatcaaccaacggagcaaggacagatcggcgaatctctacgggcgtcggcacacggcgatcgtcggcgccgggccgccggtttggcatcgagcaatgctactgctttaccatcctggccactgctgcaaacctgccaggctgccacacgcacgcgtaggcagtaggcacggagaagtgggccgtttggccccttttttgggccgttctctcaaaattcggcctttcaactgaaacgagacggtccttttgtacggtggatagaaagaggccggaactgggctttcgaattaagcccatatattacctcagcagctcagtgcattgagggtgctataatatttatcggtaatctacaacgattttgctaaacatttattgataaattttctcccaaaaatcaaaattaaatacaatataattatagtgtaattatattgtaacttgtatgtaactttcatataattttgaatagttagatttactcaaaattcatgcaaacggctaagggaaaaaatcacaaggcatgcacgagtgggagtattctaccccccccccccaacctccactttatgagaaaatttattgaaaaatatatagatagttcacctacaaaagccacaaggaaaacgctctcgaatttgttcgccatatctctttaactaacgaaaagtgaaacacgaggattaaccacatcatctgaaaaatattagccgtcggattcactgggagacaaaagagggtcaatcaatcttaaccattgaattagatggatgggaaatttcaagaggattccagaattgcatgaagctatactggaaagaaagacagaaggaaaagaaaagacctagagaataagcaggggaaaagataaggtggtgcatataattttgctatactggaaagaaagacagaaggaaaagaaaagacctagagaataagcaggggaagagataaggtggtgcatataatttttcgatatatgtatatatacatctatagtaaacattgtttataaataatatcctcatccttgggtaagctattcatgatgcactcaaaatgtatggttatgtgtgtatttttttttcatggctatagccttagagctatatatagacttgatatttttcctactatatcaatggaaaacattgcactatattttagttgtttcaaaagaacgtgtttgaggaagaaatcattacaaggatatgtacccacattccttccaaccaggcggccatgatcgcctaggtttttagaataatttcataatggttttcactgtatataggtttaatgattttgcacaaatattataaaatacatatataaaatatatgtgcacaggctataaaacacacaccgatggaaaataataggatctcattaccatagtaggctagttattgatgaacggattatttgttccattttctgaaaatatattttctcgaaggactttattctacttaaattactttaaacaacttgtgttaagctgtttttttaagtttattttttataatattcacccttacaatcaactagataatccgtaacaatgatcgagtgataagagcgtggtattgctaaatgatggcgttcggaatgtcttttcccgtgcatgtgaagagggttcatatgcatgttcagaagttcagcttgatactatcacacacagtacatactgcagatttgcagaacaatggacggttgacacagttcacatggagaacatcaggaccaaagctagcacaggcgttacataataacaccaccttataaagtgcacaatatagctccaccatcgcccaagcgacactatagtaggaactgtggagacatacgatccctaaactgctaaacaccacagaggaagaaagggatcgattttcgtaaagcttaactagctagcttaatttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctcttaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccactaagccgactcccggtccatcaccgcaaatactctcccgaggcatcgagtcacctatacatgaaacaaacaaagaaaccatatttcgagaccaagctatctccaacttaactcattcgtagcaaacaacagtattatatacgtatagtatccatctataagccatacccatgaaacaatcacggatatccaaagaaacaacccgaaaccgaaaccgacacagcgtcggccggtcagaccgcgggcaagccggtctgaccgctcacatagctcctgtctgaccggcaacaaccgcccggtctgaccggtcccgacaaatcagtaaaccctattcatctcctgaaaattgattatctccaaaaccacttcgacgataatctccaaatatcaaaaccgataatcacatatgtcaattgttcatcacagaataagaatcaaaacacacattgatcttacactataatcatgttttgttagatcaatatggttagtgcagatactaattgagatccgacgtgttgcaagagactatgggtgtcgatgtatatcctaatcctatcgtgtgtctagctcggttttttgctacaataatcagatcgacgaacaaattctgcatggaccgacgtatagtcctgcagactccagattgttcggccaataattcgagaccgtccaatatgacgcagaattgcacaggttcgttcaccgacaggcgacagcgagtccgtaacgcgtgactgttgcatggagccatggagtacctctgatttaatgacttgccccggacgtggcctgcctaaagccattgcacctctgcgatcgagcgtaaatggcggagctagatgagctagatgctggtcgatcgggttcatcagatgctgcttccttacagatttagatctgccaacacttctgacgacggggttgctggctctgcttgtgtaggtggcaaggacgaatttatgaagctatacgagcagcggccatgtgagagccatctgattacatttacagccgctgctgccccggtctgtgaggccagcagcaggaggcgtcaatgcgatagccggctagctagctagctctcgccttttatttactgcgtacgtctcgatcgtatgcatgcaacattgcaacatcgcgtctcgtacatgcgctgtatgaagcaagttcttgttgcgatcaacaggggaaagaaaatggccaatagtgtgtgcatgcctgtatggtgcgtgccgactgttgttgattacgtggtagctgttcatggcagtggatagaagaagtttgttggcaggtgaaaattaagtgcacgcgaactactcgctacattttccactgatgtctctgcaccgtcattcatttcagaatagcgcgcggctattcggggacctgctgtaaatttttcctctcctttttttgctcaccagatttctccggtggtcaacagggtttcccaaaccgttggggctagggttaccgtgccccggcggtaagcacggttaccgcgcggtaaccgcaaaaaaccgtacaaaactgtgtaaaatttatcaaaaattcaaattattttttaaatttatttgaatttaaagaggttaccgcggtatttatattaccgtacccccgcggtaagcccgataaccatgataaccgcgcggttaccgacggtaagtcgaaccgactggtcaccacaaga

SEQ ID NO: 999 - DNA, 1223 bp, Oryza sativa
cagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaaagaactagacgagcccggagataaaactataaaagggctctgtgagcaatttcgatgtagcacagatccatgccatggactcatgaaagaataagttcactccaggtccttcaacttgacgtcgagtctcttaaaccacaatctacttctacttctacttctacttatatatatatctctacttaaaaagtaaaacttgtttccgtcgtccgtatgaccgtaaagaaaaacacgtagaaaaaaaacagcgagaaaaagacttctgtcgaaaaaaaaattctgactcctattataaaaaaaacttccgactcccttgaaaaaaaggacttctcgtccgtaataaaaaaaattcaaaagaagtccgactcaggcttaagttcgatcggtagttttaaaaacagatttttaaggcaagtaacgataaacctcattagcactcattagcacatacatgagtactacttaaaaaattaaagatttttccatcgttcgtgataaaacatataaaaaggcgaaaaaacatataaaaagaaaaagaaaggaaagtctgagtcatcaatgacgcggagaaaaaaacctccgttcgtgataaaaaaaagggcgaattttttgttcttcacggagaatctaaaataatcatccaatcggacaattacacaaatcgagaaacctaaaaaaaggggaaaaagagaggaaaaaaatcacacagatgagcaagcttgccgtcaaatccggttgttccgagctcgtcgccatcgccgccgaccgcgctcctgtcgtggccttgcccgctgggcatggccacactcggcacatcccaacccgcgctggcaccccctccctctacccggtgccccgccctccgacgctctcctcttgcttggagacagaggagagaaagagaggtggatggccatcgccgaggtctccgcgccgtaagctcgtagccccgccattgaggctgacggggagagaggaaggggaaggatggtcgtcgccgccgtcgtcgtcgctgtcgtacccttgccgtcgctgcactgcgtcgagcactcactgacatgtgc
